United States Patent 8,299,318 (NUCLEOTIDE SEQUENCES AND CORRESPONDING POLYPEPTIDES CONFERRING MODULATED PLANT CHARACTERISTICS) - sequence listing, part 10

SEQ ID NO: 26408 - DNA, 631 bp, Panicum virgatum
  misc_feature: Ceres CLONE 1869154
  misc_feature: Encodes the peptide sequence at SEQ ID NO. 26409
accgatacctcactcccctcctcccggcgccgccgctgctgctcgccatggacgccggcggcctcgcggcggggtcgcacatgcggggcgagctgcacgtcgtgcgcggccgcgacgcggagccgggcgccgcccggagcgccgcggcggacgtgaggacgtgccgcgtgtgcggggacgaggtcggggcgcgggaggacggacagcccttcgtggcgtgcgccgagtgcggcttccccgtgtgccggccctgctacgagtacgagcgcagcgacggcacgcagcgctgcccgcagtgcaacacccgctacaagcgccacaaagggtgcccgagggtggaaggggacgaagacgacggcccggagatggacgacctggaggaggagttccccgccgccaagagcccgagtaagaagccccacgagcccgtcgccttcgacgtctactcggagaacggggagcacccgccgcagcggtggcggacgggaggccagacgctctcctccttcaccggaagcgtggccgggaaggacctggaggccgagagggagatggaggggagcatggagtggaaggaccgcatcgacaagtggaagaccaagcaggagaagaggggcaacaagctcaaccc

SEQ ID NO: 26409 - protein, 194 aa, Panicum virgatum
  misc_feature: Ceres CLONE 1869154
  misc_feature: SWISSPROT Homolog: EC 2.4.1.12 Cellulose synthase (UDP-forming)
  misc_feature: Functional homolog of the protein sequence given in SEQ ID NO 50363
  misc_feature: Useful for making plants with altered cell wall content and/or composition
  misc_feature: Useful for making plants with modulated biomass
MDAGGLAAGSHMRGELHVVRGRDAEPGAARSAAADVRTCRVCGDEVGAREDGQPFVACAECGFPVCRPCYEYERSDGTQRCPQCNTRYKRHKGCPRVEGDEDDGPEMDDLEEEFPAAKSPSKKPHEPVAFDVYSENGEHPPQRWRTGGQTLSSFTGSVAGKDLEAEREMEGSMEWKDRIDKWKTKQEKRGNKLN

SEQ ID NO: 26410 - DNA, 747 bp, Panicum virgatum
  misc_feature: Ceres CLONE 1869161
  misc_feature: Encodes the peptide sequence at SEQ ID NO. 26411
gtgtacaatgccagctccaatcatatcgagcacccatcgctcttcaattttgatggtacacgcccgtgtcctgcatcccgcccgaccgatgatgatggagctaccagcaccgtcgccgacgacatccttcctcgccgtcgtgctcgccgccgctctcttcctcgcgtccatcctccgcctccgcgggcgcgccgcgcgcaagtacaacctcccgccgggcccccggccgtggccggtgatcggcaacctggacctgctcggcccgctcccgcaccactccgcccgcgacctctccgcgcggcacggcccgctcatgtcgctccggctcggctccttccccgccgtcgtcgcctcgtcgcccgacatggccaggttcttcctcaagacccgcgacctggcgttcgtggaccgcccccggacggccgccggcaagtacatctcctacaactactccggcctcttctcctcgccctacggcgcgtactggcgtcaggggcggaagctctggcaggccgagctcttcaacgcgaggcggctcgcgtcgctcgagcacgtccgcggcgaggaggtgagctccatgctcagcgacctgcgcgccgctgctgcggcggcggcggccggcggcgggcgcgcggaggcggtggcgctcagggagcacctgttcatggtgaacctcaacgtcatctcgcgcatggtgctgggcaggaagtacatcgtcgatggggctggctcgccgttcacgcctga

SEQ ID NO: 26411 - protein, 217 aa, Panicum virgatum
  misc_feature: Ceres CLONE 1869161
  misc_feature: SWISSPROT Homolog: EC 1.14.13.21 Flavonoid 3'-monooxygenase
  misc_feature: Functional homolog of the protein sequence given in SEQ ID NO 50304
  misc_feature: Useful for making plants with altered carbohydrate content
MELPAPSPTTSFLAVVLAAALFLASILRLRGRAARKYNLPPGPRPWPVIGNLDLLGPLPHHSARDLSARHGPLMSLRLGSFPAVVASSPDMARFFLKTRDLAFVDRPRTAAGKYISYNYSGLFSSPYGAYWRQGRKLWQAELFNARRLASLEHVRGEEVSSMLSDLRAAAAAAAAGGGRAEAVALREHLFMVNLNVISRMVLGRKYIVDGAGSPFTP

SEQ ID NO: 26412 - DNA, 733 bp, Panicum virgatum
  misc_feature: Ceres CLONE 1869162
  misc_feature: Encodes the peptide sequence at SEQ ID NO. 26413
atcactgtgcaggtcacccggagcgggtacaggcagaaactctcaatatatgatcttctggccggcgacattgtccacctctccattggtgatcaggtgccggctgacggtctgttcttgtcaggcttctcgcttctgatcaacgagtcaagcttgactggagagagcgagccagttgctgttaatgctgagaacccgttccttctgtctggaaccaaggtgcaggacggttcttgcaagatgcttgtcacgacagtcggcatgaggactcagtgggggaagctgatggccactctcagcgaaggtggtgatgacgagacgccattgcaggtcaagctgaatggcgtagccaccatcattggtaagataggcctcatctttgcagtcatcacatttgcagtgctgaccgaaagcctgttccggcgcaagatcagcgatggcacatacttgagctggactggagatgatgcattggagctgcttgagttctttgccattgctgtaacaattgtggtcgtggcagtccctgaagggttgccgcttgccgtgacactgagccttgcatttgcaatgaagaagatgatgaacgacaaggcactcgttcggcaccttgcagcctgtgagaccatgggctcggcgacctccatctgcagcgacaagaccggcacactcacgacaaaccacatgactgtcgtcaaggcctgcatctgcagcaagattaaagatgtggatg

SEQ ID NO: 26413 - protein, 244 aa, Panicum virgatum
  misc_feature: Ceres CLONE 1869162
  misc_feature (2)..(209): Pfam Name: E1-E2_ATPase Pfam Description: E1-E2 ATPase
  misc_feature: SWISSPROT Homolog: EC 3.6.3.8 Calcium-transporting ATPase
ITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVITFAVLTESLFRRKISDGTYLSWTGDDALELLEFFAIAVTIVVVAVPEGLPLAVTLSLAFAMKKMMNDKALVRHLAACETMGSATSICSDKTGTLTTNHMTVVKACICSKIKDVD

SEQ ID NO: 26414 - DNA, 1295 bp, Panicum virgatum
  misc_feature: Ceres CLONE 1869164
  misc_feature: Encodes the peptide sequence at SEQ ID NO. 26415
gcccggcgcgcggtggcgacaccgctacgtccacgcggcttaccgcttcctccctggctgcccctgcgcagcgcagctgcccacggcaccagtgcaccacgcacacccgcgcaccaggattgcggcgctgcgctcgcgaatccgcgaacaatcacaacagccaccgcaacgccacccgcccgcaccatccttctctcttccgctcatcgtctccaccctcttgtgggggcaaagccgcgaggggataggcagataggcacaggtagacaggacaaagatcggaattagtcacgcacccaggagagccaggggggacggagagagagccaagagagggaggaggaaaccttcttcttcctcgccgcctcctcttttcctggtcgcgtcttctttgttcttgaatccgccggcgagttcttgcgtccgggcgtggcaatctgcatctttttttttctctccatcctgtccgaacccgtgtaaccgaagaactcaatcaaatcgaattggaaaagaacgtaaattttaatctgctaggtaggggtgggggcaagggcgggcggtcttgacaggaggtaaggcggcccggccgattgatcggcgatggcgccgccgtccagggactactggctcggcttcttccgcggcgcgggcgacaacatcttcgacgccatcgacgcggccatcactgtcgccgcgtccgaccacccgggcgccctccgcgagcgccgcgacggcatcgccgagcgcctcttcaccgcgctcctggtgaccggcgccacggcggcgcccgggccggcggcggtcgctggggcggcggcggggacccccgtggcgggggcgcccacgccggcgcagctccaccacgagggcgccgccagcgtacccagcctctgcagctccgaccgcgccgaggccatcaccgacgatggcgcgccgcgctgcgacgatcccgtcctcgctgagaccgagcgcatcaaggccatcctcctcaacgaccaagaaaagtcggaggccgagttgttggagctgctccggcggctgcaggagttggacttagcgttcgacacgttggatgttactgcgattggcaaggctgtggccaacttccgtaagcacagctccaagcagattcggaacctcgtcagatcgctcattgaaagttggaagcgtacagttgatgtgtggattgctcgccgccgagaggctgttgtagatcacacacctcagtccatgggtccttccagcttggagcaggaggaacgaggggtgaactccaccccgatggatgaaggtga

SEQ ID NO: 26415 - protein, 231 aa, Panicum virgatum
  misc_feature: Ceres CLONE 1869164
  misc_feature (116)..(202): Pfam Name: TFIIS Pfam Description: Transcription elongation factor S-II protein N terminal
MAPPSRDYWLGFFRGAGDNIFDAIDAAITVAASDHPGALRERRDGIAERLFTALLVTGATAAPGPAAVAGAAAGTPVAGAPTPAQLHHEGAASVPSLCSSDRAEAITDDGAPRCDDPVLAETERIKAILLNDQEKSEAELLELLRRLQELDLAFDTLDVTAIGKAVANFRKHSSKQIRNLVRSLIESWKRTVDVWIARRREAVVDHTPQSMGPSSLEQEERGVNSTPMDEG

SEQ ID NO: 26416 - DNA, 691 bp, Panicum virgatum
  misc_feature: Ceres CLONE 1869164-R
ggaatttgttgctgagatgcttgcaagaccttcaaacgcagagtcaggccctgggagaccacaggcaaggcctaggcagcatcaagatgcttcaccagctcaaggcaggacgcagtcggctccatctgagaaatcggcagcccaccatgatccaaactctgtccgagcaaagctggaactcgccaagaatgcgaagctagaggccactaagagaaaacttcaggaaggctaccaagaatttgataatgcgaagaagcaaagaaccatacaaatggtggatccgcaaaatttgccgaagcaagggaacaacaggaatttccaacctagtggcaagccaaggaataacagcaacatcaacagcaatcggaattggtcaagatgaggcaccaattccactaagcagcagcgactataggattgcaaccatcaaatccccttcaaaacttcattcttctcctctctatttttttttggggttatgatcggctaaatttttagtccaggccagtacataaacagcagcaataaggcttggttcagaattgctcacattgcccccacagacacttccccagaggtgcattgcgtgtttgcattctctggccttggtcacagttgctggtcctagtgcttgtcaaacctgtaaagatacgatgctgagtcctaataccaattctgatcttgagctccg

SEQ ID NO: 26417 - DNA, 704 bp, Panicum virgatum
  misc_feature: Ceres CLONE 1869175
  misc_feature: Encodes the peptide sequence at SEQ ID NO. 26418
agcccctgctcccactcccccatcccaccgacacgcggcgtgtgacacgcctgcgctaaaaccctagccgccccaggcccgatggccgccccgccgcagccgcagccgccgccggcggaggagggggccgcaccggccgctcccctgcccgccgccccgccggggcctcggccgtacgaggtggcggtcgcggcggccgagctccgaccggtggactgcaacctcgcggcgctctgcgaccacgtccaggcggagggcttcggctccggggccttctccgatgtcgtcgtggaggccatgggcgcctacttcaggaatatgctacatggtccttggagagaggctggagcacctaccgtggtcctgcacattgatgatgccaatgttgattcagaggcaattgcaatcgctttggcatatctttatgggcaacctcccaagcttaatgataacaatgcatttcgggtgctcgcagctgcatcatttctggatcttcaggacttatgtacaatatgtacagattttattatttctgagctttggacatcaaactttttacaatatcagttgtttgctgaaagtcaagattatggtagtcatggggaacgtgtcagaaatgcctgctggggttatctttgtcaaagtgccacactggaactacgagaggtgctaccgaagctttcttcacaaactttgcatgctct

SEQ ID NO: 26418 - protein, 207 aa, Panicum virgatum
  misc_feature: Ceres CLONE 1869175
  misc_feature (52)..(153): Pfam Name: BTB Pfam Description: BTB/POZ domain
MAAPPQPQPPPAEEGAAPAAPLPAAPPGPRPYEVAVAAAELRPVDCNLAALCDHVQAEGFGSGAFSDVVVEAMGAYFRNMLHGPWREAGAPTVVLHIDDANVDSEAIAIALAYLYGQPPKLNDNNAFRVLAAASFLDLQDLCTICTDFIISELWTSNFLQYQLFAESQDYGSHGERVRNACWGYLCQSATLELREVLPKLSSQTLHA

SEQ ID NO: 26419 - DNA, 702 bp, Panicum virgatum
  misc_feature: Ceres CLONE 1869180
  misc_feature: Encodes the peptide sequence at SEQ ID NO. 26420
gcacctcacaagagagttcagagttcaccacttcatctcatcggctcgtccaaatcgccggcgccgatggagcccaatcccaatcccaatcccaccccgaccgtggtgctgcacgcctgcctcggcgtgggccacctgatcccgatggtggagctcgccaagctgctcctccgccgcggcctcgccgccgtcatcgccgtcccgaccccgccggcctccaccgccgacttcttcgcctcctccgcctccgccgtcgcggagctcgccgccgccaacccctccgtctccttccaccacctcccgccgccggactaccccgccccggacccggaccccttcctccagatgctcgacgcgctccgcctcacggcgcccgccctcgccgccttcctccgctccctcccctccgtcgccgcgctcgtgctcgacctcttctgcgtcgacgcgctcgacacggccgcatccatcggcgtcccggcctacttctactacacctcctgcgccggcgacctcgccgcgttcctccacctcccccactacttcgccgagacggacggcggcgctagcttcaaggacatgggcaaggcgctccttcgcttccccggcgtcccgccgatcccggcgtcggacatgccgcacacggttctcgaccgcgcggatcggacctgcgccgtgcgggtcggccactacggccgcatcccc

SEQ ID NO: 26420 - protein, 211 aa, Panicum virgatum
  misc_feature: Ceres CLONE 1869180
  misc_feature: SWISSPROT Homolog: EC 2.4.1.115 Anthocyanidin 3-O-glucosyltransferase
MEPNPNPNPTPTVVLHACLGVGHLIPMVELAKLLLRRGLAAVIAVPTPPASTADFFASSASAVAELAAANPSVSFHHLPPPDYPAPDPDPFLQMLDALRLTAPALAAFLRSLPSVAALVLDLFCVDALDTAASIGVPAYFYYTSCAGDLAAFLHLPHYFAETDGGASFKDMGKALLRFPGVPPIPASDMPHTVLDRADRTCAVRVGHYGRI

SEQ ID NO: 26421 - DNA, 730 bp, Panicum virgatum
  misc_feature: Ceres CLONE 1869185
  misc_feature: Encodes the peptide sequence at SEQ ID NO. 26422
gacaaagcgtcgatcgaaacacggcagagacactgcgcatcatgctccggagctcgccggcgtcgccggtcaagccgcagcaatggacggtgtgccggagcggcgcggcggtggtggcgtccccgccaccggtggtggccgtcgcgccgaggacggttgcctccgctcctctccgcgccctgaccaccgagtcagcggaaacgcatcccgtgcctgagcctccgccattgttcgccgacgacgatgaggagacgatgctcgccagctacgtcccggtctacgtcatgctcccagtaagctcgcgccaccagagcggccgtcccaaatcgctccatcgagctcagccagtgattctgaacctgcttgattgatcgcatcgcatcgcactgaacacgacacattgcgcgcggcagctggacgtgatgagcaccgagaacgagctggaggacgcggaggggctccggcggcagctgcggcggctgcggggcgccggcgtggacggcgtcatggtggacgtgtggtggggcatcgtggagggcgccgggcccgggcggtacgagtggcgcgcgtaccgagagctgttcggggtcgtgcaggccgaggggctcaagctgcaggccatcatgtccttccacgcgtgcggcggcaacgtcggcgacgccgtcagcatcccgatcccgcgctgggtgcgggaggtcggcgaggccgacccccacgtgttctacacgag

SEQ ID NO: 26422 - protein, 102 aa, Panicum virgatum
  misc_feature: Ceres CLONE 1869185
  misc_feature: SWISSPROT Homolog: EC 3.2.1.2 Beta-amylase
MSTENELEDAEGLRRQLRRLRGAGVDGVMVDVWWGIVEGAGPGRYEWRAYRELFGVVQAEGLKLQAIMSFHACGGNVGDAVSIPIPRWVREVGEADPHVFYT

SEQ ID NO: 26423 - DNA, 704 bp, Panicum virgatum
  misc_feature: Ceres CLONE 1869187
  misc_feature: Encodes the peptide sequence at SEQ ID NO. 26424
acgagcagctcgttcatcaccgaccctcaccgtctcgtctccctgctccgctccccgcacgcgctcgcccctccctccctctctcccctcctcaccgccgctcgcgccccgtgccgtttccgccatgtgtggcatcttcgccgtgctcgggctgaggcaccggggacccgactggtcgggggtgtaccagcacgagggcaacttcctcgcccagcagcggctcgccgtcgtctccccgctgtccggcgaccagccgctcttcaacgaggaccgcaccgtcgtcgtcgtggccaatggggagatctacaaccacaagaagatccgaaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgacggttccgtctggttcgcctccgagatgaaggcgctgagcgaggactgcgtccggttcgagcacttcccgccggggcacctctactccagcgccgccgcggggttccgccgctggtacaacccggcctggttcctcgagcaggtgccggcggcgccgtacgacccgctcgtgctca

SEQ ID NO: 26424 - protein, 193 aa, Panicum virgatum
  misc_feature: Ceres CLONE 1869187
  misc_feature (2)..(144): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGIFAVLGLRHRGPDWSGVYQHEGNFLAQQRLAVVSPLSGDQPLFNEDRTVVVVANGEIYNHKKIRKQFTGKHTFTTGSDCEVIIPLYEEYGENFVDMLDGVFAFVLYDTRNKTYMAARDAIGVNPLYIGWGGDGSVWFASEMKALSEDCVRFEHFPPGHLYSSAAAGFRRWYNPAWFLEQVPAAPYDPLVL

SEQ ID NO: 26425 - DNA, 765 bp, Panicum virgatum
  misc_feature: Ceres CLONE 1869207
  misc_feature: Encodes the peptide sequence at SEQ ID NO. 26426
atctccgccccctccactcccacctccctccctctgcgaggggcaaagcaaagcaagccgcaaagaccccctcctcctttccacaccccacgcctcgtcactgtgccgcccgtgccctcccgtcccaccaccaataatccaccacccccaccccgctgcagcggcgatgtgcggcggcgccatcctctccggcttcatccggccgtccgggccggcggccaagaagcagcagcagcagctactgcagcaccagccccgccgggtcacggccgacttgctgtggccggggcccggcaggaagggagcccccgtgggggatgacttcgaggccgacttccgcgagttcgtgcgcgggctcggcgaggacgacggcgcggacgccgccggcggcgacgaggtccaggaggtccccccgccggagccggcgatgtacgccttcgccgccgcggccaaggcggcgacccccgcagttgatggtgtgatgactgttcaaaatgatgaacctactgctacctcagcaaagcgcaaccggaagaatcagtacagggggatccgccagcgtccctggggcaaatgggcggctgagatccgagaccctagcaagggtgtccgtgtttggcttggaacttacaacacggccgaggaggccgcaagggcatatgacgctgaagctcgaaagattcgtggcaagaaggcaaaggtcaattttcctgatgaagcgccagatgctcagaaatcaatcctaagcccactactgtcaatcca

SEQ ID NO: 26426 - protein, 199 aa, Panicum virgatum
  misc_feature: Ceres CLONE 1869207
  misc_feature (124)..(175): Pfam Name: AP2 Pfam Description: AP2 domain
MCGGAILSGFIRPSGPAAKKQQQQLLQHQPRRVTADLLWPGPGRKGAPVGDDFEADFREFVRGLGEDDGADAAGGDEVQEVPPPEPAMYAFAAAAKAATPAVDGVMTVQNDEPTATSAKRNRKNQYRGIRQRPWGKWAAEIRDPSKGVRVWLGTYNTAEEAARAYDAEARKIRGKKAKVNFPDEAPDAQKSILSPLLSI

SEQ ID NO: 26427 - DNA, 2909 bp, Panicum virgatum
  misc_feature: Ceres CLONE 1869222
  misc_feature: Encodes the peptide sequence at SEQ ID NO. 26428
aggagatagctggacagtggttcgccaatcaccatcagtagcaccatactactagcttgtgacttgtgagcgagtgatggcggtagcagcaggggctaacgacgacggcgagcaggccgctgctcgtgatgagccaacagcaccaacaacccccgcagtcgcaatgcccagactagatccgcagctgctcatggctgctcgccgcggcgacagcaacgagctcaagcgtcttctacagccgctggaggagaaggaggcgactgcaccagcaccggaggtcgccgtggtagttgacgacgatgggccgcctcctcctgttgctgcacatgcgtcggcctgtggacgatcgtcgtcactccttttcggggtgaccgctatgggcgactctctgctgcacgtggttgccgccgcatgcggcgacggcgacggcttcgtggagtgcgccaagacgatctgcggcaagaagggtggggggcgcctcctgctcgcgtgcaacaagaatggcgacacacccttgcactgcgccgccagtgctgggaacgccaccatgatctcctgcctcctcgatctcgccgacgatcagcagggggcgatggccatggtgagagtgcagaaccagtgtggggagaccgccttgcaccacgcggtcaagcgggcctgctgcatgatgcgcaaccgcccgtggcccgtggtcgtggatgctgactatatagagcgcctggcctgcgtcgacaagctcatggccgtggatccagagctggcctgcatcccacatgatggggacggtgcttcgccgttgtacctggccatttcgttgggtgaaatggagattgcacgacacctgtttaccaagaccaaaggcaagctgtcctactccggaccagacggacgaaacgtcttgcatgcagctgtttcttgtgcgagtaacgtccaagcgcttggtatggttttgaagtggctcaagcaagaagcaccaaagacgcccaaccaaggagggtcgtctgacgacgatctcctgaagcgactcactagccaaggggacaagaagaacgggagcacccctcttcacttggctgcgtccttgtggggcttcccgtccacatgcattgttcccacttggtcttggatgtggtcagggtggcggcgtgtggtgatcgatgagctgctaggcgctaacgcatcgacggcgtaccaggcggacacgtacgggctgtaccccatacacgtttctgcaggggttggctccatcgtcgccatccgcaggatactagaaaggtgcccggagtgcgccagcctgcgggatggcaagggaaggacgttcctccacgtcgctgttgacaaggggatgtttggcgtggttaaatacgtgtgccgaacgccggagatgtcatggatgctgaatgccatggacgacaacggggacaccccgctccaccgagctgtgtatgctgaaaatctcagggtcttcggacgtctcttttggaatccacaggtacgcctggatgttgtgaataaggagggcatgcgaccggttgatgttgcatggagcaggatgcctctagaggcttattatgcatgggatccaagaatacatatacgaaattcactattaaaagtggcagctccatatggtgaaagcagtcggggcgacctcttcaagcaaaaacatgctgacctcttcaagcaaaaacatgctgacgacaaaacccaggcgcaattattagcaggaggcgaggacactacctcggcgaataaacatcatgctgacaacacccatcagcagttgtttgaaggaggcgagggcactatatcgtcgactctaacatctgcggcgcaagtcatgggtatcctatccgtccttgttacaactgtcacatttgcatcagccttcacgttgcctggaggatatcgagccgacggcggcgacgctgcaggcacgccggtgcttgccgggagctatgctttcgaggccttcgtcctcgctgacgctatggcatttatctgctctctgttagctacctctttcctgctctatgccggggtgcctgcttttaccctcacggaccgcttccaaaccgtgaatgaagcatacggcttgatgatgcattcagcaaggagcttggtggccgctcttggcttggggctctacgtcgcgctgcatccagttgcccgcaccattgcacttgtcatcgctgtctggatgagcatgcttgtatatggcttcaccaaggattcggaaggcatcgattatatgtttagctatcctataattccaagacagaaactctcggcatggagtcgcgtgttaggctggattatctatttgttggaacgcctctggtcctacatactaatcttcggcgtcccggcaattcgcaagtgggcaaggggaaggtagcccgccaacaagttacaacacctaatctcaagctactagtgtctctcctcgtgcatgcatggttcaaagaccacctagagtacctggtctcgcgatcgatgatggcagttgctgtggttggttggttgttgttgtgatggtgctgtcttgttggccgcgtactttaattcgtcgtgtgagtagtgtaattttcttatttttgtggttggttggttgttgttgtgatggtactgtcttgttggccgcgtactttaattcgtcgtgtgagtagtgtaattttcttatttttatggttggttggttgttgttgtgatggtactgtcttgttggccgcgtactttaattcgtcgtgtgagtagtgtaattttcttatttttgttgtgttttattgttttattaggtttctcattctctattaatactagcagagagggcacgtgcaacacgcacgtgatacaaaattatttgccttttctcttgaagtcgatactacccacccgtatcggttgcg

SEQ ID NO: 26428 - protein, 773 aa, Panicum virgatum
  misc_feature: Ceres CLONE 1869222
  misc_feature (142)..(181): Pfam Name: Ank Pfam Description: Ankyrin repeat
  misc_feature: SWISSPROT Homolog: EC 3.1.1.4 Phospholipase A(2)
MAVAAGANDDGEQAAARDEPTAPTTPAVAMPRLDPQLLMAARRGDSNELKRLLQPLEEKEATAPAPEVAVVVDDDGPPPPVAAHASACGRSSSLLFGVTAMGDSLLHVVAAACGDGDGFVECAKTICGKKGGGRLLLACNKNGDTPLHCAASAGNATMISCLLDLADDQQGAMAMVRVQNQCGETALHHAVKRACCMMRNRPWPVVVDADYIERLACVDKLMAVDPELACIPHDGDGASPLYLAISLGEMEIARHLFTKTKGKLSYSGPDGRNVLHAAVSCASNVQALGMVLKWLKQEAPKTPNQGGSSDDDLLKRLTSQGDKKNGSTPLHLAASLWGFPSTCIVPTWSWMWSGWRRVVIDELLGANASTAYQADTYGLYPIHVSAGVGSIVAIRRILERCPECASLRDGKGRTFLHVAVDKGMFGVVKYVCRTPEMSWMLNAMDDNGDTPLHRAVYAENLRVFGRLFWNPQVRLDVVNKEGMRPVDVAWSRMPLEAYYAWDPRIHIRNSLLKVAAPYGESSRGDLFKQKHADLFKQKHADDKTQAQLLAGGEDTTSANKHHADNTHQQLFEGGEGTISSTLTSAAQVMGILSVLVTTVTFASAFTLPGGYRADGGDAAGTPVLAGSYAFEAFVLADAMAFICSLLATSFLLYAGVPAFTLTDRFQTVNEAYGLMMHSARSLVAALGLGLYVALHPVARTIALVIAVWMSMLVYGFTKDSEGIDYMFSYPIIPRQKLSAWSRVLGWIIYLLERLWSYILIFGVPAIRKWARGR

SEQ ID NO: 26429 - DNA, 436 bp, Panicum virgatum
  misc_feature: Ceres CLONE 1869232
  misc_feature: Encodes the peptide sequence at SEQ ID NO. 26430
cacggcccccaagccctccgccgccgcggacctccccgagggcgcgcagtggcgctacagcgagttcctctccgccgtcaagcgcggcaaggtcgagcgcgtccgcttctccaaggacggcggcctgctccagctcaccgccgtcgacggccgccgcgccaccgtcgtcgtccccaacgaccccgacctcatcgacatcctcgccaccaacggcgtcgacatctccgtctccgagggcgaagccgccgggcccgggggcttcctcgccttcgtcggcaacctcctcttccccttcatcgccttcgcgggcctcttcttcctcttccgccgcgcgcagggcggcccgggcgcgggccccggcggcctcggcgggcccatggactttggacgattatacaagaacttccacgaagacccctgagacagcggcctcttc

SEQ ID NO: 26430 - protein, 139 aa, Panicum virgatum
  misc_feature: Ceres CLONE 1869232
  misc_feature (15)..(135): Pfam Name: FtsH_ext Pfam Description: FtsH Extracellular
TAPKPSAAADLPEGAQWRYSEFLSAVKRGKVERVRFSKDGGLLQLTAVDGRRATVVVPNDPDLIDILATNGVDISVSEGEAAGPGGFLAFVGNLLFPFIAFAGLFFLFRRAQGGPGAGPGGLGGPMDFGRLYKNFHEDP

SEQ ID NO: 26431 - DNA, 719 bp, Panicum virgatum
  misc_feature: Ceres CLONE 1869237
  misc_feature: Encodes the peptide sequence at SEQ ID NO. 26432
gaccatctcaatggcggcggctgctacctccttcgctaccctcgccatcgcgcggccggcgacggcagcggcggcggcatccgggcagcgggccctccacgcctccaaggcctcctcgccgctcctatcctcccgcggtgcccgcctccactcacaggccgtttccttctccgggggcctggcgccttcgccctcccacagccgcgcgcgcttcgtcacatccgccagcgccgaacccaaggaagcagaaatccagtccaaaatcacaaacaaggtgtactttgacataagcatcgggaaccctgtggggaagaatgttgggaggattgtcatcggcttgtatggggatgatgttccccaaacagcagagaacttccgtgctctttgcactggagagaaagggttcggatacaagggatccagtttccaccgtgtcatcagggatttcatgattcaggggggagattttgacaagggcaatgtatgtttttacctactaccactaaactctggcgtgcacttggatatttataccattgtgcacattcagttcagagaaattaaagaatattttcggactgctgtgcttatatgctctatcaaaagattgaatggttcattttacctttttttttaattgtacaaatgtacttatttaatcttgttggttgttactgctaattattttctcattttgggggtatcgttcagagtacttc

SEQ ID NO: 26432 - protein, 208 aa, Panicum virgatum
  misc_feature: Ceres CLONE 1869237
  misc_feature (88)..(200): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAAAATSFATLAIARPATAAAAASGQRALHASKASSPLLSSRGARLHSQAVSFSGGLAPSPSHSRARFVTSASAEPKEAEIQSKITNKVYFDISIGNPVGKNVGRIVIGLYGDDVPQTAENFRALCTGEKGFGYKGSSFHRVIRDFMIQGGDFDKGNVCFYLLPLNSGVHLDIYTIVHIQFREIKEYFRTAVLICSIKRLNGSFYLFF

SEQ ID NO: 26433 - DNA, 664 bp, Panicum virgatum
  misc_feature: Ceres CLONE 1869242
  misc_feature: Encodes the peptide sequence at SEQ ID NO. 26434
gcaacaaccctagcgccgcagtccccatcgcagccgtgcgcgtggccggggccggcgcgagctcgcccgccggcgccgccatccatcccatcgcagccgcacgcgtggccggggccggcgcgagctcgcccgccggcgccgccatccatcccatcgcagccgcacgcgtggccggggccggcgcgagctcgcccgccggcgccgccatccattcccatcgcagccgcgcgcgtggccggggccggcgcaaggtcacccgcatctccgcccgtccgctggcgccgcatctccaacccgctcggactacatccagcaggtcgcgccgcaacggcctgctcaagaaggcctacgagctctccgtgctctgcgacgccgagttcgcgctcatcatcttctccagccacgacaagctacgagttcgggagcaccggatctgctgcttttacccttaatttcactttccctttgcggaaaagatctgcgagtagtcgagagctctactcctgtactcctgtacatctccgccctacgccgccactgctccagcggcactagatggaggcggcagacggagcaatggttaattttatagtattgcaggagttacctttcagtttagttgagcatgcaccttttccgagattcattgctactttaaacccat

SEQ ID NO: 26434 - protein, 149 aa, Panicum virgatum
  misc_feature: Ceres CLONE 1869242
  misc_feature (97)..(142): Pfam Name: SRF-TF Pfam Description: SRF-type transcription factor (DNA-binding and dimerisation domain)
NNPSAAVPIAAVRVAGAGASSPAGAAIHPIAAARVAGAGASSPAGAAIHPIAAARVAGAGASSPAGAAIHSHRSRARGRGRRKVTRISARPLAPHLQPARTTSSRSRRNGLLKKAYELSVLCDAEFALIIFSSHDKLRVREHRICCFYP

SEQ ID NO: 26435 - DNA, 749 bp, Panicum virgatum
  misc_feature: Ceres CLONE 1869257
  misc_feature: Encodes the peptide sequence at SEQ ID NO. 26436
attgttggcaatgtgttctagtgacttcatttgcttttatgactgggttgattgcagactaatacgccgaattgatgtcactgttaagaacctttactgggctgatagcggtgacctagttgcaatagcaagtgatacgtcattctacatcctcaagtacaatagagatgttgttgcttcttatctagaaggtggaaagcctgtggacgaggaaggtgttgaagatgcttttgagctgcttcatgaggtcaatgagcgagtgcgtactgggatttgggttggagactgcttcatatataacaattcatcttggcgcctaaattattgtgttggtggtgaggttaccacaatgtatcacttggatcgccctatgtatttgttgggatatcttgcgaaccaaagtcgagtttatctaatcgataaggagtttaacgtcattgggtacacattacttctcagtttgattgagtacaaaacccttgtgatgcgtggggatttggaacgcgcaaatgaaattttaccatccataccaaaggcacaatataatagtgtcgctcatttcttggagtctagaggtatgttggaagaggctcttgagatagccactgatgctgactataaatttgatctagctgtgcagcttggaaaattagatgttgcaaaggctatcgccataaaagcacaaactgaatctaaatggaagccgttgggcgaactctccatgtctacaggcaagctagagatgggcg

SEQ ID NO: 26436 - protein, 249 aa, Panicum virgatum
  misc_feature: Ceres CLONE 1869257
  misc_feature (1)..(249): Pfam Name: Coatomer_WDAD Pfam Description: Coatomer WD associated region
LLAMCSSDFICFYDWVDCRLIRRIDVTVKNLYWADSGDLVAIASDTSFYILKYNRDVVASYLEGGKPVDEEGVEDAFELLHEVNERVRTGIWVGDCFIYNNSSWRLNYCVGGEVTTMYHLDRPMYLLGYLANQSRVYLIDKEFNVIGYTLLLSLIEYKTLVMRGDLERANEILPSIPKAQYNSVAHFLESRGMLEEALEIATDADYKFDLAVQLGKLDVAKAIAIKAQTESKWKPLGELSMSTGKLEMG

SEQ ID NO: 26437 - DNA, 2000 bp, Panicum virgatum
  misc_feature: Ceres CLONE 1869259
  misc_feature: Encodes the peptide sequence at SEQ ID NO. 26438
atccccattcctggcccagccaagaacaccgcggcttgcggctgcggttacactactcaagtgtgcacaaaaaggtccatgcttcctctcgcttcccttttctgctccgtgaaggcacaagcagcagatcttggattcggctgcaggtggtagtaacgcacgcagcagcaggagtaggtgggcagcaccgcggcaggccagcccctccgccctcgtggtgccctgcatgtttcacagctctccacgcgtttgcttggagcattgaccggggaacgaatccagcttgccggttcttgaccccttctcctcctctcccatggcctgtccgcctctgcaggagctggcgttctgagcgagcgggtgcgtgtggtggccgtcggcggcggcggggatcttgggcgcgcgcgggatcctgggttctgtctggctctgaaggcgccgccgtcctgttcttctatcccttagatagtgcttcaatccgacaacgcttctagcttgcctgaaaggtttgtgaactatgaagccacctttggagaggaatcctaccaagaagcgccattcgtggtggtgggacagtcacattagccccaaaaactcgaaatggcttgcagaaaatctggaagaaatggataagcaagtgaaggaaatgctccagctgatcgaggaggacggtgactcctttgcaaagaaagcacagatgtactaccagaggcgtccaatgctcatcactcacgttgagaatttctaccggatgtaccgcgctctagctgagcgctatgacaatgtcaccggtgaattgcgcaagaatatcccaacaaggctgcaatcgatgggttctttagccagttcagagtgtggttctgagctccagaagtcaccctcaccatctcctgagccactacagaggtcatggacaagagagcagagtcctagagctgcgggctttgatttcttcctgagtaacaagaacaatgattcgccagcatcaaggaaggagcctgaggatctggcatcgcagtcagagtctgatgcgaaatccgaagatggcgatgatgatggtattgcctacacattgcatcagagagttctagaacttgaggacgagctcaatatgacaaaccagaaactgcgtgatgcaaatgaaaaacttgagattttggaggagaagagcttgaggtgccattgtgattataaagagaatggaaatgttgctgatcaaatagcaattttgtccagagagcactctaatatgttggaacaaaacaagaagctagaagctgacattatcaagctcaaggaagaagtggattcagtaagaaggcgatttgaagaggaattgtctgaaagggatggagaaattagcaagttaaagcaagaccttgctgatgcttcggagaaattgctgcaagagaagtgcagtaatggtgcgcgaatatctgaactgcaaaaatcggttgaagacatcaggtccaaactagagagagtttctgaagagaaattactagttgagaagcaggttaaggagctggaggaagcaaatgctgaagctgaaaagtacagtcaagaactgactgaagatgctgaaaggctttcagaagagaagttcaggcatgaagctgagattctcacaatgcagcagagcattgaaaatctgaagtccagaattgagagccttgctcaagagaaatcattgatgacaacatggttctcagacttggagcaagttgtggagcggggaaggagcattttcgtcgggtaaccaaattttatcggaaacaccagtagctagaatttagctagttagcaacattttatttttttccatatacataccatcatgtgaacttaagaagccctaccatacgtaagtgtactaccattgtccttgcttgaatttttatgtacgatgtgatggatggtggtgatgtactatgatacttgagatattgcactgaacttactcctcggtaataaaatgcccatggtgcacttgctggttc

SEQ ID NO: 26438 - protein, 413 aa, Panicum virgatum
  misc_feature: Ceres CLONE 1869259
  misc_feature (15)..(88): Pfam Name: KIP1 Pfam Description: KIP1-like protein
  misc_feature: SWISSPROT Homolog: EC 2.7.11.1 Non-specific serine/threonine protein kinase
MKPPLERNPTKKRHSWWWDSHISPKNSKWLAENLEEMDKQVKEMLQLIEEDGDSFAKKAQMYYQRRPMLITHVENFYRMYRALAERYDNVTGELRKNIPTRLQSMGSLASSECGSELQKSPSPSPEPLQRSWTREQSPRAAGFDFFLSNKNNDSPASRKEPEDLASQSESDAKSEDGDDDGIAYTLHQRVLELEDELNMTNQKLRDANEKLEILEEKSLRCHCDYKENGNVADQIAILSREHSNMLEQNKKLEADIIKLKEEVDSVRRRFEEELSERDGEISKLKQDLADASEKLLQEKCSNGARISELQKSVEDIRSKLERVSEEKLLVEKQVKELEEANAEAEKYSQELTEDAERLSEEKFRHEAEILTMQQSIENLKSRIESLAQEKSLMTTWFSDLEQVVERGRSIFVG

SEQ ID NO: 26439 - DNA, 1653 bp, Panicum virgatum
  misc_feature: Ceres CLONE 1869268
  misc_feature: Encodes the peptide sequence at SEQ ID NO. 26440
atcccaaaaccccctgccattaccaccaccttcctctgccccttccgaaatccccccctctctccgcctgtccgtcacgacacgacaggcacgcgcggccattaccaggagcaagcggacgctctctccgtctccagctctgccctgctccgtcccaagaaacaggggagcgggcaggaggaggagcagaggccggcggcggcgggcaatgggggaggagatgggcgcgggctggccgacgtggcgcgcggcggcggcgctggccgtggcggcgtggctggcgctgcacgtggcggcgcgcgtggcggacgcgctgtggtggcggccgcggcgcctggaggcgcacttcgcggcgcagggggtgcgcggcccaccgtaccggttcctgctggggtccgtgcgggagatggtggcgctcatggcggaggcctcctccaagcccatgtcgccgcccacctcccacaacgcgctccctcgggtgctcgccttctaccactactggcggaagatctacgggccgacgttcttgatctggttcgggccgacgccgcggctgacggtggcggagccggagctggtgcgggagatcttcctcacgcgcgccgacgcgttcgaccgctacgaggcgcaccccgtcgtgcgccagctcgagggcgacggcctcgtcagcctccacggcgacaagtgggcgctccaccgccgcgtcctcaccgacgccttctacccggacaacctcaaccggctggtgccccacgtcggcaggtcggtggcggcgctggcggaggagtggtgcgccatggcggccgccggcgggagcggcgaggtggaggtcgacgtcgcggagtggttccaggcggtcacggaggaggccatcacgcgcgccaccttcggccgcagctacgacgacggccgcgccgtgttcgccatgcagggccgcctcatggccttcgcctccgaggccttccgcaatgtcctcgtccccggctacaggttcttgccgaccaggaagaactggcaatcgtggaagttggacagggagatacggcggagcctgacccggctcatcgcccggcgcagcgacgaggccgaggcagagaacaaggccgccggcgacggcggcgccttccgcgacctcctcggcgccatgatcaatgccgccgacaggaagacgcgcgcgccgccgtcgccgccggcggcggcgatcccggtggaggacatgctggaggaatgcaagaccttcttcttcgccggcaagcaaaccaccacgaacctcctcacctgggccaccgtgctcctcgccatgcaccccgagtggcaggagcgcgcccgccgcgaggtcctcgacgtctgcggcgccgacgagctcccctccaaggaccacctccccaagctcaagacgctcggcatgatcatgaacgagaccctgcggctgtacccgccggcggtggcgacgatccgccgcgccatgaccgacgtccagctctccgacgggcgcgtgatcccgcgcgacatggagctgctcgtcccgatcatggccatccaccacgacccgcggttctggggccccgacgcggcacagttcaaccccgcgcgcttcgctggcggcccggcccgggcggcgaagcacccgctcgccttcatccccttcggcct

SEQ ID NO: 26440 - protein, 481 aa, Panicum virgatum
  misc_feature: Ceres CLONE 1869268
  misc_feature (78)..(481): Pfam Name: p450 Pfam Description: Cytochrome P450
  misc_feature: SWISSPROT Homolog: EC 1.3.3.9 Secologanin synthase
  misc_feature: The sequence is a functional homolog of SEQ ID NO 2 in US patent 7034205
MGEEMGAGWPTWRAAAALAVAAWLALHVAARVADALWWRPRRLEAHFAAQGVRGPPYRFLLGSVREMVALMAEASSKPMSPPTSHNALPRVLAFYHYWRKIYGPTFLIWFGPTPRLTVAEPELVREIFLTRADAFDRYEAHPVVRQLEGDGLVSLHGDKWALHRRVLTDAFYPDNLNRLVPHVGRSVAALAEEWCAMAAAGGSGEVEVDVAEWFQAVTEEAITRATFGRSYDDGRAVFAMQGRLMAFASEAFRNVLVPGYRFLPTRKNWQSWKLDREIRRSLTRLIARRSDEAEAENKAAGDGGAFRDLLGAMINAADRKTRAPPSPPAAAIPVEDMLEECKTFFFAGKQTTTNLLTWATVLLAMHPEWQERARREVLDVCGADELPSKDHLPKLKTLGMIMNETLRLYPPAVATIRRAMTDVQLSDGRVIPRDMELLVPIMAIHHDPRFWGPDAAQFNPARFAGGPARAAKHPLAFIPFG

SEQ ID NO: 26441 - DNA, 365 bp, Panicum virgatum
  misc_feature: Ceres CLONE 1869268-R
aaaaacaacaccgtaggatatgtttagaatgaccgaaatgcccctccccagccgcccccgtatatgtataggccaagtgatagtaaaagccaagaagcattaactttttgtcctagcctgcgcttcgggccccatccaggtggcccggaaatgccctccttaacaggccgtatcaggcccagcctttttttttaagatttgatgacacaaaacggggtgggccccaccccctcctcccctttttttttgttcctcgcccatggcagccggtgtatgtattttgtatagtggttttgtttgttcccgtctcctacgctggtagagacgaaaatgcaatggagaaaagaaatggaagaatttctttc

SEQ ID NO: 26442 - DNA, 633 bp, Panicum virgatum
  misc_feature: Ceres CLONE 1869283
  misc_feature: Encodes the peptide sequence at SEQ ID NO. 26443
atcgtttggttcaaaatctcccttcccattcctctttctctctctctcagccttgttagttggtttggttggcaagagccatggcgctgacgctgcgatccaccacgtcgttcctgtcgcccgtcgaccccatctccaagctcctccacaagcccggcgccgacgacgcgccgccgagctgcgccgccgtgccgtccccgccccacgccgccgcgccgagccgcaggctgcgcctcgtcagggcggccgccgcagaggagcacgcgaagggcttcggccacaagaaggagacgctcgagcacatgatgcacgactacaccactgatgtgatcaagacgctcaaggagagcgggaaccaccacacctggggccccgtcaccgtgaagctggcggaggcctaccgattctgctggggcgtcgagcgcgccgtgaatatcacctaccaggcgcgcaagcagttccccgaggagcgcatctggctcaccaacgaaatcatccacaaccccaccgtcaacaagaggttggatgagatgggtgtagaaatcattcgtgttgatgcaggcatcaaggatttcgatgtcgttgaaaaatgcgatgttgttgtgctacctgcatttggagctgctgtggagg

SEQ ID NO: 26443 - protein, 184 aa, Panicum virgatum
  misc_feature: Ceres CLONE 1869283
  misc_feature: SWISSPROT Homolog: EC 1.17.1.2 4-hydroxy-3-methylbut-2-enyl diphosphate reductase
  misc_feature: Functional homolog of the protein sequence given in SEQ ID NO 50777
  misc_feature: Useful for making plants with modulated nitrogen use efficiency
MALTLRSTTSFLSPVDPISKLLHKPGADDAPPSCAAVPSPPHAAAPSRRLRLVRAAAAEEHAKGFGHKKETLEHMMHDYTTDVIKTLKESGNHHTWGPVTVKLAEAYRFCWGVERAVNITYQARKQFPEERIWLTNEIIHNPTVNKRLDEMGVEIIRVDAGIKDFDVVEKCDVVVLPAFGAAVE

SEQ ID NO: 26444 - DNA, 704 bp, Panicum virgatum
  misc_feature: Ceres CLONE 1869298
  misc_feature: Encodes the peptide sequence at SEQ ID NO. 26445
gtcctcattctgctcccgtccgtctcccccctcatcctccatccctagcccgtcgaaaccctagcccgaaagtgccgcggtgaaagtctcgctctcgccgcctccccggcgccatgggcaagaagcggaggctggagaccggatccgcggcagccgctccgactaccccggccgctgcgccccaatccccgactgatactgccgctagcctatcccaggtcttcgcccccgccatggagcggaaggaggtgaagctgcccgaggaggcgggcgtcaaggaggaggaggaggaggagggcggtgacgagctgggcaacctcgaccgcgacgagctctgggccaaggtgtggggggaggccacctacgacctcgccaccgtgctcgccttcctcgccgtcctcgccttcaccatctccgtctacatcatgtccaggcccaggcccgtctacctcatcgacttcgcgtgctacaagcccgccgacgagctcaaggtgtccaaggcggagttcatcgagctggcgcgcaagtcgggcaagttcgatgaggagagcctggcgttccagtcgcggctgctggccaagtccggcatcggcgacgagtcgtacatgccgcgctccgtgttcgagcccaacgccaactgcgcccacatgaaggagggccgcgcggaggcctccacggccatgttcgcggcgctggacgagctc

SEQ ID NO: 26445 - protein, 156 aa, Panicum virgatum
  misc_feature: Ceres CLONE 1869298
  misc_feature (63)..(156): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MERKEVKLPEEAGVKEEEEEEGGDELGNLDRDELWAKVWGEATYDLATVLAFLAVLAFTISVYIMSRPRPVYLIDFACYKPADELKVSKAEFIELARKSGKFDEESLAFQSRLLAKSGIGDESYMPRSVFEPNANCAHMKEGRAEASTAMFAALDE

SEQ ID NO: 26446 - DNA, 697 bp, Panicum virgatum
  misc_feature: Ceres CLONE 1869300
  misc_feature: Encodes the peptide sequence at SEQ ID NO. 26447
aaccatactcaagcagctcaaaacctctagcctgctaccaagaaatggctctggttgcttctcccctgataagtcacactgcccatcgtcctggcctaagaagccacataggacccaatggtggcaatttgtcatggcacgagaagagtaaaagaaggtgtgaccttattagtgttagatcactaccctggagcggcgagcctgtagaatatttgacgccttcagaaatcccaaggagggactggttcagcgacgagttcgtctttggctccgccacttcagcataccaaattgaaggtgcttggaatgagcatggcaaggggccaagcacttgggaccacttctgccacacttatcctgagaggatagttgatggaagcaatggggatgttgcagtgaactcctaccatatgtatgaagaggatgtcaagttgctgaagcaaatgggcatggacgcctataggttctcaatctcttggtcgagaatactgccaaaggggacgctcgaaggtgggataaactataatggcctccagtactacagaaacctgatcaacacgttgaaagagaatggtgacaatattatttgactatagctaaccattttttcttgattctacaattaactaattgagaaagaatgtatgagtgcaatgcacaaaagtttacgcaactcaatagttatctgttgcaactc

SEQ ID NO: 26447 - protein, 181 aa, Panicum virgatum
  misc_feature: Ceres CLONE 1869300
  misc_feature (64)..(181): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51216
  misc_feature: Useful for making plants with altered cell wall content and/or composition
MALVASPLISHTAHRPGLRSHIGPNGGNLSWHEKSKRRCDLISVRSLPWSGEPVEYLTPSEIPRRDWFSDEFVFGSATSAYQIEGAWNEHGKGPSTWDHFCHTYPERIVDGSNGDVAVNSYHMYEEDVKLLKQMGMDAYRFSISWSRILPKGTLEGGINYNGLQYYRNLINTLKENGDNII

SEQ ID NO: 26448 - DNA, 574 bp, Panicum virgatum
  misc_feature: Ceres CLONE 1869311
  misc_feature: Encodes the peptide sequence at SEQ ID NO. 26449
gagactccaaccagcagaccgagctcgctcgcctcgccttttgagaagaacaaacgcgtcctctctggtcttcgtccttcccacttccacagtcctatccacacgtacgcacgagaaggaccacgctcgtgagccgccggccggtgcgagtgcgacgacgacgaacacccatggcgccgtccgaggactgcggctggctgctgtacctctccctggccgccaaatgcggcggcccccaccgcctgctcggcttcgccgcgatcgtcgccgccgccttcgtcgtcacggcgctgctgcactggtcgtcccccggcggccccgcgtggggctggtactggtggaccaggagggccggcctgggcatcgttggcgccgccatcccggggccccgggggctgccggtgctcggcagcatggggctcatgacgggcctggcgcaccggaagctcgcggcggcggcggcggacggcaaggccaggcgccgcctcatggcgttctcgctcggcgagacccgcgtcgtggtgaccgccgacccggacgtcgcgcgggagctgctccccagcgccgccttcgc

SEQ ID NO: 26449 - protein, 134 aa, Panicum virgatum
  misc_feature: Ceres CLONE 1869311
  misc_feature: Functional homolog of the protein sequence given in SEQ ID NO 51217
  misc_feature: Useful for biocontainment applications
  misc_feature: Useful for making plants with modulated flowering time
  misc_feature: Useful for making plants with modulated nitrogen use efficiency
MAPSEDCGWLLYLSLAAKCGGPHRLLGFAAIVAAAFVVTALLHWSSPGGPAWGWYWWTRRAGLGIVGAAIPGPRGLPVLGSMGLMTGLAHRKLAAAAADGKARRRLMAFSLGETRVVVTADPDVARELLPSAAF

SEQ ID NO: 26450 - DNA, 642 bp, Panicum virgatum
  misc_feature: Ceres CLONE 1869322
  misc_feature: Encodes the peptide sequence at SEQ ID NO. 26451
actcctccagaccccccccccccccccctcgcgcgcgcgccgccgccgccgccgcgagatccgctccgcgcgcgatgtggcgcagctgcgtctcgcggggcctctccagggcgagggcctccgcctccaggctcctctccacggcgccgtcgtcctacacggtggtggaccacacgtacgacgcggtggtggtgggggctgggggcgcggggctccgggcggcgatcggcctctccgagcacggcttcaacacggcgtgcatcaccaagctcttccccacgcgctcgcacactgtcgccgcgcagggaggcataaatgctgcacttggaaacatgactgaagatgattggaggtggcatatgtatgacactgttaagggaagcgattggcttggtgaccaggattctattcaatatatgtgcagagaagcaccaaaagctgttatagagcttgagaactatggattgccattttcaagaaccgaagagggaaagatataccaacgcgcctttggaggacagagcttatattttggaaaaggaggacaagcctaccgttgtgcctgtgctgctgacagaacaggacatgctatgctacacacactttatggtcaagcaatgaagcacaatactcagttttttg

SEQ ID NO: 26451 - protein, 189 aa, Panicum virgatum
  misc_feature: Ceres CLONE 1869322
  misc_feature: SWISSPROT Homolog: EC 1.3.5.1 Succinate dehydrogenase (ubiquinone)
MWRSCVSRGLSRARASASRLLSTAPSSYTVVDHTYDAVVVGAGGAGLRAAIGLSEHGFNTACITKLFPTRSHTVAAQGGINAALGNMTEDDWRWHMYDTVKGSDWLGDQDSIQYMCREAPKAVIELENYGLPFSRTEEGKIYQRAFGGQSLYFGKGGQAYRCACAADRTGHAMLHTLYGQAMKHNTQFF

SEQ ID NO: 26452 - DNA, 661 bp, Panicum virgatum
  misc_feature: Ceres CLONE 1869332
  misc_feature: Encodes the peptide sequence at SEQ ID NO. 26453
attccaacagcttcttcccctcaaagaccactccggcgagattcttcccagaccggccggcgaatcacagctcgatcgatcgttctccggcgagccagcaaccactccctgatcggaattcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggcgggcggggagaaggagtggtacttcttctcgccacgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacaacgcgctcaggcgtgctcgagctgtccctttcgtgacagcccgcggctacttgcagacggctggcccgggcgctctagagacctgt

SEQ ID NO: 26453 - protein, 178 aa, Panicum virgatum
  misc_feature: Ceres CLONE 1869332
  misc_feature (9)..(134): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Functional homolog of the protein sequence given in SEQ ID NO 50324
  misc_feature: Useful for making plants with altered terpenoid content
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 851 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50326
  misc_feature: Useful for making plants with modulated light quality response
  misc_feature: Functional homolog of the protein sequence given in SEQ ID NO 50845
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Functional homolog of the protein sequence given in SEQ ID NO 50641
  misc_feature: Useful for making plants with altered carbohydrate content
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1729 in the 11/479,226 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 344 in the 10/666,642 US patent application
  misc_feature: The sequence is a functional homolog of SEQ ID NO 854 in the 11/435,388 US patent application
  misc_feature: The sequence is a functional homolog of SEQ ID NO 886 in the 10/412,699 US patent application
  misc_feature: Functional homolog of the protein sequence given in SEQ ID NO 50642
  misc_feature: Useful for biocontainment applications
  misc_feature: The sequence is a functional homolog of SEQ ID NO 582 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 310 in the 10/666,642 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNNALRRARAVPFVTARGYLQTAGPGALET

SEQ ID NO: 26454 - DNA, 485 bp, Panicum virgatum
  misc_feature: Ceres CLONE 1869364
  misc_feature: Encodes the peptide sequence at SEQ ID NO. 26455
gcgctctctcctcctccctcgcctatctccggtccctgcttgctagtctgttgctgtatttatttccacctccccctcttcttctccagctcaatgctcaagcaccattccaagaagcccgatcgctgatacgaactcgcaagaaagagatttcttgtgcagttccgtgcgaagtctccggttcgtcgtcggccgttccaagaaggtctctgcttcgtcaaaagcggaggagatgatcacggtggcggcaccggaggggcagccgcaagcggcggcggcggcagcggaggtggtggcgccggaggagaccgtgttccggtcgaagctgccggacatcgagatccccagccacctgcccctgcacgagtactgctttgctcgggcggcggagctcccggacgcgccgtgcctcatcgcggcgggcacggggacgacatacacgtacgccgagaaacgcctcccctgtcgcaaaggggccgcgcctc

SEQ ID NO: 26455 - protein, 84 aa, Panicum virgatum
  misc_feature: Ceres CLONE 1869364
  misc_feature: SWISSPROT Homolog: EC 6.2.1.12 4-coumarate--CoA ligase
  misc_feature: Functional homolog of the protein sequence given in SEQ ID NO 50770
  misc_feature: Useful for making plants with altered carbohydrate content
MITVAAPEGQPQAAAAAAEVVAPEETVFRSKLPDIEIPSHLPLHEYCFARAAELPDAPCLIAAGTGTTYTYAEKRLPCRKGAAP

SEQ ID NO: 26456 - DNA, 1511 bp, Panicum virgatum
  misc_feature: Ceres CLONE 1869380
  misc_feature: Encodes the peptide sequence at SEQ ID NO. 26457
atccagtattccagtcctcaatccgtcgagaaattctcgcgagcgatcgaaatctaagcgaagcgaagaggcctccccagatcctctcaaggtatgcgagagcatcgatccccttccgatctatatcgcgtgtcctccctgttcttgttcttcgtcgatctagtttagggtttgatttggttctgaatcgaacccttttcctgcttgcgttcgatttgtactcgatcctcgggtagaggtgtggatctgcggggcgtgatgaggtagtttggtgtagatttgttctgggcgttcgatttgccactagggttcggctgctgttggcattcctgatcgagcggccggataggattgtttttccctttttatatgttggatgcgtgatggttcctgtgtgttgggttagattgctggtacgattcatctaggtggtgatttgcagaggaacaactttgctgttgaatattggtaggtctatctagatttattacttttgattatcgcctgataaggatcaccgattcgtgtagaataaattatttcattgttgggtcatgtagatatagctgcacaatttcttacttggctccttactgtgtgaattgtagaataaactgtgttactctatgagtttttctggattgctggatccagttaggccagtgctgtcaatttgttatggctgttaatgtaataattttctggattgttggcctgcttctcttcatgtttaatcacgtgatggttcatgatgcctgttgggttagattgtttgttcaattcatctaggcagtgctgtgcagagtacaactcgattgttgtttaatcttggtagcttcatctagatttgtacaaattttggtcacctgatgatgatcaccgattgttgtggaattatttcttaactggttcgttgttagtcaccaccttacttgtagaataacctgtggtactgcttttctgttctgttttaggccacatcatatgattgtcaaaaatttacatggtagtttaatgataaaattagttcagcttacttcagtttgatttgcttcatattttgttttctgttctattaatgatacttcatgaaatgtttgttttttctctgttcagatttgacatgtttcagtatcataataataatattctgtatcctttatagtttgttggcatgatttgctttgaatttagttagcctattctgttaatataggatgataagctgtgaggcgttcattctcttcagtccagagttatcattttcagtgttttaatgttgtttatcaagctggatgtatatggtggtttaactcttttctgtttcttaatgtttgcagatgcagatctttgtgaagaccctcaccggcaagaccatcaccttggaggtggagtcatctgacaccattgacaatgtgaaggccaagatccaggacaaggagggcatcccctcggaccagcagcgtctgatcttcgctggcaagcagctggaggatggccgcaccctggcg

SEQ ID NO: 26457 - protein, 56 aa, Panicum virgatum
  misc_feature: Ceres CLONE 1869380
  misc_feature (6)..(56): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPSDQQRLIFAGKQLEDGRTL

SEQ ID NO: 26458 - DNA, 787 bp, Panicum virgatum
  misc_feature: Ceres CLONE 1869380-R
  misc_feature: Encodes the peptide sequence at SEQ ID NO. 26459
ccagcagcgtctgatcttcgctggcaagcagctggaggatggccgcaccctggcggactacaacatccagaaggagtccaccctccacttggtgctccgtctgcgtggtggtatgcagatctttgtgaagaccctcaccggcaagaccatcaccttggaggtggagtcatctgacaccattgacaatgttaaggccaagatccaggacaaggagggcatccccccggaccagcagcgtctgatcttcgctggcaagcagctggaggatggccgcaccctggcggactacaacatccagaaggagtccaccctccacctggtgctccgcctgcgtggtggtatgcagatctttgtgaagaccctcaccggcaagaccatcaccttggaggtggagtcttctgacaccatcgacaacgtgaaggcgaagatccaggacaaggagggcatcccgccggaccagcagcgtctgatcttcgccggcaagcagctggaggatggccgcaccctggcagactacaacatccagaaggagtccaccctccacctggtgctccgtctccgtggtggacagtaagtccatggagctgctgttgtccctgggttcacaagtctggtgccttgccttgtctctccaatggtgattgcctgcgtgtccttgtcatgcctgtctgatgtgagttttatgtcatctggttgtgttttgtgaacacttaactgctgctgtgcagcagtttggttgaactatgtaatgaataagtgagccctgaagttactatggtaatcttgc

SEQ ID NO: 26459 - protein, 190 aa, Panicum virgatum
  misc_feature: Ceres CLONE 1869380-R
  misc_feature (43)..(111): Pfam Name: ubiquitin Pfam Description: Ubiquitin family
  misc_feature (119)..(187): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
QQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 26460 - DNA, 1964 bp, Panicum virgatum
  misc_feature: Ceres CLONE 1869402
  misc_feature: Encodes the peptide sequence at SEQ ID NO. 26461
acgcagctagctcagctcgatcgtcctctcctctccattcatccgttctcgtgctccctccctcccaatcctcgccacgcactgcagcggcggccggccggaggagatgatgagcggtggtaggctgaacgtggcgaggtccgcgccgggcgacgacttcccgttcgcgccgatgcagcagcagcagcagcagccgccgccctacgtcgggttcgagcacggcgtggtgggaggcggcggccagcgcggcggcggcgggatgcagcaccacctctacgacggcctcgacttcgccgcggcggcgctgcagttccaggaggcggcgccccaccaccagctgctcacgctgccgtccagcctcgcgcccatggcgccgccgccgctgccgatgcccatgccgatgcccggcgacgtgtacccggcgctcggcctggtgaagcgcgagggcggcggcgtcggcgcggacggcggcgcaggcgcggcggggggcggccggatcgggctcaacctcggccgccgcacctacttctccccgggcgacatgctggccgtggaccggctcctgatgcactcccgcctcggcggcgtgttcgggctcggcttcggcggcgcgcaccaccggcccccgcgctgccaggccgagggctgcaaggcagacctctccggcgccaagcactaccaccgccgccacaaggtctgcgagtaccacgccaaggcctccgtcgtcgccgccggcggcaagcagcagcgcttctgccagcaatgcagcaggtttcacgtcctgacggagttcgacgaggccaagaggagctgccggaagcggctggccgagcacaaccgccgccgccggaagccggccgccgcctccacggcgtcgtccaaggacgcggcagcgtcgccgcccgccaagaagcccagcggcggctccatgacgggctcctacaccactgacagcaggaacctgagcacggccaagtcgaccatgtcatcgaacacgggcagcgtgatcagctgcctggaccagggcaacaagcagctggcgaggccgacgctgaccctcggtgcgtcgccggacaaggaccaccagcaccagcagttcagcaccatgctccaggtccaggcggccgcgggcggccaccaccaggagcagcacttcatcacctccctgcaggttcacaaccacaacaatggcggcggcggcggcggcaacaacaacatcctgtcgtgctcgtcggtgtgctccagcgcgctgccgtcggccaacggcgaggtctccgaccagaacacccaccacaccaacggcaacggcaacatgcacaatctgttcgaggtggacttcatgtaggccgtacgtggatgcgtgcaaagcgagcgagcacgggagtacgttcttctgtcaaaggtgtccttggtgtgtagccgtgtaggtaaattaaaaggaataggagaaagtgagagtgagagtgagagagaacaaaaaaggcatgaagtgagagaaaaacaagagagagagagaaggctgagggtgcaaggattccatccagccagccagccatcagtgctcagtagcagctggctgcagcaggctggtctagcaaggtagagctagctatctccttgcaaagttgcatgcatggctatagtagctctagcaaagccatgcatccatcctgcatccggccggcatcccccttgcattgcattgggttctctacctgtactgtactgaactgcagtgcgtctgcatccaatccatccatccaagcctttctgcctttccatttcagtggggaatattgtgtctgctattatttcccctttatttttcccctttctagtttcctcttgttgcaaggtgagggtgtactactggtgtagtagtgcgtgtgttgtaccaaactaccagctactgttttttacagtgtctccaacaattaacaggcgagagaagattcattgttgtc

SEQ ID NO: 26461 - protein, 412 aa, Panicum virgatum
  misc_feature: Ceres CLONE 1869402
  misc_feature (175)..(253): Pfam Name: SBP Pfam Description: SBP domain
  misc_feature: Functional homolog of the protein sequence given in SEQ ID NO 50782
  misc_feature: Useful for making plants with altered terpenoid content
  misc_feature: Useful for making plants with modulated flowering time
MMSGGRLNVARSAPGDDFPFAPMQQQQQQPPPYVGFEHGVVGGGGQRGGGGMQHHLYDGLDFAAAALQFQEAAPHHQLLTLPSSLAPMAPPPLPMPMPMPGDVYPALGLVKREGGGVGADGGAGAAGGGRIGLNLGRRTYFSPGDMLAVDRLLMHSRLGGVFGLGFGGAHHRPPRCQAEGCKADLSGAKHYHRRHKVCEYHAKASVVAAGGKQQRFCQQCSRFHVLTEFDEAKRSCRKRLAEHNRRRRKPAAASTASSKDAAASPPAKKPSGGSMTGSYTTDSRNLSTAKSTMSSNTGSVISCLDQGNKQLARPTLTLGASPDKDHQHQQFSTMLQVQAAAGGHHQEQHFITSLQVHNHNNGGGGGGNNNILSCSSVCSSALPSANGEVSDQNTHHTNGNGNMHNLFEVDFM

SEQ ID NO: 26462 - DNA, 2284 bp, Panicum virgatum
  misc_feature: Ceres CLONE 1869404
  misc_feature: Encodes the peptide sequence at SEQ ID NO. 26463
gtcgcatcgacatcaccagttacttcaccggtgcctccctctttgcttgttcgcctgcgtacgtgctttactgtgtcgcagttgcagctccgtcgtcgccgtcctcgccgagctctgaccacccctgctgccgccgctgacacccgctgacatttgtctcccgagcccagagaggatcgttgctggtatcggtgtttatctaccgcattaacaattaacattgctccgggtcttgcagtggttccgatcctttgggtttagtgcggagtgcgctcgtctggtgcagctagctattctgctctcagggggtctcttcgctctgtccagattggtctcaaggttcagatctaggagagctcggggccgcttcttgatcacttctgctgacaaaggttccaactgctgcttgctctgacaaattcttgaacaccatcgctaagaaatcaggagatggccgaggtgaagccggaggacatggtccatcatatgcccatggaccagctccaggggttcgagtactgcatcgactccaatccttcctggggagaagggattgctttggggttccagcactacgtactgtccctgggcactgctgtcatgatccccacaatgctggttcagctcatgggtggaaatgataatgataaggccaaggtggtacaaactctgctgtttgtgactggaatcaagacgctgctccagacactatttggcactcgccttcctacaatcatgggaggttcatatgcatatgtggttccaatcctctccatcatccgcgacccctcgctcgtgcaaatagctgacggccatactagatttctgcagacaatgagggccatacaaggttcactgattgtatcctcaagcattcagataattcttggatatagccagttgtgggcaatatgttctagattctttagcccacttgggatggttcccgtcattgcattggtggggcttggccttttcgagagaggattcccagtggttgggaaatgcgtggagattggtcttccaatgcttatcctatttgttgcgctttcccagtatctgaagcacgtgcatgttcggcatgttcctgttttggagaggttctccatgctgatgtgcatcgctcttgtctgggtatatgcccacatcctcacagcaagtggtgcatacaagcacacggcacttgtcacccagatcaactgccgaacagaccttgccaacctcatctcttcatcacaatggataagcattccatatccgttacaatggggcgcaccgacattcagtgcagaccatgctttcggtatgatggctgcggtgctagtctctttaatcgagaccacaggagcattccaagctgctgcccggttggctagtgcaacaccaccaccagcatatgtcctgagcagaggcattgggtggcagggcattggcaccctattagatggcctatttggcactgggactggttctactgtttctgttgagaatgttggtctccttggatcaacaagggttggtagtagaagagtgattcaaatttctgctggtttcatgatcttcttctccatgctaggtaaatttggagcactttttgcctccattcccttcacaatatttgccgccatttactgtgttatgtttggaattgtcgctgctgtggggctctcctttatgcagttcaccaacatgaactcaatgcgcaacctattcattattggtgtttcacttttccttggtttatctataccagagtacttttctcggtattcgacgagttctcgacaaggcccagcacacacaaaggctggatggttcaatgactacattaacaccatcttctcatccccgccgacagtggccctcttcgtgtcagtactccttgacaacacactcgacgtcagagatgcagcaagggaccgaggaatgccatggtggacacgatttaggacgttcagaggcgacagtaggaacgaagagttctataccctgccgtttaacctcaacagattcttccccccatcatgaggcaaaggcaaaccactaaagtcaaaagatgctgcaagccaaattctcaacaagctcctagcactcagatgtgctttccatagagtagaacaacaactgcaagagaaagtttcttgcaaaaacaaaaagagaaagttggacaaaggccgaattaactccctgctggccgtcgattgtacataaatggttttgtttcaagtatcgatcaatgatcaaggaacaagaatgtcgaatatttgatatagtgtgattttag

SEQ ID NO: 26463 - protein, 525 aa, Panicum virgatum
  misc_feature: Ceres CLONE 1869404
  misc_feature (32)..(439): Pfam Name: Xan_ur_permease Pfam Description: Permease family
MAEVKPEDMVHHMPMDQLQGFEYCIDSNPSWGEGIALGFQHYVLSLGTAVMIPTMLVQLMGGNDNDKAKVVQTLLFVTGIKTLLQTLFGTRLPTIMGGSYAYVVPILSIIRDPSLVQIADGHTRFLQTMRAIQGSLIVSSSIQIILGYSQLWAICSRFFSPLGMVPVIALVGLGLFERGFPVVGKCVEIGLPMLILFVALSQYLKHVHVRHVPVLERFSMLMCIALVWVYAHILTASGAYKHTALVTQINCRTDLANLISSSQWISIPYPLQWGAPTFSADHAFGMMAAVLVSLIETTGAFQAAARLASATPPPAYVLSRGIGWQGIGTLLDGLFGTGTGSTVSVENVGLLGSTRVGSRRVIQISAGFMIFFSMLGKFGALFASIPFTIFAAIYCVMFGIVAAVGLSFMQFTNMNSMRNLFIIGVSLFLGLSIPEYFSRYSTSSRQGPAHTKAGWFNDYINTIFSSPPTVALFVSVLLDNTLDVRDAARDRGMPWWTRFRTFRGDSRNEEFYTLPFNLNRFFPPS

SEQ ID NO: 26464 - DNA, 1301 bp, Panicum virgatum
  misc_feature: Ceres CLONE 1869408
  misc_feature: Encodes the peptide sequence at SEQ ID NO. 26465
acgcagcccgaaacgcgagcacaatcaaggcctgaccaccaccaccattgccgccgccgccgccgccgcaggtgcaggagcagcgctcgcaatggcagctcgtcttgcttaagcgtcgaggagccgaggagctagaagcgcgcattggcgccgccggcgcgggcgcgagctgctgcgccgtgccaccgcgctacgccgatcgccggcgcccattgcctccgtggggtgggttggctggccgccaatctcgctagcgagcggcgccgccgaggagcgaagcggcgccaccgcgaatggcgggacgccgaatgacgctgccgctgctggcgctgctggcggccgcgttcctggccgccaccactggcagcaacagcaagtcctcggcggtgttcgaactgatccaccgggagcaggcgacctggaccgagctggcgcgcaatgaccgggagcgcatggcgttcatctcctcgcgcgggcgccgccgcgccgcggagacgggcacggccacggccaagcccagcaaggccgcgcccgcgtccgaggccttcgcgatgccgctctcctcgggcgcctacacgggcaccggccagtacttcgtccgcttccgcgtgggcacgcccgcgcagccgttcctgctcgtggccgacaccggcagcgacctgacctgggtcaagtgcctccgccccgccgccgccgccgacgaccccgccttcggcgccggctacggctacagctacggcgccccggcgccgaccgactcctccccgctgccggcgccgtcgtcctcctccccgccgccgcacgggcgcgtcttccggccggacgactcccggacgtgggcgcccatcccgtgctcctccgacacctgcacggcgtccctgcccttctccctcgccgcctgccccacccccggcagcccctgcgcctacgactaccggtacaaggacgggtcggcggcgcgcgggacggtgggctccgactcggcgaccatcgcgctgtcggggcgcggcgcggcggcggcggcggtggccagcaggagcaggagacagcggcgggccaagctgcggggcgtcgtgctgggctgcaccacctcctacagcggcgacagcttcgtggcctccgacggtgtgctcagcctcggctacagcaacatctccttcgcgtcccacgccgcggggcgcttcggcgggcgcttctcctactgcctcgtcgaccacctcgccccgcggaacgccaccagctacctcaccttcgggcgcaacccggccctgtcgccggccgccaggaccgcctgcgcgggg

SEQ ID NO: 26465 - protein, 335 aa, Panicum virgatum
  misc_feature: Ceres CLONE 1869408
  misc_feature: SWISSPROT Homolog: EC 3.4.23.12 Nepenthesin
MAGRRMTLPLLALLAAAFLAATTGSNSKSSAVFELIHREQATWTELARNDRERMAFISSRGRRRAAETGTATAKPSKAAPASEAFAMPLSSGAYTGTGQYFVRFRVGTPAQPFLLVADTGSDLTWVKCLRPAAAADDPAFGAGYGYSYGAPAPTDSSPLPAPSSSSPPPHGRVFRPDDSRTWAPIPCSSDTCTASLPFSLAACPTPGSPCAYDYRYKDGSAARGTVGSDSATIALSGRGAAAAAVASRSRRQRRAKLRGVVLGCTTSYSGDSFVASDGVLSLGYSNISFASHAAGRFGGRFSYCLVDHLAPRNATSYLTFGRNPALSPAARTACA

SEQ ID NO: 26466 - DNA, 674 bp, Panicum virgatum
  misc_feature: Ceres CLONE 1869408-R
  misc_feature: Encodes the peptide sequence at SEQ ID NO. 26467
tcaagatcccgcgcctagtctggaatatcgagagggcgggcggcaccatcctcgactcgggcacgagcctcacggtgctagccagcccggcgtaccgggtcgtggtcgcggcgctgagcaagaagctcgcggcgctgccccgggtgatcatggacccgttcgagtactgctacaactggacgtcgccgtcgacgggcgaggacctggccgtgcccgtgccggacttggcctttcacctcgcgggggcggcacgcctgcagccgccggcgaagagctacgtgatcgacgcggcgcccggcgtgaagtgcatcggcgtgcaggagggggagtggcccggggtgtccgtcatcggcaacatcctgcagcaggagcacctgtgggagttcgataccaagaaccgacgactcagatttatgaggtcgcggtgcacgcaatgattgggcccgcggtgatccatcgttcttccccccacttcttcaattttttaccccatgtggtggtgatcttgctgattctttttttttcttttcccttgttcagatactaatgcaatgagaaatgtaccttcttgcaatgcagaagtgataagctgtaatcagttttcttttctccttttccacaccctgttgttcttctcattccggtgaatatatgttcagagtgcatctcctcct

SEQ ID NO: 26467 - protein, 144 aa, Panicum virgatum
  misc_feature: Ceres CLONE 1869408-R
  misc_feature: SWISSPROT Homolog: EC 3.4.23.12 Nepenthesin
KIPRLVWNIERAGGTILDSGTSLTVLASPAYRVVVAALSKKLAALPRVIMDPFEYCYNWTSPSTGEDLAVPVPDLAFHLAGAARLQPPAKSYVIDAAPGVKCIGVQEGEWPGVSVIGNILQQEHLWEFDTKNRRLRFMRSRCTQ

SEQ ID NO: 26468 - DNA, 2653 bp, Panicum virgatum
  misc_feature: Ceres CLONE 1869421
  misc_feature: Encodes the peptide sequence at SEQ ID NO. 26469
ttttcgaaattgttacacggtgacgcctgaacagccggcacgagcccgcgccgccggcgatgttgcgcagggtcctcgcgagggcgatcccacgctccgccgcctccaccgggttgtccaaacctctaagccctctcttcatcggtgcctcgcgcctagccacttctcctggagaccacgtcgcagatggcggcggcggcggcgaggatgaccccttctccttcccggaccaatatctgcagcagctcccgcccgacgtcgcccgaggggtggactccgtcgtcgcggcggcccagactaatgcctccagtgcggcggacgccgcgcgggccctcgacctgtgcggcgccgaagcgtccgagccgctcgtggtggccgcgcttgcgcgcctccgcaacagctgcgccgccgcgcacgccgcattccggtgggccacagcgcagcccgggtacgcgccgggccggcgcgcgtcccactccatgctcgccatcctcgccaagcaccgccacttcgacgacgcgcgcgccctgctcgacgaaatgcgccgcgcatcgacggcctccccggccgcggtgcttctcctcatccggcgccactgcgccgcgcgggacgtcgctggcgccgtcgccgcgttccgcgcgctaccgaacttcggattccgacctggtgtcgccgagttccacggcctcctgagtgggctatgccggtacaagaacgttcaggacgcggagcacctgctcatgtccagccagaaggagttccccttcgagaccaagagcttcaacatcgtgctcaatggttggtgcaacattatcggcagtgttcgggaggcgaaaaggttttggaatgccatggggaatctgggcattgacagggacgttgtgtcgtacgggagcatgatctcatgcttctcaaagtctgggagtttggattctgtcatgaagctctttaaccgcatgaaggaggctggcattacaccagatcggaaagtatacaatgcagttgtgcatgcactagcaaagggacgttgcgtggaggaggcaaagatgcttgtccagactatggaggagaagaaggttgccccggacacagccacttttaactctctcattgggcctctttgcaaggctcgtcgtgttcatctggcaatggaaacgttttatgctatgttaggaaggggtctgcctccttcagtgaggacctttcatgcgttacttaatgtggccacacccactggggtatttgatctgttacataagatgaaagagttacgctgtgagcctgagatggacacttacattatgttgatcaggaaattctgccgatggaggcagtatgagagtgtggagaagctatggagtgcaatgcctgcaaatgggctgagccctgatcggagtgcatacattgtgttgatacatggattattcctaaatggaagactagaggaggcgtcaaagtattacgaagagatgaaagctaagggctttgcaccagagcagaagactcaagaaatgatacaagcttggctcgcgggcagagagcttgccaaggcatcagcttcaggttgttcaaagggtggttcagtgtctctcagacttcccagaaggtgacaaagttaaggttagctccgaagggcaattcataaaaggaaacgaaacagaatagaagggtacctattatgattcccgaataactcataagttcaaaaagatacttggctgcacggaaaactgggactactgtatgtttttcgtagttatttgtcacttgattgataagttgaaaactggaatatggcaagtcattttcaggtggatgcatgctatttgtatttctttgcattgagcttttagtgggtactgaccagatgttcgattatatttttacaaaacttctcctgagccatgtaggttttaagcccacctgaacgcttcctttaatatctaaggggcactacaggtgattttgcaaataaaatcagggaaaatgagatggataaagcaacgagcagattaacatagctttctgatctgatgatttttgacattcttgtttcaagcaaaagctgcagataccatacagagatccattaggcggtagatcccatggaggacagtagtggggcctgaactgccaccagaattgggctgactgaggacattgcaagggcaagagatctccaagtctcttttttcaagcaggagttaatacttgtttccacccagctgctgttctgcaggaccactgaccacgcttccgaaacctacctggcgcttgaactaatctgacgacaagatcacgttggatttgaagctgggagtgggtgctgccagcctgctattaatcaatggccattatgcttggattcgttctgacgatagggctcatctcgtctctgatatgtgaatacatctaatctatgagataccctttagattgctaccttgtggtttaaaataatgccttagcagctggctgcttagatcatactactagtagcatggtccaagtcaaagagcttatccttgtacagtctgacgacctttctgtcatattctcaaagttatacgcatctcaactggatctttaacgtgtatcttctcgcacgcctgaactcttctgatatgttatatgtactccagaatttggcgtt

SEQ ID NO: 26469 - protein, 516 aa, Panicum virgatum
  misc_feature: Ceres CLONE 1869421
  misc_feature (275)..(309): Pfam Name: PPR Pfam Description: PPR repeat
  misc_feature (446)..(480): Pfam Name: PPR Pfam Description: PPR repeat
  misc_feature (310)..(344): Pfam Name: PPR Pfam Description: PPR repeat
  misc_feature (345)..(379): Pfam Name: PPR Pfam Description: PPR repeat
  misc_feature (411)..(445): Pfam Name: PPR Pfam Description: PPR repeat
MLRRVLARAIPRSAASTGLSKPLSPLFIGASRLATSPGDHVADGGGGGEDDPFSFPDQYLQQLPPDVARGVDSVVAAAQTNASSAADAARALDLCGAEASEPLVVAALARLRNSCAAAHAAFRWATAQPGYAPGRRASHSMLAILAKHRHFDDARALLDEMRRASTASPAAVLLLIRRHCAARDVAGAVAAFRALPNFGFRPGVAEFHGLLSGLCRYKNVQDAEHLLMSSQKEFPFETKSFNIVLNGWCNIIGSVREAKRFWNAMGNLGIDRDVVSYGSMISCFSKSGSLDSVMKLFNRMKEAGITPDRKVYNAVVHALAKGRCVEEAKMLVQTMEEKKVAPDTATFNSLIGPLCKARRVHLAMETFYAMLGRGLPPSVRTFHALLNVATPTGVFDLLHKMKELRCEPEMDTYIMLIRKFCRWRQYESVEKLWSAMPANGLSPDRSAYIVLIHGLFLNGRLEEASKYYEEMKAKGFAPEQKTQEMIQAWLAGRELAKASASGCSKGGSVSLRLPRR

SEQ ID NO: 26470 - DNA, 752 bp, Panicum virgatum
  misc_feature: Ceres CLONE 1869437
  misc_feature: Encodes the peptide sequence at SEQ ID NO. 26471
acgccgagttctctcttccagaaacggacagagagagaaagtgagctccagcgaagcagccagcagcccgccacgccttcctccttcctctcgcggattcagagctccagacctcctccgtgtccgtgtgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttgtggacgtcggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccataataagacttgagtatgccaaggacagcattacttggcagacactgtatcctgaatggatcgatgaggaggaagaaactgagataccctcttgtccatctctcccagagcccaatgttcgaaaaggtgtacgctttgatgtcattgcagtgaaacttccttgtacccgtgttgcgggttgggtcagagacgttgcacggctccatttgcagctctcagcagc

SEQ ID NO: 26471 - protein, 250 aa, Panicum virgatum
  misc_feature: Ceres CLONE 1869437
  misc_feature: Functional homolog of the protein sequence given in SEQ ID NO 50565
  misc_feature: Useful for making plants with altered carbohydrate content
TPSSLFQKRTERESELQRSSQQPATPSSFLSRIQSSRPPPCPCEDTTKRRTSKSKSFKDVENFEVLVIEKNCGCKFKSLKIMIIAIISATVLTLITPTLYEHQLQSASRFVDVGWMWDKTSSDPRYASSVDVQWDDVHRALRNLKSGNQDLKVGLLNFNSTEYGSWTQLLPDSHVSIIRLEYAKDSITWQTLYPEWIDEEEETEIPSCPSLPEPNVRKGVRFDVIAVKLPCTRVAGWVRDVARLHLQLSA

SEQ ID NO: 26472 - DNA, 713 bp, Panicum virgatum
  misc_feature: Ceres CLONE 1869472
  misc_feature: Encodes the peptide sequence at SEQ ID NO. 26473
ttcgatcggagacggagagaggccaatggcagcgcggtgcggcggcggctgcgacgggcgcgagggcggcgcggtggaggcgctgctgcagtggcagaaggtgagcgacttcctcatcggcgcgtcctacctgtccatcccgctcgagctgctgcacttcgccacctgcgccgacctcgcgccgctccgctgggtgctcctccagttcggcgccttcaccgtcctctgcggcgtcgtcgacctcgccgccgtcctcacctacgcgcgcccggactcgcgccgccgcctcctcgcgttcaccgccgccaaggcgctcgcagccctggccgcctccgtctccctcccggccttcatcccgcacctgctccgcctcaagatccgcgaggcgctcctccgggacaaggcccgccagctcgaccgcgacgtcgccgccgtccggcgccgccaggagaccaccgcgcgcgtcgtccgcgccatcacgcagcacgtccgccgcggcggtggcgcgctcccgcacgacgcgcacgccgtcctgcgcaccgccgtgctccacctctccgaggccctcggcctccgtagctgcgccgtctggatgcccgcggatggctccagcgtgctccacctggtgtatcagctgccggaagacgaccggacgaggcaggccattcgtgtcgctgaccccgacgtggccgccgtcatggccagcaaggacg

SEQ ID NO: 26473 - protein, 229 aa, Panicum virgatum
  misc_feature: Ceres CLONE 1869472
  misc_feature: SWISSPROT Homolog: EC 2.7.13.3 Histidine kinase
MAARCGGGCDGREGGAVEALLQWQKVSDFLIGASYLSIPLELLHFATCADLAPLRWVLLQFGAFTVLCGVVDLAAVLTYARPDSRRRLLAFTAAKALAALAASVSLPAFIPHLLRLKIREALLRDKARQLDRDVAAVRRRQETTARVVRAITQHVRRGGGALPHDAHAVLRTAVLHLSEALGLRSCAVWMPADGSSVLHLVYQLPEDDRTRQAIRVADPDVAAVMASKD

SEQ ID NO: 26474 - DNA, 728 bp, Panicum virgatum
  misc_feature: Ceres CLONE 1869488
  misc_feature: Encodes the peptide sequence at SEQ ID NO. 26475
atcttctccctttgctatctcctccctttgctaccccagccgccgctctcgacgctgtcggcccgtgcggcgccctccagtcctccacgctcccctgcccaactgcagctcgagtccagctggtggggcagcaccctcccttcccacgacttctctgttcgttctttcggcctcggtcttcctttcctagcggcgatgacagggcgagttgcgctgcccgttgttcatcgagcgatgggggcttcgccggcgacgaacatccgacaaggacagaatacgcaggagaggagcatcggcaggcaagactccaggcaaccggcgccaatgttgggcccttctgaacgccagctcccgaagcgacgccgacggatggcttccgttggcagtgggattcctgaggatatactcttcgaaattctggtactacttccggtaaagtgccttgtgcgcctccaattggtgtgcaagctgtggcgtgcaaccataaccagcactcattttgcccaccgtcacctggagcgttcgagatccaaattctcttttctcctgatgccccggagggataacgaggactacagctatggcattaagggtgtgtctatcttcagctttgagccggagcagctccctaccaagatcgccccgttcctaatgcacaagggattgaggatgccgatgttcaccttgcctttgcactgcgacgggctcattctgatcccttgctttgt

SEQ ID NO: 26475 - protein, 134 aa, Panicum virgatum
  misc_feature: Ceres CLONE 1869488
  misc_feature (18)..(65): Pfam Name: F-box Pfam Description: F-box domain
MLGPSERQLPKRRRRMASVGSGIPEDILFEILVLLPVKCLVRLQLVCKLWRATITSTHFAHRHLERSRSKFSFLLMPRRDNEDYSYGIKGVSIFSFEPEQLPTKIAPFLMHKGLRMPMFTLPLHCDGLILIPCF

SEQ ID NO: 26476 - DNA, 2128 bp, Panicum virgatum
  misc_feature: Ceres CLONE 1869492
  misc_feature: Encodes the peptide sequence at SEQ ID NO. 26477
aaacgcggtgcagatacagacgcaggcaaacctgaacctgcagagcgcaccaatggcagatcacgatctgctagtgctaaagcagctgagtccagtgaggtcaaaccccgagctgagtgagctcggatacgcgtcgagcacctttcgcttttcaccagcaagcaatcgcctcgccctgcattatttctgagcggattgcggcggcggctcctcgctagatccgcgtccgcgaagacggcccagatggagccccaggatgacggaccccttcgcctccaagaacccgccgccgccggctgcggcggcgtcattggcaaaagttgcgtcgcctccccctgccgatggctgcggcggctgtcccgcaagctgcactggagcttcgtgctcgcggtcgtcgcggtctatggcgcctgccagggcgtcggcaacgccgtcggcggcgtcgccgcggggtactactggaaggacgtgcagcgcgtgcagccgtcggcggcccagttctaccagggcgtcacggacgcgccgtgggtcgtcaagcccctctggggactgctcaccgacgtggtcccggtcgccggctaccgccgccgcccgtacttcgttctcgcaggcgtggtcggcgtgtcgtcaatgctgatgctctccctgcaccgcggattggggatcatgccggcgctgctagccctgacggcgcagagtgcgggcgccgcgatagccgacgtgacggtggacgccctggttgctcagaacagcataacgcacccgccccttgcttccgacatgcaaagcctgtgtgggtttagctcctctcttggggcattggttggattctccattagcggcctgcttgttcactcaatgggctctcagggtgctcttggcctgttgagcatcccctctatactggtgctcttggccgggatcctgctgaaggagaaccacgttgcagaatttgactacaagcaggttcataaaaagttctacaaagcgattcggtctatggggacaacactgaaatgcccagaggtctggcggccatgtgtatatatgtttgtttctcacaatttgagtctggatattcagggaggaatgttctactggtacacagaccatgtggttggacctgggttttctgagggatttatcggtctcatctttgcaattggttcatttggttcactgcttggagttttgctataccaaagcgctctgaaggactattctttccgcagcatacttttatggggtcaagtgctgtctagtctggcaggaatgctcgatctggtattggtgaccaggctaaacttgaaaattggcataccggattatttctttgcaatgatcgataacagcatttcccaaatggttggcagactcaaatggttgccacttcttgtgctttgctccaagctttgttcccccggcatcgaaggaacattttacgcgctactcatgtcactacaaaatgccgggttgctgatgtctgcttggtggggtggcttgctgctgcacatgctgaatgtgactcgaatggagttcagtaacctctggatcgctgtcttgattagaaacatttcaaggcttgtcccattgacactattgtttcttgttcctcaaagtgatcagaactcaacactcctgcctgcagagatgcttgaatgtgacacaacagaagctgtgagggcaggatcagttgaattctcagtcctcgttcaagaagattctggctgcatttctcccaatatggtggctgaggatggacgaaccaaaatgcttgatgcagaaatcgatgatgtggaatcaatcccgctggttagtaagagccagaccattgattcatgatgtgttaagtgccatgatttggcaaatgattccatgactcatccccaagtccgttaaagacggtaagacattgcatcgaagatcgaacaaaggaattggagaatttggtaccgaaatgcgggacttggaattttcactgttacataggtggtagcagtcatgagcaagagttgactgagctcaagcatagcttgttgatacacagttttaggcacttcaattactccttatcgccatttagacatactgaacacattccttccggttatagaaatccattctttgg

SEQ ID NO: 26477 - protein, 532 aa, Panicum virgatum
  misc_feature: Ceres CLONE 1869492
  misc_feature (58)..(470): Pfam Name: BT1 Pfam Description: BT1 family
MEPQDDGPLRLQEPAAAGCGGVIGKSCVASPCRWLRRLSRKLHWSFVLAVVAVYGACQGVGNAVGGVAAGYYWKDVQRVQPSAAQFYQGVTDAPWVVKPLWGLLTDVVPVAGYRRRPYFVLAGVVGVSSMLMLSLHRGLGIMPALLALTAQSAGAAIADVTVDALVAQNSITHPPLASDMQSLCGFSSSLGALVGFSISGLLVHSMGSQGALGLLSIPSILVLLAGILLKENHVAEFDYKQVHKKFYKAIRSMGTTLKCPEVWRPCVYMFVSHNLSLDIQGGMFYWYTDHVVGPGFSEGFIGLIFAIGSFGSLLGVLLYQSALKDYSFRSILLWGQVLSSLAGMLDLVLVTRLNLKIGIPDYFFAMIDNSISQMVGRLKWLPLLVLCSKLCSPGIEGTFYALLMSLQNAGLLMSAWWGGLLLHMLNVTRMEFSNLWIAVLIRNISRLVPLTLLFLVPQSDQNSTLLPAEMLECDTTEAVRAGSVEFSVLVQEDSGCISPNMVAEDGRTKMLDAEIDDVESIPLVSKSQTIDS

SEQ ID NO: 26478 - DNA, 438 bp, Panicum virgatum
  misc_feature: Ceres CLONE 1869498
  misc_feature: Encodes the peptide sequence at SEQ ID NO. 26479
agtcatcaaggacgcctccacaaacgaatggccatagggaacctttaattggtgagatcactacagcacaatctgcatcacctactagaacgaaaaatgccctctcagtggtaccatggctgggtcttcggttcaccaggggtctctggccctttttattggaaaacacacgtagggaagtgccaagtgaaactgtcataccagtgggaagaaggcttttactgtttaaggatgatcaaggatattcatctctcagccatggcagtggaagtgaaattggaagctttcttggttgggcaatggcaataatctatatgggtggacgactgccccagattttcttaaatatgcaaagaggccatgctgaggggctcaatccattaatgtttaccttcgctttattggggaattcgacatacgtacgaagtatactttgtt

SEQ ID NO: 26479 - protein, 145 aa, Panicum virgatum
  misc_feature: Ceres CLONE 1869498
  misc_feature (89)..(145): Pfam Name: PQ-loop Pfam Description: PQ loop repeat
SSRTPPQTNGHREPLIGEITTAQSASPTRTKNALSVVPWLGLRFTRGLWPFLLENTRREVPSETVIPVGRRLLLFKDDQGYSSLSHGSGSEIGSFLGWAMAIIYMGGRLPQIFLNMQRGHAEGLNPLMFTFALLGNSTYVRSILC

SEQ ID NO: 26480 - DNA, 452 bp, Panicum virgatum
  misc_feature: Ceres CLONE 1869957
  misc_feature: Encodes the peptide sequence at SEQ ID NO. 26481
gtgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggccctatcccgcggcggtggcggcggcggcggcggttacggcggcggtcgccagggaggcttctgtgtgcgcggcggctacgcgctggcggtcgcgcgtgagggcgcgctacggcggcggcggct

SEQ ID NO: 26481 - protein, 124 aa, Panicum virgatum
  misc_feature: Ceres CLONE 1869957
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSTEQSMLDAIEAMNGKELDGRNITVNQALSRGGGGGGGGYGGGRQGGFCVRGGYALAVAREGALRRRR

SEQ ID NO: 26482 - DNA, 634 bp, Panicum virgatum
  misc_feature: Ceres CLONE 1869979
  misc_feature: Encodes the peptide sequence at SEQ ID NO. 26483
gcactcagcaatccgcaatcatcccgagcaatccctcgtcgaatccaccagcgaagcaaatccccagccttcctccccctctcccccgatggcccgcacgaagcagacggcgaggaagtccaccggcggcaaggcgccgaggaagcagctggcgacgaaggcggcgcgcaagtcggccccggcgaccggcggcgtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctccgcttccagagctcagccgtcgccgcgctgcaggaggcggccgaggcctacctcgtcgggctcttcgaggacaccaacctctgcgccgtcgccgtggagtggaagtagtagaaatggtagcttgtcatctgtgtccaatcggaatggtgtagagatgtgctgggttccttagctttggttgttggtcgaatcaagaagtggttgtttggtctcctgctgtaacttatcccattgtatcttcggtaccttggagttgcaatggatcaatgaaatggcaatgggcacagagttatcatg

SEQ ID NO: 26483 - protein, 118 aa, Panicum virgatum
  misc_feature: Ceres CLONE 1869979
  misc_feature (58)..(118): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAVAVEWK

SEQ ID NO: 26484 - DNA, 1058 bp, Panicum virgatum
  misc_feature: Ceres CLONE 1869990
  misc_feature: Encodes the peptide sequence at SEQ ID NO. 26485
accaccagtccaccaccaccaccaccacctcctccgccaccaccacgccgcagccgtttccgcgagaccgcaaacccccgccgcttcgctccagcaacccaccgcatcccggcccgcgcggcagcagcaagcagccagcgttacgaccgccatggccgccgcgcgctacgacgtggagcagggcgggaggggcggggaggggatgtacccgccgccgccgccgccggagcagatgtacccgcaacgggagggggagagggagtgggtgccctggttcgtgccggtcgtcgtggccgccaacatcgcgctcttcgccgtcgtcatgtacggtgctctctcaggaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggtggctacggcggcggcggsggcggctacggaggcggtggtggctacggcggtggtcgccgtgagggcggctacggcggaggcggtggcggcggtcgccgcgagggcggctacggtggtggtggctacggcagccgcggtgactccgtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatg

SEQ ID NO: 26485 - protein, 182 aa, Panicum virgatum
  misc_feature: Ceres CLONE 1869990
  misc_feature (10)..(81): Pfam Name: RRM_1 Pfam Description: RNA recognition motif. (a.k.a. RRM, RBD, or RNP domain)
  misc_feature (48)..(146): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
MAAADVEYRCFVGGLAWATDNASLQQAFASYGDVLDSKVITDRETGRSRGFGFVTFSSEQSMLDAIEAMNGKDLDGRNITVNQAQSRGGGGGGYGGGRQGGYGGGGGGYGGGGGYGGGRREGGYGGGGGGGRREGGYGGGGYGSRGDSVVTGGTDGVALPCWQPSYPIYLLVFVSLFDPSYP

SEQ ID NO: 26486 - DNA, 648 bp, Panicum virgatum
  misc_feature: Ceres CLONE 1869997
  misc_feature: Encodes the peptide sequence at SEQ ID NO. 26487
agccgaactagggtttcttctcgccgccgccttctcgcctccacgcccagattgccggctctacttggtgagccgcacggatggcggaggaagccaatggaaagaaggaggaggaggagatcagcacaggccctctgtcagtgctgatgatgagcgtcaagaacaatacccaggttcttatcaactgccggaacaacaagaagttacttggtcgtgtgagggcatttgatcggcattgcaacatggttcttgagaatgttagggagatgtggactgagataccgaagactggtaaaggcaagaagaaggctcttccggtgaacaaagacaggttcataagcaagatgttcctccgtggggattcagtcatcattgttctcaggaacccgaaatgagttggacaactttgctagcttgctgtctaatctgtatgccaaacactgttccattcgtataagagacgattcttggtggagtgttttagttggatgctgtgatgcacctcttgcgttcactggtactttctatttggcccaatcattatcaaatttagaactccactgttccatttgtcgattcccatttgcaaattgcaaggatggtaatggcatgtgtttgagcaaagcagggtcgtcatacgcccacagt

SEQ ID NO: 26487 - protein, 104 aa, Panicum virgatum
  misc_feature: Ceres CLONE 1869997
  misc_feature (22)..(101): Pfam Name: LSM Pfam Description: LSM domain
MAEEANGKKEEEEISTGPLSVLMMSVKNNTQVLINCRNNKKLLGRVRAFDRHCNMVLENVREMWTEIPKTGKGKKKALPVNKDRFISKMFLRGDSVIIVLRNPK

SEQ ID NO: 26488 - DNA, 722 bp, Panicum virgatum
  misc_feature: Ceres CLONE 1870017
  misc_feature: Encodes the peptide sequence at SEQ ID NO. 26489
gtggtcgccagcgacactgctagtaacctcgacctcccttcctccccagcaaccgatcctcatctccgcctgctgcaacagcagcagcagccatggcggcctccacggcactctccaccgccgccaaccccacccagctctgccgcccccgcgcctctcccaacaagccggccgtcaagggcctgggcctcgggacgggccgggaccgcttctcccagcggcggagcagcagcagcgtcacgtgccaggcggcgagcagcatccccgccgaccgcgtccccgacatcaagttggaggagtggctgcagacgcacgggcccaacgaccgcaccctggcgcaggggctcaagggcgacccgacgtacctggtggtggagcaggacaagacgctggcctcctacggcatcaacgccgtgtgcacccacctcggttgcgtcgtgccgtggaacggcgccgagaacaagttcatctgcccctgccacggatcccagtacaacaaccagggcaaggtcgtccgtggcccggcgcccctgtcgctggccctggtgcacgtcgacgtcgacgacggcaaggtgctcttcgtcccgtgggtggagaccgacttcaggaccggcgaggacccctggtggaaggcataagcggcggcgttgttcctgtctgccatctcagaggacgttacgttactgctggcttccagattatatatgtacacaacaggctgt

SEQ ID NO: 26489 - protein, 181 aa, Panicum virgatum
  misc_feature: Ceres CLONE 1870017
  misc_feature (65)..(157): Pfam Name: Rieske Pfam Description: Rieske [2Fe-2S] domain
  misc_feature: SWISSPROT Homolog: EC 1.10.99.1 Plastoquinol--plastocyanin reductase
MAASTALSTAANPTQLCRPRASPNKPAVKGLGLGTGRDRFSQRRSSSSVTCQAASSIPADRVPDIKLEEWLQTHGPNDRTLAQGLKGDPTYLVVEQDKTLASYGINAVCTHLGCVVPWNGAENKFICPCHGSQYNNQGKVVRGPAPLSLALVHVDVDDGKVLFVPWVETDFRTGEDPWWKA

SEQ ID NO: 26490 - DNA, 605 bp, Panicum virgatum
  misc_feature: Ceres CLONE 1870036
  misc_feature: Encodes the peptide sequence at SEQ ID NO. 26491
atgggaatcacctcctcttcctcctcgaaacaggaatcccggggtatagggctcgtacggggggaggagatcctcccctccccacccgtcgtacctcttcgcaagtcttactgccctttctgcgtccgtgtgaagcagctgttcgagaatctgggagcatgcttcaaggccattgagatggatgtggaaagtgatggagctgagctccaggatgctctcaaggagtggactggacagaggaccgttccaaatgtcttcatcaatgggaagcatattggtggctgcgatgataccatggcactgaacaatgatgggaagctggtgtctctgctaactgaggctggagcgatcaagggttctacttccaagaaaaccgccactgcttagctcgatctgacagttgtcctggttgacatgtttatactgttcccatggtatgatatgaaataacggggctatggttcgcaggtcctgaactttgtgctgtctaagtgtcaagtactatcaggactgtctagtccccctgttgaaccgctcatacatcagtcgagttgcatgcctgcgctaatagtaatgagttcctaatcatgaaccctgtcttcttc

SEQ ID NO: 26491 - protein, 69 aa, Panicum virgatum
  misc_feature: Ceres CLONE 1870036
  misc_feature: Functional homolog of the protein sequence given in SEQ ID NO 50111
  misc_feature: Useful for biocontainment applications
MDVESDGAELQDALKEWTGQRTVPNVFINGKHIGGCDDTMALNNDGKLVSLLTEAGAIKGSTSKKTATA

SEQ ID NO: 26492 - DNA, 708 bp, Panicum virgatum
  misc_feature: Ceres CLONE 1870047
  misc_feature: Encodes the peptide sequence at SEQ ID NO. 26493
gccgttgcctccctccaaggcttctccgctcatggcgtccctggcgttctcactggcaggagccttcaagggcctctccctcgcgtccccttcctcttccatgcgccctgacttcctccgcggcgaccgcgccgcgctctccgtcggcggcgccgcggtgggcgtgccggtgccggcgcggcggctgaccatccagatggcgcacaagaagggagccgggagcacaaagaacggccgtgactccaaggggcagcggctgggagtcaagatatacggcgaccaggttgccaagcccggggccatcatcatccgccagcgcggcaccagggtctatcctggaaataatgttggaatgggcaaggatcatacactcttttctttgattgatggactagtcaagttcgagaaatatggaccagacaagaaaaaggtaagtgtctacccatacgagaaacagcctgaaaacccaaaccgttacagagcaagaaagagagagtacttccgcatgcagcgtgaacgcaagaaggcaagagcagagggagccattgagcctcaattggtattagccgctgtagacgaaaactctgaggtcagcacagactgctgataagcttactgtgtagtatttccccttttttttttccacaagccatgtttgatattttctccctaatttgtaagactgcatgatccatttaaagtcatatt

SEQ ID NO: 26493 - protein, 191 aa, Panicum virgatum
  misc_feature: Ceres CLONE 1870047
  misc_feature (57)..(137): Pfam Name: Ribosomal_L27 Pfam Description: Ribosomal L27 protein
  misc_feature: Functional homolog of the protein sequence given in SEQ ID NO 50541
  misc_feature: Useful for making plants with modulated biomass
MASLAFSLAGAFKGLSLASPSSSMRPDFLRGDRAALSVGGAAVGVPVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKQPENPNRYRARKREYFRMQRERKKARAEGAIEPQLVLAAVDENSEVSTDC

SEQ ID NO: 26494 - DNA, 729 bp, Panicum virgatum
  misc_feature: Ceres CLONE 1870064
  misc_feature: Encodes the peptide sequence at SEQ ID NO. 26495
aagtctccagttcttccggcgcgcgtaactctccactccatggaagaccagagccccaagcccatccgctgcaaagctgcggtgtgcagagccgccggcgagccgctcatcgtcgaggagatcgtcgtcgatccaccgaaagcgtacgagatccgcatcaagatcatctgcacctcgctctgccacagtgacatcaccttctggcgaggcaaggcagcaacagcttttccaagaatcttaggccacgaagcctacggggttgtggagagcgtgggggagcatgtggagggcttcgccgccggcgacacggtggtgccgacgttcatggggcagtgcgaccgctgcccgggctgcgcttccgagcacaacaacctctgcaccacggtgcccttcgtgttcggccccgggatgcggcgcgacggcaccacccggttccgggacgcccaggggaaccccctccacgacctggtcgccgtgtccagcttcagccagtacaccgtcgtggacgtgacccaggtcgtcaggatcgaccccgccgtgccgcccaagctcgcctgcctcctcagctgcggcgccagcaccggggtgggagctgcatggagggtggccaaggtggaaccaggctcatcagtggccatctttgggctggggtccgttgggttagcggtgggcgcaggtgcgaaaatgtgcggagcatccaagattatcggcgttgacatgaaccctgac

SEQ ID NO: 26495 - protein, 229 aa, Panicum virgatum
  misc_feature: Ceres CLONE 1870064
  misc_feature (35)..(163): Pfam Name: ADH_N Pfam Description: Alcohol dehydrogenase GroES-like domain
  misc_feature: SWISSPROT Homolog: EC 1.1.1.1 Alcohol dehydrogenase
  misc_feature: Functional homolog of the protein sequence given in SEQ ID NO 51010
  misc_feature: Useful for making plants with modulated heat sensitivity
MEDQSPKPIRCKAAVCRAAGEPLIVEEIVVDPPKAYEIRIKIICTSLCHSDITFWRGKAATAFPRILGHEAYGVVESVGEHVEGFAAGDTVVPTFMGQCDRCPGCASEHNNLCTTVPFVFGPGMRRDGTTRFRDAQGNPLHDLVAVSSFSQYTVVDVTQVVRIDPAVPPKLACLLSCGASTGVGAAWRVAKVEPGSSVAIFGLGSVGLAVGAGAKMCGASKIIGVDMNP

SEQ ID NO: 26496 - DNA, 720 bp, Panicum virgatum
  misc_feature: Ceres CLONE 1870111
  misc_feature: Encodes the peptide sequence at SEQ ID NO. 26497
acgtaaccacgtctcctccgccgccccgcttcctcctgcctccttgctaagcaaacccccgcttttcctcctccgccctgcacgcgcgcgcctcgcgaaatcccccctccctcgccgccgctcgccattccccgccccggaggaagccagccagccccgccggagatgtcgtacgcctacctcttcaagtacatcatcatcggcgacacaggcgtcggcaagtcgtgcctgctgctgcagttcaccgacaagcgcttccagcccgtgcacgacctcaccatcggcgtcgagttcggggcgcggatgatcaccatcgacaacaagcccatcaagctccagatttgggacacggcaggccaagagtcattcagatccataactagatcatactacagaggggccgcaggttctcttttggtctatgatatcaccaggagggagactttcaatcacctcgcaagctggctggaggatgcgaggcagcacgccaacgccaacatgacgataatgctggttgggaacaaatgtgatctgtctcacaggcgtgcagtgagctacgaggaaggcgagcagtttgcaaaggaacatggcctgatcttcatggaggcatctgcaaaaaccgcacaaaacgtcgaggaggtatttgttaagactgctggagcgatctacaagaaaatccaagatggtgttttcgatgtatctaatgagtcttatggaatc

SEQ ID NO: 26497 - protein, 184 aa, Panicum virgatum
  misc_feature: Ceres CLONE 1870111
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51218
  misc_feature: Useful for making plants with altered lignin content
  misc_feature: Functional homolog of the protein sequence given in SEQ ID NO 50522
  misc_feature: Useful for making plants with modulated oxidative stress sensitivity
MSYAYLFKYIIIGDTGVGKSCLLLQFTDKRFQPVHDLTIGVEFGARMITIDNKPIKLQIWDTAGQESFRSITRSYYRGAAGSLLVYDITRRETFNHLASWLEDARQHANANMTIMLVGNKCDLSHRRAVSYEEGEQFAKEHGLIFMEASAKTAQNVEEVFVKTAGAIYKKIQDGVFDVSNESYG

SEQ ID NO: 26498 - DNA, 687 bp, Panicum virgatum
  misc_feature: Ceres CLONE 1870198
  misc_feature: Encodes the peptide sequence at SEQ ID NO. 26499
gcactcgcccttatcatccatccaccctccgtcctccctcccctccctcgcccatcccccaccacgccggcccaccgccctcgccatcccactccgttcccccctcagttttcccactcggttgcagttgctgcgagcagtcaccaccgccgccgctgccgcgcacacaaaccagcggcaataaacacctcccccgcccccctcgcctcgctcccaacctccgattcgagggcgccgcgatcgcgatcggacccgtccgcggctggaatcgtcgaggagccgagagggatcggattggtggggggagagagagagagagaggggggcggcgatggggcggctgttcctgacgcacctggacggcaacgtctacagctgcaagcactgcaagacccacctcggccttgccagcgacatcatctccaaggccttccacagcaagaacgggaaggcctacctcttccataaggttgtcaatgtgactcctggagtaaaagaagaccgcatgatgataacaggaatgcatactgtttctgatatcttctgtgtttgctgtggatccattgttggatggaaatatgaagccgcacatgagaagaaccagaggtacaaggaaggaaagtatattctggagaggttcaaggtggcaggcccagacggaagccagtactggaatgcacatgatgc

SEQ ID NO: 26499 - protein, 118 aa, Panicum virgatum
  misc_feature: Ceres CLONE 1870198
  misc_feature (1)..(108): Pfam Name: Yippee Pfam Description: Yippee putative zinc-binding protein
MGRLFLTHLDGNVYSCKHCKTHLGLASDIISKAFHSKNGKAYLFHKVVNVTPGVKEDRMMITGMHTVSDIFCVCCGSIVGWKYEAAHEKNQRYKEGKYILERFKVAGPDGSQYWNAHD

SEQ ID NO: 26500 - DNA, 611 bp, Panicum virgatum
  misc_feature: Ceres CLONE 1870223
  misc_feature: Encodes the peptide sequence at SEQ ID NO. 26501
tatggaggggaaagtgtgtggtgttacatctgaaggtgaaactgcaaagtgcaagaaggtggtctgtgatccttcgtatttacccaacaaggttaggaagataggtagggttgtacgtgcaattgctatcatgtgccacccaatccctaatacaaatgagtcccactcagttcacattattttgccacagaaacaacttggacacagatcagacatgtatgttttctgttgctcatacacacacaatgttgcgccaagaggaaagttcattgcatttgtgtctgcagaagacgagactgataacccccagtccgagctaaagcctggacttgatctacttggccctgtagatgagatattttatgatatttatgacagatatgaaccagtgaatgaaccgtctcttgataattgctttgtctcaacgagttatgatgccaccacacattttgagacaaccgtgacagatgttcttaacatgtatacgatgatcactggaaagacggttgatcttagtgtggatttgagtgctgccagtgctgctgaataatactagatttctcaatcattacctcatgttcatcaaagaagcacatcgtcagggacagcac

SEQ ID NO: 26501 - protein, 182 aa, Panicum virgatum
  misc_feature: Ceres CLONE 1870223
  misc_feature (1)..(177): Pfam Name: GDI Pfam Description: GDP dissociation inhibitor
MEGKVCGVTSEGETAKCKKVVCDPSYLPNKVRKIGRVVRAIAIMCHPIPNTNESHSVHIILPQKQLGHRSDMYVFCCSYTHNVAPRGKFIAFVSAEDETDNPQSELKPGLDLLGPVDEIFYDIYDRYEPVNEPSLDNCFVSTSYDATTHFETTVTDVLNMYTMITGKTVDLSVDLSAASAAE

SEQ ID NO: 26502 - DNA, 375 bp, Panicum virgatum
  misc_feature: Ceres CLONE 1870229
  misc_feature: Encodes the peptide sequence at SEQ ID NO. 26503
atccacctcgcccacccgtctgccgtctgactgcccgttcttgcatgcttgatactcgcatccagcttggctggcagtggcagctgatccttcggccggccggtcatgagctaccaagcaggctacccgcctcccggcaccgcctcgttccctccgccggggcagcatgcggcctaccgcgcgcccccaccccaggcccacctcgcgccgccgcccgcgtaaccaccgtcccaagacgacgccggcgcgcaccgccagcaccccctgctccaaaccgcgatcccccctgcctacggggactggaaaggacgcttgaccctccgtctgccgctggtgcgtcctccacgcgtgcttctgaggacgacaaccgaactt

SEQ ID NO: 26503 - protein, 38 aa, Panicum virgatum
  misc_feature: Ceres CLONE 1870229
  misc_feature: Functional homolog of the protein sequence given in SEQ ID NO 50205
  misc_feature: Useful for making plants with altered cell wall content and/or composition
MSYQAGYPPPGTASFPPPGQHAAYRAPPPQAHLAPPPA

SEQ ID NO: 26504 - DNA, 750 bp, Panicum virgatum
  misc_feature: Ceres CLONE 1870249
  misc_feature: Encodes the peptide sequence at SEQ ID NO. 26505
atctgtagccttcgccagcgccggaagttaaagaacaaagaagaggacgccccggccgcaactcccctagacgaagaagagacccttgggctgacgtcgagcggagaaggcgagagaagatggggaagggcgtcctggaggtgcacctcgtcgacgccaggggcctctccggcagcgatttcctagggaagatcgacccctacgtgatcgtgcagtaccggagtcaggagcgcaagagcagcgtcgcccgagaccaggggaggagcccgtgctggaacgaggtgttcaagttccagatcaactcttcggcgtccagcgcgcagcacaagctcatcctccggatcatggaccacgaccacttctccagcgacgacttcctcggcaaggctacgatcgacgtgacggacatcatcagcttgggcgcggagcgcggctcgtaccacctcaacgcggggaagcacaacgtggtcctcgccgacagcacgtaccacggcgagatcaaggtcggcatcaccttcaccgccgcccaggttgaggaagatgatgaggattttggaggctggaggcgcagaagctccaatgcgtaggtgcggtgaaatctgaagaagttctttggttggtttgtagtgtagtaattcaggtcgggtgtagtttttgtcgtttgtactggcagaagtttgtgcccaagattgttgattggctggttagactatgtgtaatcaagtatgcttaaagccgttgttgattgac

SEQ ID NO: 26505 - protein, 155 aa, Panicum virgatum
  misc_feature: Ceres CLONE 1870249
  misc_feature (6)..(91): Pfam Name: C2 Pfam Description: C2 domain
  misc_feature: SWISSPROT Homolog: EC 3.1.1.4 Phospholipase A(2)
MGKGVLEVHLVDARGLSGSDFLGKIDPYVIVQYRSQERKSSVARDQGRSPCWNEVFKFQINSSASSAQHKLILRIMDHDHFSSDDFLGKATIDVTDIISLGAERGSYHLNAGKHNVVLADSTYHGEIKVGITFTAAQVEEDDEDFGGWRRRSSNA

SEQ ID NO: 26506 - DNA, 720 bp, Panicum virgatum
  misc_feature: Ceres CLONE 1870304
  misc_feature: Encodes the peptide sequence at SEQ ID NO. 26507
acccccgcatcgcgcccgcccgggccgccttctcttctccagcgtccgatctcccactcgccgccctcaccgcagctccctccgctcggtcgcttccccacctccgccttccccgcgcgcgcgcgcgcccgccacctcgccctccttccctccacgtcgcgcgcgcccgcccttatataagtgcgggaggagcgcatggcggacgcgccagcgagccccgggggcggcggcgggagccacgagagcgggagccccaggggcggcgccgggggcgggggcggcggcgtcagggagcaggacaggttcctgcccatcgccaacatcagccgcatcatgaagaaggccatcccggccaacgggaagatcgccaaggacgccaaggagaccgtgcaggagtgcgtctccgagttcatatccttcatcaccagcgaggcgagtgacaagtgccagagggagaagaggaagaccatcaacggggacgacctactgtgggccatggccacgctggggttcgaggactacatagaacccctcaaggtgtacctgcagaagtacagagagatggagggtgatagcaagttaactgcaaaaactggcgatggctctattaaaaaggatgcccttggccatgggggagcaagtagctcagccacacaagggatgggccaacaaggagcgtacaaccaaggaatgggttatatgcaacctcagtaccataac

SEQ ID NO: 26507 - protein, 174 aa, Panicum virgatum
  misc_feature: Ceres CLONE 1870304
  misc_feature (36)..(101): Pfam Name: CBFD_NFYB_HMF Pfam Description: Histone-like transcription factor (CBF/NF-Y) and archaeal histone
  misc_feature: Useful for making plants with modulated drought sensitivity
  misc_feature: Useful for making plants with modulated water use efficiency
MADAPASPGGGGGSHESGSPRGGAGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKTGDGSIKKDALGHGGASSSATQGMGQQGAYNQGMGYMQPQYH

SEQ ID NO: 26508 - DNA, 463 bp, Panicum virgatum
  misc_feature: Ceres CLONE 1870309
  misc_feature: Encodes the peptide sequence at SEQ ID NO. 26509
ccttatcatttggagtgcacggcactgcggggcgcgcgggtcgacgctgcggggcgatgctgctggcgggcgcctgcggggtgctgctgcggcgagtgccaactgccactacgacgcgcgctgcaagaacctctacatcattgccggcaagaggcatcaagggcacgctcaaccggcctggctgccgcctgcgtgggcgaccgcccaggcccaccatcaagaatgccaagcccgcacctcaggaagaaggccatgcccgacggcatcctccgccaacacattgccgtggggccgcgatgactgagtctacatgatacttcgaatataatgactggggttattagtataacccaaaaggctacatgaaaggatctgctatcactggaccaattgggaacgattgtgctgatctttggcctacgattgctactgcatcaaacgccatagcctaaaatcaggattt

SEQ ID NO: 26509 - protein, 29 aa, Panicum virgatum
  misc_feature: Ceres CLONE 1870309
  misc_feature: Functional homolog of the protein sequence given in SEQ ID NO 50297
  misc_feature: Useful for making plants with modulated biomass
  misc_feature: Useful for making plants with modulated heat sensitivity
MKGSAITGPIGNDCADLWPTIATASNAIA

SEQ ID NO: 26510 - DNA, 730 bp, Panicum virgatum
  misc_feature: Ceres CLONE 1870333
  misc_feature: Encodes the peptide sequence at SEQ ID NO. 26511
gccatgtggaagcgcgccacctgcctcctcctccgccaccaccgcttcgccctggccccccaatccccggcggtctccgccgccgccgcgcctggactctgccgggcgccggcgcccctcttcttctccactcttgatgcggctggtaagaggacgagggtggaagacgtgatgccgatcgccacggggctcgagcgcgaggagatcgaggccgagctccagggaaagaagagattcgacatggacgcgcccgtcggtccctttggcaccaaggaagctcctgctgtgattcagtcatactacaacaaaaggattgttggttgccctggtggtgaaggagaagatgagcatgatgtggtgtggttttggttggagaaaggcaaaccacatgaatgcacagtctgtactcaatatttcatgcttgatgtgattggaggaggatcccctgatggacatgatgacgatgatcaccaccattaaggttctgtaggctatggcaataaaatgggggtgcaaataccatttttgtcacagcgttgtgaagctgtggaaaactcagcatttgggcattatagagttcggtagaccatgtcaacccgattgccccacggcttggaagctggaaacaggacatggtttgtaagacataaaagtcacttcattaaatcggctatacaaataacttagacaacgctgtacttttgcccatcaacacatgttctgctgaatc

SEQ ID NO: 26511 - protein, 158 aa, Panicum virgatum
  misc_feature: Ceres CLONE 1870333
  misc_feature (49)..(148): Pfam Name: COX5B Pfam Description: Cytochrome c oxidase subunit Vb
  misc_feature: SWISSPROT Homolog: EC 1.9.3.1 Cytochrome-c oxidase
MWKRATCLLLRHHRFALAPQSPAVSAAAAPGLCRAPAPLFFSTLDAAGKRTRVEDVMPIATGLEREEIEAELQGKKRFDMDAPVGPFGTKEAPAVIQSYYNKRIVGCPGGEGEDEHDVVWFWLEKGKPHECTVCTQYFMLDVIGGGSPDGHDDDDHHH

SEQ ID NO: 26512 - DNA, 723 bp, Panicum virgatum
  misc_feature: Ceres CLONE 1870335
  misc_feature: Encodes the peptide sequence at SEQ ID NO. 26513
  misc_feature (633)..(633): n is a, c, t, g, unknown, or other
attcttgactcttccccgccttcctctgctcgctcgtccgctcctctctcccccgtcaccgtccatggcggcgtcctcctccgcctccgcctcgccgctcctcctcccctcagggtcgaggcgtgcgtcggcgtcgagggcgcggctccgcggcggcggcgcgtccaggagcagggcgctgggctcagaggcgccgtgctgctgcaaggccctcgccgccgccggaaacgcggcacaatgcggggcggctgacagtttcgtgatcagcagcgggagtagcaccaggagggggctcctaggggtggccctgggagcgtctgccctggggctcgccgcgctcgatgccgtcgccgccgggctgccgccggaggagaagcccaagctctgcgacgccgcctgcgaaagcgagctcgaaaatgtgcctatggtaaccacagaatccggcctgcagtacaaggacatcaaagtgggcgaagggccaagcccacccgttggtttccaggttgctgcaaactatgttgccatggtaccgaatgggcagatattcgacagttcactagagaaaggtcagccctacatattccgggtcggatcaggacaggtgatacaggggcttgatgaaggaattttgtncatgaaggttggaggactacgtcggttgtacatacctggaccattagcgtttccaaagggtcttacttcagctccaggaaggccaagggt

SEQ ID NO: 26513 - protein, 219 aa, Panicum virgatum
  misc_feature: Ceres CLONE 1870335
  misc_feature (136)..(212): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature (190)..(190): Xaa is any aa, unknown, or other
MAASSSASASPLLLPSGSRRASASRARLRGGGASRSRALGSEAPCCCKALAAAGNAAQCGAADSFVISSGSSTRRGLLGVALGASALGLAALDAVAAGLPPEEKPKLCDAACESELENVPMVTTESGLQYKDIKVGEGPSPPVGFQVAANYVAMVPNGQIFDSSLEKGQPYIFRVGSGQVIQGLDEGILXMKVGGLRRLYIPGPLAFPKGLTSAPGRPR

SEQ ID NO: 26514 - DNA, 672 bp, Panicum virgatum
  misc_feature: Ceres CLONE 1870362
  misc_feature: Encodes the peptide sequence at SEQ ID NO. 26515
attcgcctttccgcacccgccgctcggtcgccttcgagttccaccagccaccaaacccgccggggagaagtcgagaggagcaagtcgccgagaagaggagagatggcccgtacgaagcagaccgcccgcaagtccaccggagggaaggcccctcgcaagcagctcgccaccaaggttcgttcgcgtctctctctctcgtgttcctccgttccgatctgctctgttctcgccgagatttggcggttgttgggcgcaagttgtcctgagaagcggttgcgatttgttgcgcaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggctctccaggaggccgccgaggcctacctcgtcgggctattcgaggacaccaacctctgcgccatccacgccaagcgcgtcaccatcatgcccaaggacatccagctcgcccgccgcatccgcggcgagcgcgcgtaagccgcagccgccgctgccgtaccggtagtggagatgtaggag

SEQ ID NO: 26515 - protein, 175 aa, Panicum virgatum
  misc_feature: Ceres CLONE 1870362
  misc_feature (97)..(171): Pfam Name: Histone Pfam Description: Core histone H2A/H2B/H3/H4
MARTKQTARKSTGGKAPRKQLATKVRSRLSLSCSSVPICSVLAEIWRLLGASCPEKRLRFVAQAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 26516 - DNA, 805 bp, Panicum virgatum
  misc_feature: Ceres CLONE 1870371
  misc_feature: Encodes the peptide sequence at SEQ ID NO. 26517
ctgcacgccggccggtcgccgtgacggcgtcacctctctctcccccgcgaaaaccctaatggcgtcgcgcctcctccacctccgccgcctcctaactccacgccccaccctccatgccgccgcgttctccaccgccgccaccccgaccccgcgcgtctccgggatcgtcgacgagatctgcggcctcactctcctcgaggcctcctccctcgccgacgccctgcgcggccgcctcggcgtcgaccagctccccccgctggccatcctcacgggcggcgccgtcccgctcgccggaggagcagcgggacccggggcggccggcgaggaggccaaggcgaaggaggagaagatggcgttcgacgtgaagctggaggggttcgacgccgcggcgaagctcaagatcatcaaggagctcagggcgttcacgaatttggggttgaaggaggcgaaggagctcgtggagaaggcgccggccgtgctgaaggcaggagtgcccaaggaggaggcggagagtatcgccgagaagatgcgagcggtcggcgccaagatcgttctcgagtgagacgacgagagctctgtatggcctcgtttcttgatttgttttatcttaattgtacgaagaaactgatagaattttggaacaaggaagcaataattagtgagattgactgtggagatattttcattgccggtggaaatgccaattgggctttggggaatagtcttagatttagcaatattgcttcgagctctgtatcttggttgtttgttttatggtatgaaaaatagagattcttttactcac

SEQ ID NO: 26517 - protein, 167 aa, Panicum virgatum
  misc_feature: Ceres CLONE 1870371
  misc_feature (100)..(167): Pfam Name: Ribosomal_L12 Pfam Description: Ribosomal protein L7/L12 C-terminal domain
MASRLLHLRRLLTPRPTLHAAAFSTAATPTPRVSGIVDEICGLTLLEASSLADALRGRLGVDQLPPLAILTGGAVPLAGGAAGPGAAGEEAKAKEEKMAFDVKLEGFDAAAKLKIIKELRAFTNLGLKEAKELVEKAPAVLKAGVPKEEAESIAEKMRAVGAKIVLE

SEQ ID NO: 26518 - DNA, 562 bp, Panicum virgatum
  misc_feature: Ceres CLONE 1870396
  misc_feature: Encodes the peptide sequence at SEQ ID NO. 26519
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcaacatcaccgtcaacgatgcccagtcccacggcggcccgcgctccggcggcgggagcgcgccggtacgggtgccgcctgtgcctgcgccgctacaacgcaagtcggaggggttccgactgcaccacctcgtgacgggcgctgagaagctggtggagaaggatggccgccaactggagagcgcctgcagcctcgccggtgggctgtttatgatggcccacgggttcctacagtagag

SEQ ID NO: 26519 - protein, 154 aa, Panicum virgatum
  misc_feature: Ceres CLONE 1870396
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
MAASDVEYRCFVGGLAWATDDNSLHNAFSPFGEVLESKIILDRETQRSRGFGFVTFSSEQAMRDAIEGMNGKELDGRNITVNDAQSHGGPRSGGGSAPVRVPPVPAPLQRKSEGFRLHHLVTGAEKLVEKDGRQLESACSLAGGLFMMAHGFLQ

SEQ ID NO: 26520 - DNA, 633 bp, Panicum virgatum
  misc_feature: Ceres CLONE 1870400
  misc_feature: Encodes the peptide sequence at SEQ ID NO. 26521
gtcgggttgggggtcgccgcgtcgcctgcttccagtttcttcctccctgaaccctcgccgccgccgccgccgctccgggtccgtgcccctgccggcgccgccgccgccaaaagagggaaaatagggaggatggccggcgctctcgacttgtccctcgacaacctcttctccaaaaacaaaaaaacccagccgcgccccagcggccaaggcccgacctcgggaggcggaggccccgcacccacggggccgcgccgtcgcttcaacgcccgcgcagccgcagccccgtaccaccgcggcaccattttccttttccaggcgcaggcgcggcggcccttggtttatgctggatacggagccccccagccccagccgccaatggacccgcccaccaagttttacttctccaacctcgactatggcgtctccaacaacaacttcaaggaattattttctgatgtcggcaatatccagcgttcctccttcaactatgacaggattggaaaatcaaagggaaccgcaaaggttgtcttctcaagaaggtctgatgttctagctgctcttaggaggtacaacattgtgcagcttgatggcaaacttatgaaaattgagatcattggaacaattattgagggc

SEQ ID NO: 26521 - protein, 167 aa, Panicum virgatum
  misc_feature: Ceres CLONE 1870400
  misc_feature (89)..(159): Pfam Name: RRM_1 Pfam Description: RNA recognition motif. (a.k.a. RRM, RBD, or RNP domain)
MAGALDLSLDNLFSKNKKTQPRPSGQGPTSGGGGPAPTGPRRRFNARAAAAPYHRGTIFLFQAQARRPLVYAGYGAPQPQPPMDPPTKFYFSNLDYGVSNNNFKELFSDVGNIQRSSFNYDRIGKSKGTAKVVFSRRSDVLAALRRYNIVQLDGKLMKIEIIGTIIE

SEQ ID NO: 26522 - DNA, 707 bp, Panicum virgatum
  misc_feature: Ceres CLONE 1870409
  misc_feature: Encodes the peptide sequence at SEQ ID NO. 26523
atcgcactcagcaatcttgccgagcaatccctcgtcgaatccaccagcgaagcaaatccccagccttcctcgcccgctcccccgatggcccgcacgaagcagacggcgaggaagtccaccggcggcaaggcgccaaggaagcagctggcgacgaaggcggcgcgcaagtcggccccggcgaccggcggcgtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctccgcttccaaagctcagccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggcgagagggcctaggcgccgtcgccgtggagtggaagtagtacaaatggtagcttgtcatctgtgtccaatcggaatggtgtagtgatgtgctgggttccttagctttggttgttggtcgaatcaagaagtggttggttggtctcctgctgtaatttatcccattgtatcttctgtaccttggagtggcaatggatgcatgaaatgggcatgggcaccgagttatc

SEQ ID NO: 26523 - protein, 136 aa, Panicum virgatum; identical to SEQ ID NO: 10238
  misc_feature: Ceres CLONE 1870409
  misc_feature (58)..(132): Pfam Name: Histone Pfam Description: Core histone H2A/H2B/H3/H4

SEQ ID NO: 26524 - DNA, 685 bp, Panicum virgatum
  misc_feature: Ceres CLONE 1870427
  misc_feature: Encodes the peptide sequence at SEQ ID NO. 26525
tgctgagatgagggacaatgaacagagttcggaagcaaaaagtgcacctgaggaactggttcagcaggtgctaagtgccggatggagagagggcctaaacatagcatgtgaaaatgcactcagtcgctatgatgccacagcttacaacacaatcctcaggaatgcaagaccacaaggaatcaacaagaatggccctcctgaacacaagttgtacgggttcacctacctccgagtatcgagtgagctccttgaaggacaaaactatgccactttcaaaacttttgtcaggagaatgcatgctaacctggattacaacgcaaatattgatccacttgcacctatggaaagatcaaagccagaaataccaatcgaaaaaatcctggaagtagcacagccaaagttggagccatttcctttcatcgagaacacagatctaccaatttaaacatcccaatggttcaatctactggaaggggcacaaggaactttaaaaagcaagacagacacagcaagcctattgtcgaacaatatgctgaaaccaaataaactgctatgttaagcagactacaatcatgttgcaccaataatcttgtgttgttcaacctgaggcttgatgcttgtctaatgagctgtaataccttggccttcacattgttgtatgtatttgagctaatgaataaaaatg

SEQ ID NO: 26525 - protein, 147 aa, Panicum virgatum
  misc_feature: Ceres CLONE 1870427
  misc_feature: SWISSPROT Homolog: EC 3.2.1.2 Beta-amylase
AEMRDNEQSSEAKSAPEELVQQVLSAGWREGLNIACENALSRYDATAYNTILRNARPQGINKNGPPEHKLYGFTYLRVSSELLEGQNYATFKTFVRRMHANLDYNANIDPLAPMERSKPEIPIEKILEVAQPKLEPFPFIENTDLPI

SEQ ID NO: 26526 - DNA, 630 bp, Panicum virgatum
  misc_feature: Ceres CLONE 1870428
  misc_feature: Encodes the peptide sequence at SEQ ID NO. 26527
aggaacggctccgcctctcgccgcctagctcgcggtctcgcaccatttccttcgctccaagaaaaggcgctgccatggccatggcggcgctgcgcggggcctcccgctgcctggcgccaagggggagcgccgtggccgcgcggcccatgctcctggcgcactcgcgcggaatcacctacaagctcttcattggaggcttatcacagtttgcaacggaagacagcctagcagaagcgttctctcgttacggccaagtaatagaagctacgatcatcacggataaggtgaccaacagaccaaaggggtttggcttcgtgaaatttgcttccgaggaagaagccaataacgcgagggaagagatgaacggcaaggtactgaatggccgtgtgatctacgtcgacattgcaaaggccaaactggaccgggatgtagatgccctgccaatagcgacaggccctcctaagccaattggcaacgactgaaaaagaatggcctggtgtgtagactccatacttctcctctgctcctctctgctgtactagttcactcctcatattcggaagctctagatatggagtgatgtttaataatgtgtcgaggttttgcgagaatacaaatcaagtccactta

SEQ ID NO: 26527 - protein, 135 aa, Panicum virgatum
  misc_feature: Ceres CLONE 1870428
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50830
  misc_feature: Useful for making plants with modulated cold sensitivity
MAMAALRGASRCLAPRGSAVAARPMLLAHSRGITYKLFIGGLSQFATEDSLAEAFSRYGQVIEATIITDKVTNRPKGFGFVKFASEEEANNAREEMNGKVLNGRVIYVDIAKAKLDRDVDALPIATGPPKPIGND

SEQ ID NO: 26528 - DNA, 675 bp, Panicum virgatum
  misc_feature: Ceres CLONE 1870438
  misc_feature: Encodes the peptide sequence at SEQ ID NO. 26529
aatccggcaatcccccccagtcgctggcagccgcaagcgccgtgctcgtcgccgtccgccgctcgtcttcgtcccgcacggccgccaggcgagctgcgacttcgaccgcaaccacacaccagcagcgcaagaggttgattatcagttgggttctgattttgggatttgtggctcttgtattgaggtggcaaactaaaacagtcaacaaccatgcaggctagcgatcggttcaacataaattctcagcttgagcatcttcaagccaaatatgttggcacaggacatgcggacttgaccagatttgaatgggctgtaaacattcagagggacagctatgcctcttatattgggcactatccaatgttggcatattttgctattgctgaaaatgaatcaattggaagagagcgttacaattttatgcagaaaatgctgcttccatgcggcctccctcctgagagagatgaagactgaggagcctctacacgatccttatgcatcacaacagtagcttgtgttgaacttaggttcgctaccggagtaaaaggggggcacactagaatggccacgctagtaatatctgtggctgtgcttgaaatttgaattccctgatcatgcattgcacgcttttggcttaaacgacacggatctttctcatgaaatcccgaattttca

SEQ ID NO: 26529 - protein, 87 aa, Panicum virgatum; identical to SEQ ID NO: 15474
  misc_feature: Ceres CLONE 1870438
  misc_feature (5)..(87): Pfam Name: SF3b10 Pfam Description: Splicing factor 3B subunit 10 (SF3b10)

SEQ ID NO: 26530 - DNA, 574 bp, Panicum virgatum
  misc_feature: Ceres CLONE 1870440
  misc_feature: Encodes the peptide sequence at SEQ ID NO. 26531
agcagtacaagaagcacaagaaaaaacacttgtagccatcagcttcttcttcttcttcttcttcaccgtcatcaagtcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcagagacaagcccgacgccgacatccgcgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccgatcagggttagaaatatcggccgcaatttcacgagatacccgatatatcgggtttatcggtggggtctgatattttttttatcggccgaaattgatttaatgaatattttttatactaaaaagtaaattag

SEQ ID NO: 26531 - protein, 74 aa, Panicum virgatum
  misc_feature: Ceres CLONE 1870440
  misc_feature (15)..(74): Pfam Name: potato_inhibit Pfam Description: Potato inhibitor I family
MSSSAEAADQCGGGKTSWPEVVGMSIEEAKKVILRDKPDADIRVLPVGTPVTRDFRPNRVRIFVGTVAQTPHVG

SEQ ID NO: 26532 - DNA, 722 bp, Panicum virgatum
  misc_feature: Ceres CLONE 1870456
  misc_feature: Encodes the peptide sequence at SEQ ID NO. 26533
gtaagtagcattacgccaagcaacatcagacagtagcagtagctagacagtaatgggtttcagcgaggctcaggaagagctcgtcctgcgctcatggaaagccatgaagaaggacgccgaatccatagctctcaagttcttcttcaggatctttgagatcgcgccgggcgccaagcagatgttccccttcctgcgcgacgccggcgacgcgcccctggagaaccaccccaagctcaaggcgcacgccgtggccgtcttcgtcatggcttgcgagtccgcgacgcagctgaggaacaccggcgacgtgaaggtgagggaggcggcgctgaagcggctgggcgcgacgcacgtcaaggccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacgccgccgccgcctgagttcgtcgtgaagaccttaacactctgtcacacgcatcccctgctgctgcgaagaacgcgcgttgctggggagagcttggagctgccactgctgctggctgctgctactccacgaagatgtcgctactactagagtactagtccactactgtgttctgtttttgtcagtgccagccacgtcattgatgaataaaac

SEQ ID NO: 26533 - protein, 157 aa, Panicum virgatum
  misc_feature: Ceres CLONE 1870456
  misc_feature (7)..(117): Pfam Name: Globin Pfam Description: Globin
  misc_feature: SWISSPROT Homolog: EC 1.14.12.17 Nitric oxide dioxygenase
  misc_feature: Functional homolog of the protein sequence given in SEQ ID NO 50202
  misc_feature: Useful for making plants with modulated cold sensitivity
  misc_feature: Useful for making plants with modulated salt sensitivity
MGFSEAQEELVLRSWKAMKKDAESIALKFFFRIFEIAPGAKQMFPFLRDAGDAPLENHPKLKAHAVAVFVMACESATQLRNTGDVKVREAALKRLGATHVKAGVADAHFEVVKTALLDTIRDAVPDMWTPEMKAAWEEAYDQLAAAIKEEMKNAAAA

SEQ ID NO: 26534 - DNA, 702 bp, Panicum virgatum
  misc_feature: Ceres CLONE 1870462
  misc_feature: Encodes the peptide sequence at SEQ ID NO. 26535
aaatcgatcggagcacaacagaagccacacgctcacaagacacaagcaagcaagcatctgaggagaagccggccgccgatttccccagcccgtgcattgttcccgatggcgaccatggtgatggcctccgccgcgagctccctcgccttcgccgccaccggcgcgagcgccggccgcttccccgcccggcttccggcggcggcggggctcgcgccgcgccggcgcgcaccgctcgtcagggcgcaggctaataagggtcctgagaagccggcagcgagcccggggctctgggacgcgctggcgttcagtggccccgcgccggagcggatcaacgggcgcctcgccatggtgggcttcgtgtccgcgctcgccgtcgaggcggcccgcggggacggcctcctcgcgcaggtcggcaacggcgccgggctcgcgtggttcgcgtacacggccgtcgtgctgtccgcggcgtcgctggcgccgctgctccagggggagagcgccgaggacaggagcggcggcttcatgaccgccgacgccgagctctggaacggccgcctcgccatgctcggcctcgtcgcgctcgctgccaccgagtacctcaccggcgcgcctcttgtcaacgtgtaaatacggcgtacattacgtacgcatacgtgtagctgtatgtgtagaggcggtagtgtatatacgtgtgtatttgta

SEQ ID NO: 26535 - protein, 173 aa, Panicum virgatum
  misc_feature: Ceres CLONE 1870462
  misc_feature (49)..(164): Pfam Name: Chloroa_b-bind Pfam Description: Chlorophyll A-B binding protein
  misc_feature: SWISSPROT Homolog: EC 4.99.1.1 Ferrochelatase
MATMVMASAASSLAFAATGASAGRFPARLPAAAGLAPRRRAPLVRAQANKGPEKPAASPGLWDALAFSGPAPERINGRLAMVGFVSALAVEAARGDGLLAQVGNGAGLAWFAYTAVVLSAASLAPLLQGESAEDRSGGFMTADAELWNGRLAMLGLVALAATEYLTGAPLVNV

SEQ ID NO: 26536 - DNA, 488 bp, Panicum virgatum
  misc_feature: Ceres CLONE 1870473
  misc_feature: Encodes the peptide sequence at SEQ ID NO. 26537
attacccctcaaacatacaagaagaagcagcattcgaagtgcttacatcttgtggtatatatctctgaagaagatgagcagctcggcagttggtgatggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggagcgttctggtatgccattaaaattgttatgtttcggatatacaccattattatttgcaatatcagaaacatgctattac

SEQ ID NO: 26537 - protein, 76 aa, Panicum virgatum
  misc_feature: Ceres CLONE 1870473
  misc_feature (17)..(76): Pfam Name: potato_inhibit Pfam Description: Potato inhibitor I family
MSSSAVGDGKGCDATPKTEWPELVGSTIKEATEKINAERPDLNVEPVPVGTIVPQDFDPKRVRLWVDTVAEVPRIG

SEQ ID NO: 26538 - DNA, 673 bp, Panicum virgatum
  misc_feature: Ceres CLONE 1870478
  misc_feature: Encodes the peptide sequence at SEQ ID NO. 26539
atcagtccatcagcaagctaagcactacacctagtagctgaaacgccacctgagacaaaggttatctgaacattcagccaggaaagcatcagaagcaaccatggtcagtgccaagagacttgttcaaatggcgaagaagtggcaaagaatggcggccctcgcgaggagaaggatcacgtcgccggcgaaagagaccgaagggtcgtcgtgcagcacttcgtcggtggccggcaagggccactgcgttgtgtacttggccgacggccggcggttcgaggtcccgctggcgtaccttaacacggcgatcttcggcgagctcctgagcctgtcgcaggaggagttcgggttcgccggcgacgacggcaggatcacactgccctgtgaagctgccgtgatggagtacgtcatgtgcttgctccggagaaacgcatcagaggaggtcgaggcggctttcctgacctccatagcgaggccgtgccactatggaagcggcttggcgcaatccattggagttagccagcaacttgctgtttctagcttctgaagaacacagcattgagcttgtcttctccttctagctccagcacgatgtatgtaaattgttacatggggagattggaaatagaatagagatgatttttccccaaaagagatggtgccggttctctgaatt

SEQ ID NO: 26539 - protein, 147 aa, Panicum virgatum
  misc_feature: Ceres CLONE 1870478
  misc_feature (1)..(107): Pfam Name: Auxin_inducible Pfam Description: Auxin responsive protein
MVSAKRLVQMAKKWQRMAALARRRITSPAKETEGSSCSTSSVAGKGHCVVYLADGRRFEVPLAYLNTAIFGELLSLSQEEFGFAGDDGRITLPCEAAVMEYVMCLLRRNASEEVEAAFLTSIARPCHYGSGLAQSIGVSQQLAVSSF

SEQ ID NO: 26540 - DNA, 714 bp, Panicum virgatum
  misc_feature: Ceres CLONE 1870486
  misc_feature: Encodes the peptide sequence at SEQ ID NO. 26541
acgagcatcagcggcatcagcaggctggcaagtggcaacacgcggcatggagcaccagctgttcgatgaccccttctcgagcagcatctcgtcgctggaggcggacatcttctccgccggcggccagctgccgtcgccgccgtggccggacctcgaactcgacctcgacctcgacgacgacgacatccacgacctctccgcgccggcggccaacgccacctcctcaggaggctatggctcgggcggaggctccggcggctcccacaggaagctcagccacaacgcgtacgagcgcgaccgccggaagcagctcaacgagctctactcctcgctccgctccctcctccccgacgctgaccacactaagaagctgagcatccccaccacggtctcccgagttctcaagtacatccccgagctgcagaagcaggtggacaacctggagaggaggaagaaggagctgacgaacgccaactgcaaaccaggagttctgaagacgagccagattgtaattcccattgtttctgctacctgcctcaacgatacggagatcatggttcaggtcagcctgcagagcaatgtggccgccacaagtcttcctctgtccaagtgcataaaagtgctggagaacgaaggccttcacctgattagttcatcaacttactccaccttcgacaacaggacattctatagcctccatcttcagagaagtca

SEQ ID NO: 26541 - protein, 222 aa, Panicum virgatum
  misc_feature: Ceres CLONE 1870486
  misc_feature (74)..(126): Pfam Name: HLH Pfam Description: Helix-loop-helix DNA-binding domain
  misc_feature: The sequence is a functional homolog of SEQ ID NO 1315 in the 10/666,642 US patent application
MEHQLFDDPFSSSISSLEADIFSAGGQLPSPPWPDLELDLDLDDDDIHDLSAPAANATSSGGYGSGGGSGGSHRKLSHNAYERDRRKQLNELYSSLRSLLPDADHTKKLSIPTTVSRVLKYIPELQKQVDNLERRKKELTNANCKPGVLKTSQIVIPIVSATCLNDTEIMVQVSLQSNVAATSLPLSKCIKVLENEGLHLISSSTYSTFDNRTFYSLHLQRS

SEQ ID NO: 26542 - DNA, 695 bp, Panicum virgatum
  misc_feature: Ceres CLONE 1870501
  misc_feature: Encodes the peptide sequence at SEQ ID NO. 26543
aaaccccccggcccaaaccctcctcgcctcctcagtccatccatccaaatcctcggggcgagcgcgcgcggagagagagggattcccacggcgatggcggcggtagctagggttttccgcgggtccaggttcctcatgttcccggcgccgggcgcggcggcggcagcgggggcgaagaaagcggcggcgccaaaggtcaccaaggccgacgcgacggcggcgaaggagaagcgcgggatcatgaagccggtgccggtctccgaggagctgagcaggttcgccggcggcgcgcccgagctcgcccgctcccaggttgtcaagctcatctgggcccacatcaaggccaacggcctccagaacccggcgaagaaaaaagagatcaactgtgatgccgcactgaaaagcttgtttggtgggagggacaaggttgggatgctggagatcccgaagctactgaaccctcacttcatgaagaactaacagaagcagcagatggcaccaacgatggagctttcgtcttaagtctttattggatggctcccagtaggtagttaagccaaagttgtgtgatgacgtcaagaattcatacttgtgttcatctgttgggtttggggcgtgatgcatgtaaaaaggattcccagtgttatcgctactcttgtgatgtgggaaatgtttgtctgctaatgacacatcgt

SEQ ID NO: 26543 - protein, 128 aa, Panicum virgatum
  misc_feature: Ceres CLONE 1870501
  misc_feature (49)..(126): Pfam Name: SWIB Pfam Description: SWIB/MDM2 domain
MAAVARVFRGSRFLMFPAPGAAAAAGAKKAAAPKVTKADATAAKEKRGIMKPVPVSEELSRFAGGAPELARSQVVKLIWAHIKANGLQNPAKKKEINCDAALKSLFGGRDKVGMLEIPKLLNPHFMKN

SEQ ID NO: 26544 - DNA, 658 bp, Panicum virgatum
  misc_feature: Ceres CLONE 1870524
  misc_feature: Encodes the peptide sequence at SEQ ID NO. 26545
cagatcgatcgagcaccccaaacttgcacacaatcaccatcagttctagtagacaagacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgagaagcgccttgggcttcaaccagcatgcactgctgcctgaagggcaaacaatctagttgtacagctaacagttgctagaccccacgcagaatcaagggaggagtgatgcatgcaagtttgatgtgcaagctgctgtaaagaggaggaagatggaggggagtaagaagcacgtttattaatctgctgctgtacaaattaaatttagcactagagtgagagaaagtaagctgttagctgtctaaaagaaaagccgaagccattggccctctggttgtatctgttgatatagtagtggcttcctgttgtttggcctttgttgtaacataagcagaggcgcactagccttcgtttacagttaagctgaattattagtacc

SEQ ID NO: 26545 - protein, 87 aa, Panicum virgatum; identical to SEQ ID NO: 18987
  misc_feature: Ceres CLONE 1870524
  misc_feature (12)..(71): Pfam Name: potato_inhibit Pfam Description: Potato inhibitor I family

SEQ ID NO: 26546 - DNA, 739 bp, Panicum virgatum
  misc_feature: Ceres CLONE 1870527
  misc_feature: Encodes the peptide sequence at SEQ ID NO. 26547
gtcgccgttggcaagcagcagcgtcgcagggaaggaaaagggggccgagggccgcgaggcgaggaggaaggggaaggaaggaaggaaggaagaagagggtcggggagcgatggggctgggcgtgcgggcggcgcccttcacgtacgtggcgcacgcgctggccatcgcggcggcggtcatggtgctggtgtgggccatccacttccgcggagggctcgccatcgaggccaccgacaagaacctcatcttcaacgttcatcctgttcttatgctgattggatatattattatcggcagtgaagctataatggtatacaaggtatttccaacgttgaaacatgacacggctaagcttatccatcttattctacatggcatcgcgcttgtccttggtgcggttggaatatactttgctttcaaaaatcacaatgaaagtgggattgccaacctttacagtctgcattcttggcttgggatcggaacgattactttgtatggtattcagtggatatttggattcgttacattcttcttccctggtgctgcaccaaacttgaggaggagcctccttccttggcacatactgtttgggctattcgtctacatcttagcactggctaatgcagaactcggctttctggagaagctcacttttctcgagagctcgggcctcgacaaatatggtaccgaggcattcttggtgaacttcacagcattggttgtcgtgctatttggtgct

SEQ ID NO: 26547 - protein, 209 aa, Panicum virgatum
  misc_feature: Ceres CLONE 1870527
  misc_feature (11)..(209): Pfam Name: Cytochrom_B561 Pfam Description: Cytochrome b561
MGLGVRAAPFTYVAHALAIAAAVMVLVWAIHFRGGLAIEATDKNLIFNVHPVLMLIGYIIIGSEAIMVYKVFPTLKHDTAKLIHLILHGIALVLGAVGIYFAFKNHNESGIANLYSLHSWLGIGTITLYGIQWIFGFVTFFFPGAAPNLRRSLLPWHILFGLFVYILALANAELGFLEKLTFLESSGLDKYGTEAFLVNFTALVVVLFG

SEQ ID NO: 26548 - DNA, 613 bp, Panicum virgatum
  misc_feature: Ceres CLONE 1870534
  misc_feature: Encodes the peptide sequence at SEQ ID NO. 26549
ataagaaaggcacaatttttggtggtttagttgaggctccattgcagccatccagttcaaagaagtatcaggggagcaataattgctttgttttcactaatttacatgaccgccctgttatatatcgtccgacaggtgcaaataactatttcaccgtgtgctccaccgactatttggctctgggaggaggaggtcattttgcactctatctagatggagaccttttgaccggttcaagttccaattcagagacttttaacaacgagtgtttatcgcattccccagacttctcagtgaaagatgttgagctgtggggcttcgtctatccttccaagtatgaggagatgctcacgctctgccggactgagaaaccaggaatttgtcgatggtgatcgtcagtcggagttcccaatcaatcaatcatagacatgctgcacatctgtacagttttcagtagactccgtgagttacgagcattttttttcttcttctttagtgcgcagagtactggacttgcttttctcaagccagtttgctcagatttgtaaataccaactttgtaatttttcatgctgtcactcggcgaaacatggacgtagcaggttattgttcc

SEQ ID NO: 26549 - protein, 129 aa, Panicum virgatum
  misc_feature: Ceres CLONE 1870534
  misc_feature (1)..(107): Pfam Name: TLD Pfam Description: TLD
  misc_feature: Functional homolog of the protein sequence given in SEQ ID NO 50650
  misc_feature: Useful for making plants with altered protein content
KKGTIFGGLVEAPLQPSSSKKYQGSNNCFVFTNLHDRPVIYRPTGANNYFTVCSTDYLALGGGGHFALYLDGDLLTGSSSNSETFNNECLSHSPDFSVKDVELWGFVYPSKYEEMLTLCRTEKPGICRW

SEQ ID NO: 26550 - DNA, 621 bp, Panicum virgatum
  misc_feature: Ceres CLONE 1870535
  misc_feature: Encodes the peptide sequence at SEQ ID NO. 26551
aaaccaaaagaagaaagccacgccgcgagatctgggagagagagagagagagagagagagagagactgagagaggcccccgcaagatgcacgacttctgcttcacgatcccctacgggttcgccgtgctggcaggcggcgtgctgggctacctccgccgcggcagcaccgcgtccctggcggggggcgccggcgccggcgcgctcctcctcctcgcggggttcgtcagcctcaaggccttcgagaagcggcgcaactcctacctcgccctcgcgctcgagaccctttgtgcattcgccttgacctacgttatgggacagagatacctagaaacttcgaagataatgccagctggtgttgttgctggtctcagcgccgtgatgtctgcattctatctattcaagattgcaactggcggcaaccacatcccaccaaagaaagagtaaaccaatgtttaacttgtaatatatgtttgattgaactcaaagatcacgaccgattgtgttgtctagttgcacggtaacttgagggactagtgatgctctccatttgtaattctgttagattgtaccatggatctctgaactttgtacaagaaataaagattaaagatgtgattcac

SEQ ID NO: 26551 - protein, 119 aa, Panicum virgatum
  misc_feature: Ceres CLONE 1870535
  misc_feature (4)..(107): Pfam Name: TMEM14 Pfam Description: Transmembrane proteins 14C
MHDFCFTIPYGFAVLAGGVLGYLRRGSTASLAGGAGAGALLLLAGFVSLKAFEKRRNSYLALALETLCAFALTYVMGQRYLETSKIMPAGVVAGLSAVMSAFYLFKIATGGNHIPPKKE

SEQ ID NO: 26552 - DNA, 747 bp, Panicum virgatum
  misc_feature: Ceres CLONE 1870564
  misc_feature: Encodes the peptide sequence at SEQ ID NO. 26553
acccaaaaaaattatcgaatcccgcctccctcgtttcgccccaacccaaaaccgagttccctccaattccacccgcctcccctccgagatggacgccggcgcaccgaaggtgaagaaggcggcggcgggccgcaagcttggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcaccttgcttttgtgtgtatgtagttccgcatctcaatgtatcgtgtcctccgagcttcggatcctatgtcgtaggtctaggctttagctgtagtggttggtgatgggggatatgtatgttttccaaatttaatgaggaggtgggagcggttttgctttccttt

SEQ ID NO: 26553 - protein, 151 aa, Panicum virgatum; identical to SEQ ID NO: 11988
  misc_feature: Ceres CLONE 1870564
  misc_feature (27)..(100): Pfam Name: Histone Pfam Description: Core histone H2A/H2B/H3/H4

SEQ ID NO: 26554 - DNA, 729 bp, Panicum virgatum
  misc_feature: Ceres CLONE 1870578
  misc_feature: Encodes the peptide sequence at SEQ ID NO. 26555
ttccacttctcccctgctcaatctcagctcccctgcctgcgaagcatcccccatctctccccaatctctccgatcgcgcgagctcgcacgcaagcccgggcacctcatccccacgccaaaccctaaccctaacccgaaccgacccagggtcccgggccgcggcggcgggagggcatggccgacacggcgcgcgacggcggggacgccttcgcggacgaggcggagcccacggtcaccatcgacgagtacatcgagggcatcgaggccgaggagctggaggcggatttggtgctgggcggcgacgacggcaaggagtgcacctacgccggcgggtacctcaagcgccaggctgtcttctcctgcctcacctgcgtgccggatggagtcgccggggtgtgcaccgcctgcagcctcgcctgccacgatggacatgaggtgagtctgctcactcttcccattcattttccttcctaaacagcattagctctccattgttgcgagggggaacaaggcaagtaaatgaagattatcaactgttctgcccactagtatcaactgaatgtttattccagcagcacaatgtacccgctagtttcttcaaagatatgtttttattttttaattgaacacacaagacagctgcacgtcactgtattagagaaagcgtaagaaatgccggtccgtttacaaagccgacatgagcaaagtaaaccaaaggaaagaagatag

SEQ ID NO: 26555 - protein, 99 aa, Panicum virgatum
  misc_feature: Ceres CLONE 1870578
  misc_feature (46)..(97): Pfam Name: zf-UBR Pfam Description: Putative zinc finger in N-recognin (UBR box)
MADTARDGGDAFADEAEPTVTIDEYIEGIEAEELEADLVLGGDDGKECTYAGGYLKRQAVFSCLTCVPDGVAGVCTACSLACHDGHEVSLLTLPIHFPS

SEQ ID NO: 26556 - DNA, 662 bp, Panicum virgatum
  misc_feature: Ceres CLONE 1870599
  misc_feature: Encodes the peptide sequence at SEQ ID NO. 26557
gacacccgcgcctctgacgcctccctcccagcctccctccacctctgacgcctccctccctccaccctctcctccaggcaacctcagcgcctcagccgcttgcgctcgcccgctccgggcctccggagctccctgcctccctccatcctcccttcatctccgcgcatccgcgggccggggctccgccccctccagccggcggagctgcagatccggccgacagagctgcagatctgggcatccggccggctcttcggccgatctggcccgggttagtgcggccggcgcgacggaagccagcgggcacggcggcggcaagcgaggcgagccagcgggcgcggttgtggggcaggcgcagaagcgcagcatggcgaagctcaagccaaaggcgttgctggcacaaagcaaagtgaagaaggtccctagccaaatcagtgtgatcacgatcttcacctacttggtcctcggtgtcgtagtcgtgtcctctgtttatgctgtttacaaatactgggtaggcaaaggaccagcagtgacagcagcaggcgtggaggggaactaaacccccaaactatgtaactgattttgttgttgtatcatccagttggataattttggttgctgcagcccagttaacggaatatggatagattgtatcttgctac

SEQ ID NO: 26557 - protein, 63 aa, Panicum virgatum
  misc_feature: Ceres CLONE 1870599
  misc_feature: SWISSPROT Homolog: EC 5.2.1.8 Peptidylprolyl isomerase
MAKLKPKALLAQSKVKKVPSQISVITIFTYLVLGVVVVSSVYAVYKYWVGKGPAVTAAGVEGN

SEQ ID NO: 26558 - DNA, 706 bp, Panicum virgatum
  misc_feature: Ceres CLONE 1870620
  misc_feature: Encodes the peptide sequence at SEQ ID NO. 26559
cggctccgtcgccgtgcagatgctcacgctgctgtgctcgcgtgccgtcgccctcccactcgctccgcctccacgcttccttcaccgcctgccgcacccgcgcgcctcctcctcctcttcctcgctcccgccgccgccgccgtcggggatggagacctcctacaagttcggcccctacaagatcgacgccagggaggtcttccacgccacgcccctctcctacgccatggtcaacctccgccccctgctccccggtcatgttcttgtgtgccccaagcgtgaagtgaaaagatttgctgatctaagttctgatgaaacaattgacttatgggttactgcaaaggaagttggtgcacgtcttgagcagtaccataaagcaacttcacttacctttgctattcaggatggtcctcaagctggccaaacagtcccacatgtccacattcacgtcatcccaaggaagaaaggggattttgagaaaaatgatgaaatatatgatgcgattgatgtgaaagagaaagaattgaaggagaagcttgacctggacattgagaggaaagatagaagcatggaagaaatggctcttgaggccaatgagtaccatgctcttttctcctagaattgcatctagtatagttagtttctaagttgagctgactgcttgccacaaataagtctatgggctggtccctataagatggggagt

SEQ ID NO: 26559 - protein, 156 aa, Panicum virgatum
  misc_feature: Ceres CLONE 1870620
  misc_feature (14)..(107): Pfam Name: HIT Pfam Description: HIT domain
  misc_feature: SWISSPROT Homolog: EC 3.6.1.29 Bis(5'-adenosyl)-triphosphatase
  misc_feature: Functional homolog of the protein sequence given in SEQ ID NO 51219
  misc_feature: Useful for making plants with modulated heat sensitivity
METSYKFGPYKIDAREVFHATPLSYAMVNLRPLLPGHVLVCPKREVKRFADLSSDETIDLWVTAKEVGARLEQYHKATSLTFAIQDGPQAGQTVPHVHIHVIPRKKGDFEKNDEIYDAIDVKEKELKEKLDLDIERKDRSMEEMALEANEYHALFS

SEQ ID NO: 26560 - DNA, 668 bp, Panicum virgatum
  misc_feature: Ceres CLONE 1870633
  misc_feature: Encodes the peptide sequence at SEQ ID NO. 26561
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaaggagaagaagcacggcgagggccaccacgacggccacagcagcagcagcgacagcgactgatcgcctcgcggcgcgccgtgcttgccggtgaaaaaggtgcttggagaggactatctaccggaagctgtgtgatgtaatatgtttcacgagtgccatacgtgtgtgtgctaatcaagggagaaatgaaaaaaaaaaaccttttatgttgatcaatgtactcctaatgatggctccacggtgctagcttgtaataaaatgttaatgcagaaattggtctgctggcttgtctttgacatgtattcacgggcatcatgcatactagtatttctttgctgtattgttt

SEQ ID NO: 26561 - protein, 102 aa, Panicum virgatum
  misc_feature: Ceres CLONE 1870633
  misc_feature (2)..(92): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKDKKKKKKEKKHGEGHHDGHSSSSDSD

SEQ ID NO: 26562 - DNA, 685 bp, Panicum virgatum
  misc_feature: Ceres CLONE 1870663
  misc_feature: Encodes the peptide sequence at SEQ ID NO. 26563
acctgctgccaatcaaccaagaagcacgcgcagccacaccaagtcagggagaaggccatggccggcgtgaactcaaccagcgtcgtcgggctcaagcccgccgcggcggtgccgcacgccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaaggttctcagcacatcagtcacacggcactgtcttaaccggaaggcctgaatttttggtttctgatcttgccgtgtctctgcacctgtgttcctgcagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaa

SEQ ID NO: 26563 - protein, 136 aa, Panicum virgatum
  misc_feature: Ceres CLONE 1870663
  misc_feature (9)..(130): Pfam Name: PsaN Pfam Description: Photosystem I reaction centre subunit N (PSAN or PSI-N)
MAGVNSTSVVGLKPAAAVPHAATSSPAAKRVQVAPKDRAAEGRRAALLGLAAVFAVTATTGSAKAGIIDEYLEKSKANKELNDKKRLATSGANFSRAYTVEFGSCQFPYNFTGCQDLAKQKVLSTSVTRHCLNRKA

SEQ ID NO: 26564 - DNA, 754 bp, Panicum virgatum
  misc_feature: Ceres CLONE 1870704
  misc_feature: Encodes the peptide sequence at SEQ ID NO. 26565
gcaagttcctctcgtctctcgccttcgcaaattccttggtctggtcctcgtcccgccgccgccgcccagcagcagccgttgccggagaagaaggggagggagccatgggtcgcgtccggaccaagactgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacaaggagacaatggagatgctcgcttccctcggcatggccgacctccccggcgtcgagcgccaggctgaggtctccaacgcccccacctacggtcgcccgcagtacggtggcccccgccgcgaccgcgtctaggcttctagccggttccagtggttggatcttgatcgcttcacttatcgtcgttattaattattatgctactatgtcaaacttattttaggtcattgttgctttgtggcgattgagtcttaacctctctgttttgctctaaattctgcactcttttgatctgcgtgtgatgtacaggatctatattctcgcgcgaatggaatcatatgcgatttataagttag

SEQ ID NO: 26565 - protein, 142 aa, Panicum virgatum
  misc_feature: Ceres CLONE 1870704
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLASLGMADLPGVERQAEVSNAPTYGRPQYGGPRRDRV

SEQ ID NO: 26566 - DNA, 714 bp, Panicum virgatum
  misc_feature: Ceres CLONE 1870716
  misc_feature: Encodes the peptide sequence at SEQ ID NO. 26567
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaaggagaagaagcacggcgagggccaccacgacggccacagcagcagcagcgacagcgactgatcgcctcgcggcgcgccgtgcttgccggtaaatatccattaattacccgcggtcagatccttgctaatgaataattaaaaaattgtttgcctttataatttcctttttgtgatctttttcgcgtgcatacaggtgaaaaaggtgcttggagaggactatctaccggaagctgtgtgatgtaatatgtttcacgagtgccatacgtgtgtgtgctaatcaagggagaaatgaaaaaaaaaccttttatgttgatcaatgtactcctaatgatggctccacggtgctagcttgtaataaaatgttaatgcagaaattggtctgctggcttg

SEQ ID NO: 26567 - protein, 102 aa, Panicum virgatum; identical to SEQ ID NO: 26561
  misc_feature: Ceres CLONE 1870716
  misc_feature (2)..(92): Pfam Name: Dehydrin Pfam Description: Dehydrin

SEQ ID NO: 26568 - DNA, 502 bp, Panicum virgatum
  misc_feature: Ceres CLONE 1870727
  misc_feature: Encodes the peptide sequence at SEQ ID NO. 26569
actgctgggtgaggatttcactccgaacctttctgactttggacttgcaaaactcggaccagttggtgacagaactcatgtctccacaagactaatggatacctatggctactgagctccagactatgttgtgagtggtaaacttaccatgaaatcagacatctacccttttggtgttcttctattgcaactgataactggcaggaggatttatgatgcgtcaaggcctaaaccagaccaaagtttgctaacatggccaaggccatttctgcatgacaaaagtaatttctcccgacttgcttatccggctctgctgggctgctacccgtcatcctttctgaaccacctacttgtgatcagcataatgtgtctccagcaccaggaccatgtccacccttatcatcgctgatgtctgtgataggcctgaaccatgttgcatgccagccatatgcgcctgagcgcccgccagtaactataagctcccctgcgaacagtgggtcac

SEQ ID NO: 26569 - protein, 37 aa, Panicum virgatum
  misc_feature: Ceres CLONE 1870727
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
LLGEDFTPNLSDFGLAKLGPVGDRTHVSTRLMDTYGY

SEQ ID NO: 26570 - DNA, 681 bp, Panicum virgatum
  misc_feature: Ceres CLONE 1870750
  misc_feature: Encodes the peptide sequence at SEQ ID NO. 26571
ggctgcacccacctgttccgctcctcgtccctcacctctccatggcggactgtgtagtcgacggctacacaatcccctccggcactagagtcatcgttaacacatgggctatcagcagggatccagagttatgggaggagccagaggagttcatgccggagaggttcatggacggcgggagcgctgcggccatcgactttaaaggcaacgactttgagtttgtgccatttggggctggaaggaggatctgtcctggcctcaactttggtttggctactgttgagatcatgctggcaaacctcgtgtattgttttgactggcagctgccagacggcatagaggccaaggatattgatttgacagaggtgtttggattgtcagtccgtccaaaggagaagctcatgctatttccaaaaccacgtggtcatcactccatgcaaattactgaggctggtcactgagttgtctatcacaccccatcgatcgattacacatgcatatatatcctgtatagcagctatatatattatatatacaataatgctgccttaactagctattattgtaggtacaatcacaattaatgcatacatcctattcaccttatacatctggtcaggttgtatagctcaatagtgcatatatgcatggtataaacaataattcgatctggattatatt

SEQ ID NO: 26571 - protein, 152 aa, Panicum virgatum
  misc_feature: Ceres CLONE 1870750
  misc_feature: SWISSPROT Homolog: EC 1.14.13.21 Flavonoid 3'-monooxygenase
  misc_feature: Functional homolog of the protein sequence given in SEQ ID NO 50304
  misc_feature: Useful for making plants with altered carbohydrate content
  misc_feature: Functional homolog of the protein sequence given in SEQ ID NO 50691
  misc_feature: Useful for making plants with modulated drought sensitivity
LHPPVPLLVPHLSMADCVVDGYTIPSGTRVIVNTWAISRDPELWEEPEEFMPERFMDGGSAAAIDFKGNDFEFVPFGAGRRICPGLNFGLATVEIMLANLVYCFDWQLPDGIEAKDIDLTEVFGLSVRPKEKLMLFPKPRGHHSMQITEAGH

SEQ ID NO: 26572 - DNA, 967 bp, Panicum virgatum
  misc_feature: Ceres CLONE 1870754
  misc_feature: Encodes the peptide sequence at SEQ ID NO. 26573
aacaaaactcgcggacaggaacagaggggatcttcctcttccccaagcaatcctatcggatctcgatccacccagctatctcacgtcgtcggcgatgtgccgacggccacgggcgtgacagcggtgctgccccaggtcccggatcccccctcccacaccttccgcctcgcagatccggcggcggcgagagctcaagtttgtaatgtctgggatggcatctgatgatgcaactgctcaagagagggttgaaggagatgttgcagataaaaaagtagaagaagttcaggaccagaatgaagttggtgggatgccctcacgacaggaggaggaggcagtaattaagaaaaagtatggaggaatattacccagaaagactcctcttatatctaaggaccatgaacgtgcttactttgattctgctgattgggctctaggaaagcaaggtggtgttcccaacaagcctaaaggccctcttgaagcacttcgaccaaagcttcagcctactcaacagaatgcgcgtgcccgtcgaacttcttatgcatctgcggacagtgatgagactttgaacttgtctgctgaggatctgggccagcaaggagaacctgttgaggacaagaacaaggaataagtacgcctggtggctctaagccttttatacggaagatgccatttgctgtgctcatgctaagacccttgccttgataataagtaacgcggatttgtatactaaacactggtgagtttgacatgtgcagttcgagctggatgtgaggtgtggtacatgtaatatccgcggctaccctcagctgttcagcctttcggatgcctgtaacagctaggaatgagtccgcgaggatggtgacaatgtttacagtgctggatatgcacgcaaacacatgcaaatccaatggttgaaactccctttgaactgtagttactacctataataaagaagattgttctgatg

SEQ ID NO: 26573 - protein, 141 aa, Panicum virgatum
  misc_feature: Ceres CLONE 1870754
  misc_feature (47)..(140): Pfam Name: Lg106 Pfam Description: Lg106-like protein
  misc_feature: Functional homolog of the protein sequence given in SEQ ID NO 50181
  misc_feature: Useful for biocontainment applications
MSGMASDDATAQERVEGDVADKKVEEVQDQNEVGGMPSRQEEEAVIKKKYGGILPRKTPLISKDHERAYFDSADWALGKQGGVPNKPKGPLEALRPKLQPTQQNARARRTSYASADSDETLNLSAEDLGQQGEPVEDKNKE

SEQ ID NO: 26574 - DNA, 726 bp, Panicum virgatum
  misc_feature: Ceres CLONE 1870768
  misc_feature: Encodes the peptide sequence at SEQ ID NO. 26575
caagtacaggtggtccacctccaagtccgagagcggcgtgcagttcggccccttcgcgctgccgctcaacggcctgcccatgaccttcacccgcagggactgagccgggccgacgcacggaccaggccaaaaccgacggagatccgaaaccggaccggatggtggtattggtagtggtatatactcctacttgcactaagcaatacctaggcacggcacgcggaaaccgctgccggaattgggcgtcggccgcgggcgccggtcgccatcggacgggacggccatcggatcaggcatgggatcgcagaaagatcacgcaagataacccgtgtacagattcttcctcagctctctgcctctctctcagctggtaggaccggaccccaacaagccggaagaggagaccagacacaaagattagttgtagccgcgtaggtgtcagtcagtcagtgttaagctaagctaagctgctccagtaggcatcagacgccacaaagaagtggcgctgaactgtaaaaccaaactcattttgatcttcttcttattttcccccccttataatttttttaaagccagccagacagcaccctatagcagaaggacaagcgaacaaaaaagaaaggagaagagaggaggcccctgattgggattgtaagcaaagctaggttgtccgcctgaaagcaggctggcagctaggccgaataatccatggacggatggatggat

SEQ ID NO: 26575 - protein, 33 aa, Panicum virgatum
  misc_feature: Ceres CLONE 1870768
  misc_feature: SWISSPROT Homolog: EC 1.14.13.93 (+)-abscisic acid 8'-hydroxylase
KYRWSTSKSESGVQFGPFALPLNGLPMTFTRRD

SEQ ID NO: 26576 - DNA, 284 bp, Panicum virgatum
  misc_feature: Ceres CLONE 1870838
  misc_feature: Encodes the peptide sequence at SEQ ID NO. 26577
tatcaccaggctgggccttatctctttgcccgctatccgtcctgacatatacgaataagccggccaggggcggaagcgtcccacggatgcgcagggcttctgatgctccccggcgctcgccttcctgctgcccccgtggggcgtgttcctccggcctcggcgccggctcctgtccttgatccaccaactactatcactgctgtgctgcatctagctcatcatctcccccacttcctccttctgctgctatcgacgctggtagcggagcatatctacggcctgct

SEQ ID NO: 26577 - protein, 60 aa, Panicum virgatum
  misc_feature: Ceres CLONE 1870838
  misc_feature: Functional homolog of the protein sequence given in SEQ ID NO 50208
  misc_feature: Useful for making plants with altered carbohydrate content
MLPGARLPAAPVGRVPPASAPAPVLDPPTTITAVLHLAHHLPHFLLLLLSTLVAEHIYGL

SEQ ID NO: 26578 - DNA, 699 bp, Panicum virgatum
  misc_feature: Ceres CLONE 1870844
  misc_feature: Encodes the peptide sequence at SEQ ID NO. 26579
cttgtcgttggccgttgctagcactccgcccaccctgctctccgccatggccgcacgccccgtgaccgcgagcagctcacgccgccctcctctcccagctcaggctgctgctgctgctgctgcttcctcttcccccgcggttcgtggagtcagatcgggggagcgctcgctccttcggccgtgcccgatgctgctgacgtctgtggcagtggggagtttggttgccgctggggccgctaatgctgccgagctattggatcctctgcacggatcatcagaacttcttttggccgatcttggcattggagattggtttgggggtttgctgttttctgctggacagcaggctaatgaggctgttcaggatcagctatctgctcttagtttctctagcttggcagtcattttcggtgctggacttgtaacaagtttgtctccatgtacactcagcgttctgccattgaccctgggatatataggtgcatttggctctggaaaaggccgaaccgaggttatcggaaattcaatagcattttcattaggactggcaacaaccttagctattcttggtgttgctgcttcgtttgctggaaaggcttatggtcaggttggacaaggactcccagtggctgcttctgggttggccatcatcatgggactgaaccttctggaggtactcgagttgcaacttccctcctt

SEQ ID NO: 26579 - protein, 217 aa, Panicum virgatum
  misc_feature: Ceres CLONE 1870844
  misc_feature: SWISSPROT Homolog: EC 1.8.1.8 Protein-disulfide reductase
MAARPVTASSSRRPPLPAQAAAAAAASSSPAVRGVRSGERSLLRPCPMLLTSVAVGSLVAAGAANAAELLDPLHGSSELLLADLGIGDWFGGLLFSAGQQANEAVQDQLSALSFSSLAVIFGAGLVTSLSPCTLSVLPLTLGYIGAFGSGKGRTEVIGNSIAFSLGLATTLAILGVAASFAGKAYGQVGQGLPVAASGLAIIMGLNLLEVLELQLPS

SEQ ID NO: 26580 - DNA, 641 bp, Panicum virgatum
  misc_feature: Ceres CLONE 1870862
  misc_feature: Encodes the peptide sequence at SEQ ID NO. 26581
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgc

SEQ ID NO: 26581 - protein, 126 aa, Panicum virgatum
  misc_feature: Ceres CLONE 1870862
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 22 in US patent 7244875
MAAADVEYRCFVGGLAWATDNASLQQAFASYGDVLDSKVITDRETGRSRGFGFVTFSSEQSMLDAIEAMNGKDLDGRNITVNQAQSRGGGRREGGYGGGGGGGRREGGYGGGGYGSRGDSGGNWRN

SEQ ID NO: 26582 - DNA, 648 bp, Panicum virgatum
  misc_feature: Ceres CLONE 1870896
  misc_feature: Encodes the peptide sequence at SEQ ID NO. 26583
gcagatcgatcgagcacacgatcggcactactcatcatcacaaacttgcacactcggcgagctcgagtaattcattccacaaacactctccatcgatcgatctctttaattgttgactctgacatctgtgcgcgcagatcgatcgacatcgacgacgatatgagctccgtggacgccaccggcggcgagaagaagacgtcgtggccggaggtggtgggcctgccggcggaggaggccaagaagatcatcctcaaggacatgcccgacgccgacgtcgtcgtcctgccggccggctcgccggtgaccatggactggaggtccaaccgcgtccgcgtcttcgtcgacaccgtcgctcggaccccgacggtgggctgaaccaacgataaaccgcctcctgctggatcaaagccgctgctagctcacccttgattttcctgaatgtcttcaccataaaagggaagacctagagatcgaagcacaaataatggagctaggtagcggctatctgatataaaatttatggaatgcatgaataaataatgttccctgctcctcaataaagaaatgaattatgagcatgcagcttaactttggccaaaagataaaagataacagagaataaaactgatctgatcatatatatggact

SEQ ID NO: 26583 - protein, 71 aa, Panicum virgatum
  misc_feature: Ceres CLONE 1870896
  misc_feature (12)..(71): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVARTPTVG

SEQ ID NO: 26584 - DNA, 718 bp, Panicum virgatum
  misc_feature: Ceres CLONE 1870906
  misc_feature: Encodes the peptide sequence at SEQ ID NO. 26585
ctctctctaaaccctacccgccgccgccgccgccgctgaggtcagaccgaccagcttcaaccatggcggacgtcgatgtcgagcccgaggtcgccgccggcgcgcccaagaagaggacgttccgcaagtacagctaccgcggcgtcgacctcgacgcgctgctcgacatgtccaccgacgacctcgtccagctcttccccgcgcgcgcgaggagaaggttccagaggggtctgaagaggaagcccatggcgctcatcaagaagctgcgcaaggcgaaaaaggatgctcctgccggcgagaagccagagccagtgaggacccatctccgcaacatgatcattgtccctgagatgattggaagcatcattggtgtctacaacggcaagacattcaaccaggttgagatcaagcctgagatgattggccactacctcgctgagttctccatctcctacaagccggtcaagcatggtaggcccggtatcggtgccactcactcctcacggttcattccgctgaaatgagttattagcccagttatcagcctccagaatccagcacggaaggcgcatggcatgtcttgtttccttccagttgtgctgcttgttttgaacaagttacataccaatggtgttttgctctgttccagctctagaatcctagctaagcactgcacgatgtatgctgttttgagttaatcttatctatacggcgatgt

SEQ ID NO: 26585 - protein, 153 aa, Panicum virgatum; identical to SEQ ID NO: 12318
  misc_feature: Ceres CLONE 1870906
  misc_feature (55)..(136): Pfam Name: Ribosomal_S19 Pfam Description: Ribosomal protein S19

SEQ ID NO: 26586 - DNA, 655 bp, Panicum virgatum
  misc_feature: Ceres CLONE 1870938
  misc_feature: Encodes the peptide sequence at SEQ ID NO. 26587
cacctcgctgagattggacgtggattccgggaccttggcttcaagattatcgccacatctggaacagccaaagtgctccagctcgagggcatcccggtggagccagttctgaaaatacatgaggggcgaccaaacgccagagatatgctgaagaatgatcagattcaggtgatggtgataacaagctctggtgacgcactagactcaaaggatggcctccaactccgcaggctagcccttgcctacaagatcccaataatcacaactgtggatggggcgcgagcaaccatggatgctatcaagagcctgaagaacaagtcgatcgagaccctcgccttgcaagattacttccagactgctgatgcgcccgacttgcaagcagcggcacaaaccactccttagaggcatgtcccctaattcatgtaatgtgagcctagtgcgaactaaaacacatcccttgcgatattatgtttacttgttagcatccgtgcacctgcagcatgcataattgctagaaggtggggatgattagctgagtgccagttaccattttttgagaacacttgaatttagcatgaattgcaacatatggattaatagggaagcaggatgctggttgcaaagtgcacagtttctgtttaatgaaacttggaca

SEQ ID NO: 26587 - protein, 133 aa, Panicum virgatum
  misc_feature: Ceres CLONE 1870938
  misc_feature (1)..(88): Pfam Name: MGS Pfam Description: MGS-like domain
  misc_feature: SWISSPROT Homolog: EC 6.3.5.5 Carbamoyl-phosphate synthase (glutamine-hydrolyzing)
HLAEIGRGFRDLGFKIIATSGTAKVLQLEGIPVEPVLKIHEGRPNARDMLKNDQIQVMVITSSGDALDSKDGLQLRRLALAYKIPIITTVDGARATMDAIKSLKNKSIETLALQDYFQTADAPDLQAAAQTTP

SEQ ID NO: 26588 - DNA, 614 bp, Panicum virgatum
  misc_feature: Ceres CLONE 1870953
  misc_feature: Encodes the peptide sequence at SEQ ID NO. 26589
acggcgtggggagagacgagaagaagcctcaaggaagaggaagctgaaggcgagcgagtggggagggaagaagatgaaggtccgcgcgtcggtgaagcggctgtgcgggttctgcaaggtggtgaagcgccggggcatcgtcttcatcccctgcaccgccaaccccaagcacaagcagcgccagggcttctccaccctcgccgaagccgccgcatcatgcacccccctgcccccgcccccgccaccgcatgccagcagcaccgcagccgccgcagcgttcgcggatgcttccaaggtagctagacaagagatgtttacaaaattcaattggcctctgggtttagctgccctgctcaagaatggcgaaaaataatgtgtctgctctactatacgctgacgattcagaaacagatttggcactttgatatcaagtgaaagtttgtagccaaaacttgaagatgtatcatcatgatgtattttgcagtcactactagtcagttgagttggtcctgtggtgaaataatatcagcacatattgttacgcgcctcaatatgtttgcttgttcgaacaaaatttattacacatttgaagaaagctgacatacttgactgcc

SEQ ID NO: 26589 - protein, 99 aa, Panicum virgatum
  misc_feature: Ceres CLONE 1870953
  misc_feature (1)..(38): Pfam Name: Ribosomal_L36 Pfam Description: Ribosomal protein L36
MKVRASVKRLCGFCKVVKRRGIVFIPCTANPKHKQRQGFSTLAEAAASCTPLPPPPPPHASSTAAAAAFADASKVARQEMFTKFNWPLGLAALLKNGEK

SEQ ID NO: 26590 - DNA, 672 bp, Panicum virgatum
  misc_feature: Ceres CLONE 1870955
  misc_feature: Encodes the peptide sequence at SEQ ID NO. 26591
aggggccagaaaagcctttgaaacccgtcttactgctcgtctctctcgcctgcctccttgtttcccaaggccgccctgcagcgtctccaatggcgtacaaggtgaaagggttgttcaaggtcatctcccggatcttcgtggtgaaggagcacgagacggagatcggttatccgacggacgtgaagcacgtcgcgcacatcggctgggatagcgcggcggggaatgcctctccaagctggatgaacgacatcatgacatcccccaacttctcgtccttgggcaactttgctgcgtccacagggacctcctgggtttctcaaggggcggtttcagagaccaccggccggcgggaatcggctacttgtcccgacgttccaaggccgctcgggaagacgagggggaagaagccggaggacggatcgccaaccgcgccgtcgacgtccacggacgagctggcgtcaccgccgccagcggccgctgaggccgaggctgccgatggcgctgctgcagatggcacgcgatgatccaaactgtgttccggtcttttcttattgtcgtgtaggcaatggcaacgattgtatgtctcgactttgtttcaactttgagattggattgcagatgataaaaaatggaacgaatgcaacgaaatagaatgcgacgatctgtttgttc

SEQ ID NO: 26591 - protein, 144 aa, Panicum virgatum
  misc_feature: Ceres CLONE 1870955
  misc_feature (24)..(137): Pfam Name: PBD Pfam Description: P21-Rho-binding domain
MAYKVKGLFKVISRIFVVKEHETEIGYPTDVKHVAHIGWDSAAGNASPSWMNDIMTSPNFSSLGNFAASTGTSWVSQGAVSETTGRRESATCPDVPRPLGKTRGKKPEDGSPTAPSTSTDELASPPPAAAEAEAADGAAADGTR

SEQ ID NO: 26592 - DNA, 713 bp, Panicum virgatum
  misc_feature: Ceres CLONE 1870961
  misc_feature: Encodes the peptide sequence at SEQ ID NO. 26593
atccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatgtcgacgagcgtcggcggcggccgcgcgctgccgtcgctgcaggccggccggccggcgccgtacccgcggctcgcgctgccgtcggcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcgtcgacgacgccactggcctcgacaaggccgtcaaccctggcaccggcaagttcatcatcggcgaggacgagaagtagagagagaccgagggaaatgatgcgcctggttgtttgtgggtgatcgatcagt

SEQ ID NO: 26593 - protein, 177 aa, Panicum virgatum
  misc_feature: Ceres CLONE 1870961
  misc_feature (62)..(175): Pfam Name: Chloroa_b-bind Pfam Description: Chlorophyll A-B binding protein
  misc_feature: Functional homolog of the protein sequence given in SEQ ID NO 50302
  misc_feature: Useful for making plants with modulated light quality response
  misc_feature: Useful for making plants with modulated nitrogen use efficiency
MAQSMLMSTSVGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLLGAIGALGDRGTFVDDATGLDKAVNPGTGKFIIGEDEK

SEQ ID NO: 26594 - DNA, 542 bp, Panicum virgatum
  misc_feature: Ceres CLONE 1870988
  misc_feature: Encodes the peptide sequence at SEQ ID NO. 26595
atcatacacgaagaccgactgaaaaccgaacctgccgctcctgcaatggaggactccatgatctcgccgtctgctctggcggcaccggcctagcgcccagggcctgccgcccctcggccgccgcgcgtcctccttcgccgtcctctgcggcaccgcaaagaacatcaagaccgactagcccttcgggataggacctggcctccccgtctaccactatgcctccgggaggaaggtcaagggccagggcatgtaccaattcttcgacaagcaccgcgcctacctcaacggatacagcccaatctaccaagaggaagactggtctcccaccggcgacgtctacatctgcggaaccactggacttctgatctggcccgcctccctcgccgggttccttggccgcggcgccctccttgtttacaacaccagcgccctcgccagctaagaacactattcatgcatagtccatgcaagcgcttgtggttcatgtaagatcagatcgggtgtctgtcggctgtaatctagcctgaagctttgacgcgcta

SEQ ID NO: 26595 - protein, 64 aa, Panicum virgatum
  misc_feature: Ceres CLONE 1870988
  misc_feature (1)..(64): Pfam Name: PsbR Pfam Description: Photosystem II 10 kDa polypeptide PsbR
MYQFFDKHRAYLNGYSPIYQEEDWSPTGDVYICGTTGLLIWPASLAGFLGRGALLVYNTSALAS

SEQ ID NO: 26596 - DNA, 907 bp, Panicum virgatum
  misc_feature: Ceres CLONE 1871005
  misc_feature: Encodes the peptide sequence at SEQ ID NO. 26597
agcacccgctgtgcagtgcgcaagtgcgcttcatcgtcctctcccccctgccgtgcacccgctttccccaccaccaattcgggaaccctactccgccgccgccgccgccgccgccgccgccgccatgagccgccaacctgaggttctgtgggctcagcgctctgagaagatttacttgactatctcattgccagatacaaaagatgttgagctgaagactgaacctaaaggcctctttactttctcagctgttgcccatggggaaccttttagcttcactttggagctctttgattccatactgccagagggaagtaaaacaaagacaaagatgggcttgcgaaacataatctgttcaatccaaaaggaaaagaaaggttggtggaagcgcttgctgaagtcagaggaaaagcatccatacatcaaagttgactggaacaaatggtgtgatgaggatgaagagtctgaagcctcgggggattctgatgatgactttgatggggccaatgaaggagatgaaagtgatgatgatgacgggatgctttatctccctgaccttgaaaagttaaggggcaagtgacttggctgctcaggtgagggaagtaggtctgctgtaacagattatcattgacgtgacagataggctctccattaacgtagttgctgttacctgcaaagcatctgcgatggcaccagagttttgtcatgatctttgcttggcgtgtcttttatctccggggtgtctttcctgaccagtgagcttgtgctctgaatgtagctatgagctgtgtagttttcgactaactcttagcgccagtcgatgacctaattctactatcacaatgcatctagatcttttggaatcatgatatcttggtaaggattatcatttgctggcagggtgatt

SEQ ID NO: 26597 - protein, 151 aa, Panicum virgatum
  misc_feature: Ceres CLONE 1871005
  misc_feature (5)..(81): Pfam Name: CS Pfam Description: CS domain
  misc_feature: SWISSPROT Homolog: EC 5.3.99.3 Prostaglandin-E synthase
MSRQPEVLWAQRSEKIYLTISLPDTKDVELKTEPKGLFTFSAVAHGEPFSFTLELFDSILPEGSKTKTKMGLRNIICSIQKEKKGWWKRLLKSEEKHPYIKVDWNKWCDEDEESEASGDSDDDFDGANEGDESDDDDGMLYLPDLEKLRGK

SEQ ID NO: 26598 - DNA, 627 bp, Panicum virgatum
  misc_feature: Ceres CLONE 1871014
  misc_feature: Encodes the peptide sequence at SEQ ID NO. 26599
actacctgggcaacccgagcctggtgcacgcgcagagcatcctggccatctgggcgtgccaggtggtgctcatgggcgccgtcgaggggtaccgcgtcgccggcggcccgctcggggaggtggtggacccgctgtacccggggggcagcttcgacccgctggggctcgccgacgacccggaggccttcgcggagctcaaggtgaaggagatcaagaacggccgcctcgccatgttctccatgttcggcttcttcgtgcaggccatcgtcaccggcaaagggccgctggagaacctcgccgaccacctcgccgaccccgtcaacaacaacgcctgggcctacgccaccaacttcgtccccggcaagtgagcgagctcgatcgctatgtgaagctagcgacccgggggatcgcgcgtgtaccgtagacgtacgtattcgtatgtactgctacatactgcagggtgtacgagtatctgtgaaggggacctgggatcgcacagtttggtgtacaagtagtagtgtatttgtacgcatgcatgcgctggaccggatcaatgaaatacgcgcaccgcgttgtaaatttgtagcaaaataatttataataaagtgtaatatctaaatctgtatc

SEQ ID NO: 26599 - protein, 121 aa, Panicum virgatum
  misc_feature: Ceres CLONE 1871014
  misc_feature (1)..(88): Pfam Name: Chloroa_b-bind Pfam Description: Chlorophyll A-B binding protein
YLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 26600 - DNA, 827 bp, Panicum virgatum
  misc_feature: Ceres CLONE 1871030
  misc_feature: Encodes the peptide sequence at SEQ ID NO. 26601
aatagcacaacccgcgattagcccgcgacctccgcaaaagcagcgcgccattttggatccagggagctagagtgcggactgttcccgagatttctttctcccccaccgcacccccgcctcctcgcgccgcagcggacgagaccatgtgtcccacgggcaggtacctgggcctcgacctctccgccgccgcgggcgtcggcggcgacctgaggccggcgttcgacgtgctggacgcggaccgggacggccgcatcagccgggaggacctcaagaccttctacgccaccgccggggggcggttcgacgacgacgacctcgcggccatgatcgcggccgcggacgccgaccgcgacggcttcgtgcagtacgacgagttcgagcgcctgctggccgcccgcgcggggggcgccgcggggcggtccgcgatggaggacgcgttccggctcatggaccgggacggggacggcaaggtcgggttcgaggacctcaaggcgtacctcgcgtgggccgggatgcccgcggcggacgaggaggtgcgcgccatgatccgtgtcgccggcggaggggacggcgacgaaggcgtggggatcgaggcgctcgccagagtgctcttggtcgacttggaaggcatcgctctctgaaaactctcaactgcttgcagaggcagagcattgtgcgttgttttttttttgcgaatctcttccttggtttggttggtgacaccgagagatgggatgtgatttgtctgtggttggttcacgcggaccttgaggcgtgcgtgtattgtatacctgcccccctgatgagaatattgaaaagattgcctc

SEQ ID NO: 26601 - protein, 165 aa, Panicum virgatum
  misc_feature: Ceres CLONE 1871030
  misc_feature (94)..(122): Pfam Name: efhand Pfam Description: EF hand
  misc_feature (57)..(85): Pfam Name: efhand Pfam Description: EF hand
  misc_feature (21)..(49): Pfam Name: efhand Pfam Description: EF hand
  misc_feature: SWISSPROT Homolog: EC 2.7.11.1 Non-specific serine/threonine protein kinase
MCPTGRYLGLDLSAAAGVGGDLRPAFDVLDADRDGRISREDLKTFYATAGGRFDDDDLAAMIAAADADRDGFVQYDEFERLLAARAGGAAGRSAMEDAFRLMDRDGDGKVGFEDLKAYLAWAGMPAADEEVRAMIRVAGGGDGDEGVGIEALARVLLVDLEGIAL

SEQ ID NO: 26602 - DNA, 721 bp, Panicum virgatum
  misc_feature: Ceres CLONE 1871041
  misc_feature: Encodes the peptide sequence at SEQ ID NO. 26603
ctcccctcctccttcctccaccaccttccagcaagcgagccttatcttcttcttcgtccatccgtcctggcattggctagtaggtgtcgcgagacagggagggtagcagcgagctgagaggttcacggtgggggcggcggcggcggccatgaagatccagtgcgacgcgtgcgaggccgcggcggccacggtggtgtgctgcgccgacgaggcggcgctgtgcgcgcgctgcgacgtcgagatccacgccgccaacaagctcgccagcaagcaccagcgcctcccgctcgaggcgctctccgccaagctcccccgctgcgacgtctgccaggagaaggcggccttcatcttctgtgtggaggaccgggcgctcttctgccgggactgcgacgagcccatccacgtccccggcacgctctccggcaaccaccagcgctacctcgccaccggcatccgcgtcggcctcgcctccgcggcctccgcgtgcggcgacgcccacgactcggaccaccaccccccgcccaaggccgccgtcgagccgccgccgcagcccgccgtctccgccgcggcggcgcagcaggtgccctcgccgccgccgttcctgccgcagggctgggccgtcgacgagctcctccagttctccgactacgagtccggcgacaagctgcaaaaggagtcgccgctcgggttcaaggagctcgagtggttcgccgacatcgac

SEQ ID NO: 26603 - protein, 190 aa, Panicum virgatum
  misc_feature: Ceres CLONE 1871041
  misc_feature (1)..(47): Pfam Name: zf-B_box Pfam Description: B-box zinc finger
  misc_feature (52)..(99): Pfam Name: zf-B_box Pfam Description: B-box zinc finger
  misc_feature: The sequence is a functional homolog of SEQ ID NO 465 in the 11/479,226 US patent application
  misc_feature: The sequence is a functional homolog of SEQ ID NO 1961 in the 11/479,226 US patent application
  misc_feature: Functional homolog of the protein sequence given in SEQ ID NO 50993
  misc_feature: Useful for making plants with altered lignin content
MKIQCDACEAAAATVVCCADEAALCARCDVEIHAANKLASKHQRLPLEALSAKLPRCDVCQEKAAFIFCVEDRALFCRDCDEPIHVPGTLSGNHQRYLATGIRVGLASAASACGDAHDSDHHPPPKAAVEPPPQPAVSAAAAQQVPSPPPFLPQGWAVDELLQFSDYESGDKLQKESPLGFKELEWFADI

SEQ ID NO: 26604 - DNA, 704 bp, Panicum virgatum
  misc_feature: Ceres CLONE 1871043
  misc_feature: Encodes the peptide sequence at SEQ ID NO. 26605
agtccaccgctccgctcctctccactaccgccgccaccacccccaaaaccctcgccccggccggaggggaggagagcgaccgaggaggaggaagcgagcgcgaccggccggcggagatgcagatcttcgtgaagacgctgacggggaagaccgtcacgctggaggtcgagagcagcgacaccatcgccaccgtcaaggccaagatccaggacaaggaaggcatcccaccggagcagcagcggctcatcttcgcggggaagcagctggaggacgaccgcacgctggccgactacagcatccagaaggagtccacgctgcacctggtgcttcgcctccgcggtggcggcaggggcggctaccctaccatgaccgtaccgtgggacctcatcaaccttgcccgcaaacacaatgagaagaagatggtctgccgcagttgctatgcgcgccttccctccaggtccacaaactgccgcaagaagaagtgtggccacaccaacgagctgagggcaaagaagaagttcatctccaagttgaacagtttgtgaacgatttggaaatcgagcgaagtgacattctggagtgccatctgaaagtatcacgcatcagttgaaccaacttatcttagcatatgtatcggagctgtgttagctttgtcctattttaagtttccatctgcatgctgaacctaatttactctctcgaat

SEQ ID NO: 26605 - protein, 142 aa, Panicum virgatum
  misc_feature: Ceres CLONE 1871043
  misc_feature (6)..(74): Pfam Name: ubiquitin Pfam Description: Ubiquitin family
  misc_feature (85)..(136): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency
MQIFVKTLTGKTVTLEVESSDTIATVKAKIQDKEGIPPEQQRLIFAGKQLEDDRTLADYSIQKESTLHLVLRLRGGGRGGYPTMTVPWDLINLARKHNEKKMVCRSCYARLPSRSTNCRKKKCGHTNELRAKKKFISKLNSL

SEQ ID NO: 26606 - DNA, 948 bp, Panicum virgatum
  misc_feature: Ceres CLONE 1871080
  misc_feature: Encodes the peptide sequence at SEQ ID NO. 26607
ttcctcgtctctccttcgtgcctcgccccatcagatccgccaaccccgggccgctcagatacacagatcggcacccaccatggccgcggcttcccctccgctcctccccacctctgtcgtcccggccgccgcgccatccccctcccccatccccaccgccgacgtcgccgccgccgacgccaaccccgccgcggcgcgcgccttcgtctcccgcctcctcgactccgccaggcgcgcgctctccggcgcccgcccctggtccgagctcgccgaccgcaccgcgctctcccgcccggacaccctctccgaggccacctcccgcctccgcaagaacctcgcctacttccgcgtcaactacgccgccgtcgtcgggctctccctcgccgccgcgctcctcgcgcaccccttctcccttgcggcgctcctcgccctgctcgccgcctggtgcctcctctacatgctccgccccgccgacgcgccgccgctcgccgccttcgggcgcaccttctccgacagggaggtgctcgggggcctcatcgcgtcctccgccttcgtcgtcttcctcacctccgtcggctcgctcatcttctccgcgctggccctcggcgccgccgccgtctgcgcgcacggcgcgttccgcgtcccggaggacctcttcctcgacgagcccgaccaggctgccggcagcggcaacccgctgctctccttcatcgccaccgccaccggaggacgcgtctgactgatggaggcaggccgcttcaattcttttggcagctgaggttgaggataccgatcgatcgatactgcgcgaaattactttatctgcataattacagaacaatacatacagacagacagcgaacgaacgaggaaccggaaacctcatttgtttccgtgaataaaaaagttggtttcatgtatcaatcaattggcatgattaattatttc

SEQ ID NO: 26607 - protein, 219 aa, Panicum virgatum
  misc_feature: Ceres CLONE 1871080
  misc_feature (49)..(203): Pfam Name: PRA1 Pfam Description: PRA1 family protein
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
MAAASPPLLPTSVVPAAAPSPSPIPTADVAAADANPAAARAFVSRLLDSARRALSGARPWSELADRTALSRPDTLSEATSRLRKNLAYFRVNYAAVVGLSLAAALLAHPFSLAALLALLAAWCLLYMLRPADAPPLAAFGRTFSDREVLGGLIASSAFVVFLTSVGSLIFSALALGAAAVCAHGAFRVPEDLFLDEPDQAAGSGNPLLSFIATATGGRV

SEQ ID NO: 26608 - DNA, 690 bp, Panicum virgatum
  misc_feature: Ceres CLONE 1871091
  misc_feature: Encodes the peptide sequence at SEQ ID NO. 26609
accgccatcctctctccctccgatcagcagcagcacagccagagccagcaccagcgcagcggcgagcggtccaccatccacagcttcaattcaaatcgcacggccatggcgtcgcagcagcagcagcagcggcaggcggcggggtcggcggcggcggcggcgcccgtggggttcgaggactacctgccggtgatggcggagcggctgggtgaggatgggctgatgcgggagctggcgagcgggttccggctgctcatggacccggcccgcgggctcatcaccttcgacagcctccgccgcagcgcgccgctgctgggcctgggcgccatgtccgacgacgacctccgcgggatgctcgcggagggcgacttcgacggcgacggcgcgctcagcgagatggagttctgcgtgctcatgctccgcctcagccccgagctaatggacgggccccgcaggtggctcgacgacgccgtctcgcaggcctcgcacttcctcttcaccagctaggcgggctgcctgctggagacggccgcgcgcgtaggaattgttcgttgagcttctctttcttttcgttgttcatagctggattaggaattcgttcaaaaaaaatagctggattaggaagggactggtgcctgattggtcgatagatggattccatgccttgtgtactcgatcgcctgttcctcc

SEQ ID NO: 26609 - protein, 133 aa, Panicum virgatum
  misc_feature: Ceres CLONE 1871091
  misc_feature: Functional homolog of the protein sequence given in SEQ ID NO 51220
  misc_feature: Useful for making plants with altered glycerol content
MASQQQQQRQAAGSAAAAAPVGFEDYLPVMAERLGEDGLMRELASGFRLLMDPARGLITFDSLRRSAPLLGLGAMSDDDLRGMLAEGDFDGDGALSEMEFCVLMLRLSPELMDGPRRWLDDAVSQASHFLFTS

SEQ ID NO: 26610 - DNA, 927 bp, Panicum virgatum
  misc_feature: Ceres CLONE 1871122
  misc_feature: Encodes the peptide sequence at SEQ ID NO. 26611
aaaataatcttatcttagcttgatttcgagttaggcatttgccacctcaacgtttctcccaaccctgtcctctgttcaatctcttgtaacctgcagagcatgctcatgagtagtcatggctcatgagcgttttttttttgcggaagcataaagcatatggattttttaaggaattcaagttccaagtttttagtactgtgtgtgaaacaaaacaaaagaacgttttaaatttgatgatgcgttgcaggtacagggcggtgacgagcgcctactaccgcggcgcgctgggcgccatggtggtgtacgacgtgacccggcgcgccacgttcgagcacgtcccgcggtgggtggaggagctccgcgcgcacgccgacggctccaccgtcgtggcgctcatcgggaacaaggccgacatgcccgcggcgcggcgcgaggtggcggccgacgaggccgcgcgcctcgccgaggagcaggggctcttcttctccgaggcgtccgcgctcacgggggacaacgtggagcgcgccttcctcacgctcctcgaggaggtcttcgccgtcgtctcgcgccgggcgctggagctcgacgaggcacgccggatgcgcggcgagcagggcgatggcggcgccggtggcgaggtgctgtcgctcagggggacaacggtggacctgggctccatcatggagaccagctccatgaagaagagctcgcagtgcgcctgctcgtgatggcgttttcacctcagatgtaggagttctttcaaaagtactatatttttttaagagcttcatttacaaatcacagatcattacactattggtcttttaggcatgctaccttgtaaagcctgtaagtacgagacgttctattgtacctgatcaattgttttgttttcgaagttcccaagcaaacaggcagatttatgcc

SEQ ID NO: 26611 - protein, 201 aa, Panicum virgatum
  misc_feature: Ceres CLONE 1871122
  misc_feature (16)..(145): Pfam Name: Ras Pfam Description: Ras family
  misc_feature: Functional homolog of the protein sequence given in SEQ ID NO 50162
  misc_feature: Useful for making plants with altered lignin content
MSVFFLRKHKAYGFFKEFKFQVFSTVCETKQKNVLNLMMRCRYRAVTSAYYRGALGAMVVYDVTRRATFEHVPRWVEELRAHADGSTVVALIGNKADMPAARREVAADEAARLAEEQGLFFSEASALTGDNVERAFLTLLEEVFAVVSRRALELDEARRMRGEQGDGGAGGEVLSLRGTTVDLGSIMETSSMKKSSQCACS

SEQ ID NO: 26612 - DNA, 543 bp, Panicum virgatum
  misc_feature: Ceres CLONE 1871123
  misc_feature: Encodes the peptide sequence at SEQ ID NO. 26613
acgctccatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagtggggtcacatcgctgagcagaagtacggtggcggtgggtacggtggcggcggcggcggatactgtggcggcggtgggtacggcggcggaggtggtgatggtagctatagaggcatcttcccctgccgcttcatgatcttcctcggcgtcggcggcttgctcgccggctacctcccctgattcctcaagggatgggtctatgtcacggatgccttcgtcgaggactacttacgccgtggtggaactgtcgtccgaatgctgcttgacgccattgacttgtttctcattggaacggccatgtttgtgcttcggcacgggcttgtacgag

SEQ ID NO: 26613 - protein, 86 aa, Panicum virgatum
  misc_feature: Ceres CLONE 1871123
  misc_feature (2)..(65): Pfam Name: GRP Pfam Description: Glycine rich protein family
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
MMSGKALLVAVLLVGVASRCSGSRGLQWGHIAEQKYGGGGYGGGGGGYCGGGGYGGGGGDGSYRGIFPCRFMIFLGVGGLLAGYLP

SEQ ID NO: 26614 - DNA, 721 bp, Panicum virgatum
  misc_feature: Ceres CLONE 1871123-R
gcggtgggtacggtggcggcggcggcggatacggtggtggcggtgggtacggcggcggaggtggtggtggtgggtatggaggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaagaaggccaactacgcctgccactactaatcgatcgatgacgaaggagcgagctgcttcctccatctatcatttcgtcagtgtagcgtgcttgttaaataagatgtgtgtgtgtgtccgatccccagctagcgtcgccttcgcttctgcgtcgtcgtcttcccgtgactagctcccatgaatccatgaggacgcatgacgccatgccgtctcgttgtctgcttcttcagtagtgatgatgcctgcttccttgtcgttgttgctgatgtaatgagaaataagatgagttggttggtggt

SEQ ID NO: 26615 - DNA, 672 bp, Panicum virgatum
  misc_feature: Ceres CLONE 1871128
  misc_feature: Encodes the peptide sequence at SEQ ID NO. 26616
atccaccctcatcggaagctccccccaactccaagcctccttccagcagcgaagaagcgaggagccagccggagagcggcgatcgagcagcgtcgcgacaccagccagtcggatacaagcgatcccatggcgcccagaaggtcaccgtcgccggcggggcagcagccgaggctccgaggcgtgcggaagcggccgtggggccggtacgcggcggagatccgcgaccccgtacgcaaggcgcgcgtgtggctggggaccttcgacacgcccgaggacgccgcgcgcgcctacgacgccgccgcgcgcaggctccgggggccgcgcgccgccaccaactacccggcccaggacccgagggccgtggcggcggacgctccggcggcgagcaggagcgggagcgttgcgctgtcggagggcgcgtcgtcttcctcgtcgcgctcccgggactcgccgctggcggtcacggtggccgtcgcggcggctccgtcgaaggacctgagtctggcgctcccggccacgccatcgtcgtaccacatgttcctggacccggccgcgacgatggtagccgtggcgccagcgctgctgcagttcctgccgcccaagagtgaggaagaccagagcttctcagggtcgtgctcctcctcaggctcctcgtcggccgtgttccacgcc

SEQ ID NO: 26616 - protein, 181 aa, Panicum virgatum
  misc_feature: Ceres CLONE 1871128
  misc_feature (14)..(65): Pfam Name: AP2 Pfam Description: AP2 domain
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
MAPRRSPSPAGQQPRLRGVRKRPWGRYAAEIRDPVRKARVWLGTFDTPEDAARAYDAAARRLRGPRAATNYPAQDPRAVAADAPAASRSGSVALSEGASSSSSRSRDSPLAVTVAVAAAPSKDLSLALPATPSSYHMFLDPAATMVAVAPALLQFLPPKSEEDQSFSGSCSSSGSSSAVFH

SEQ ID NO: 26617 - DNA, 673 bp, Panicum virgatum
  misc_feature: Ceres CLONE 1871135
  misc_feature: Encodes the peptide sequence at SEQ ID NO. 26618
cctccctccacagatcccgattcgatcagccgccatggcccgctcctcctcgcagtcccagtcctccgtcggcggcgccggcgccggagcccgcccggccaccgttggcccccgcggcacggcagcagctgccgccggcatgcgccgccgccgcgccaccgctagcgccgggggagggggcttctccggcggcggcgggagcaacatgcttcggttctacaccgacgaggccccgggcctgcgcctctcgccaaccatggtgctcgtcatgtcgctgtgcttcatcggattcgtcaccgccctccacgtcttcggcaagctctaccgctcccgcaccgccgcagcctccgcgtgacccatccccatcccatccctccggcgcgactatcatcagatcaaggttttcaatatatcatcatcagtctacttactcttgtcttgcctagctttccttcctgtgctagtgctagatctggagggagatgaatggaaccctacaacttgaagttagtgatgatgccctttctgttgccttattcttcccctttccttgttttagtgcctttttatttactcccagatgcaaatagttgtgcctagtcactgtaatcatggggattgctacaattaattttgcatctcggtaacttagcgtgtgctcgaggatttctac

SEQ ID NO: 26618 - protein, 106 aa, Panicum virgatum
  misc_feature: Ceres CLONE 1871135
  misc_feature (52)..(97): Pfam Name: Sec61_beta Pfam Description: Sec61beta family
MARSSSQSQSSVGGAGAGARPATVGPRGTAAAAAGMRRRRATASAGGGGFSGGGGSNMLRFYTDEAPGLRLSPTMVLVMSLCFIGFVTALHVFGKLYRSRTAAASA

SEQ ID NO: 26619 - DNA, 1042 bp, Panicum virgatum
  misc_feature: Ceres CLONE 1871180
  misc_feature: Encodes the peptide sequence at SEQ ID NO. 26620
gcattgaactcgccctcggttcgttccagcgcttgcccatcggactcaccgccgagacgaagccccacaacatccccccagaccccagccagcttctctctcagccccctccgcttgtcgcgttgcggacccggcgcacgccggcccgcccagatatagagcgaacagagccgccggccagacagacactcgaagcggttgcttggtgcggcaagggagaaggatcatcagaccccagttggtttactactagccggccatggctgccaagaaggtggtgctgaagatcgacctgcacgacaacaaggataagcagagggtgctcaaagcggtctccactctccacggtatcgactccatctccgtggacatgaaggactctaagctgacggtgatcgggctcgccgaccccgtcgacgtcgttgccaagctgcgcaaggtcggggccgcccacatcctctccgtcggcccggccaaggaggagaagaaggacgaaaagaaggacggcgacaagaaggatggcgataagaaggacggcgacaagaaggacggcgataagaaggtcgtggtgtacccgccgccgtggtacgccgggcagtacccctactacccccactacgtcgtccacagcgccgaggaggaccccaactcctgcgtcatctgctgattgccgatccccgcccggtttttgtaaattcctagttggcctgcctgcctacctcgagctccagcgtcagtgatcgccggctgggacccggaccagggccggggctgcggtggttggccgctgcgctcagctctatgcctctattccctgggttggttggcccgtccgcaggtcgttatatgatgacgatgacgatggccggagcaattacgcaggcgatccaggagtagttggtgggatttcaggttgcagcgccattgctgatcagcgagttgtgtagtgttcatagcatattgtatctgggttttgtccttgctatttgggtgttgaggcatgaaactatagacatatataaaggttaactgaacatacact

SEQ ID NO: 26620 - protein, 135 aa, Panicum virgatum
  misc_feature: Ceres CLONE 1871180
  misc_feature (6)..(73): Pfam Name: HMA Pfam Description: Heavy-metal-associated domain
MAAKKVVLKIDLHDNKDKQRVLKAVSTLHGIDSISVDMKDSKLTVIGLADPVDVVAKLRKVGAAHILSVGPAKEEKKDEKKDGDKKDGDKKDGDKKDGDKKVVVYPPPWYAGQYPYYPHYVVHSAEEDPNSCVIC

SEQ ID NO: 26621 - DNA, 342 bp, Panicum virgatum
  misc_feature: Ceres CLONE 1871216
  misc_feature: Encodes the peptide sequence at SEQ ID NO. 26622
aaatcccgtgaggcgcctcgccgcgcagacaaaaatccccaaatcccctcgagagcccagcctctcaaacccagcgattcgagccggtggcggcggcggcggtcggttcgtggcatggcggagattcgcaagcacgccatgtccaaccaggcgccagatattcctcagatactactggaagctcagaataggtggctgcggcccaacgaaatctgccaaatattgtcaaactacaagaagttctccatcgcacctgagccaccaaacagacccccaagtggttcgctgtttctgtttgatcggaaaatattgagatacttcagaaaggacggacataactgg

SEQ ID NO: 26622 - protein, 75 aa, Panicum virgatum
  misc_feature: Ceres CLONE 1871216
  misc_feature (19)..(75): Pfam Name: CG-1 Pfam Description: CG-1 domain
  misc_feature: The sequence is a functional homolog of SEQ ID NO 1308 in the 10/666,642 US patent application
  misc_feature: The sequence is a functional homolog of SEQ ID NO 588 in the 10/666,642 US patent application
MAEIRKHAMSNQAPDIPQILLEAQNRWLRPNEICQILSNYKKFSIAPEPPNRPPSGSLFLFDRKILRYFRKDGHN

SEQ ID NO: 26623 - DNA, 682 bp, Panicum virgatum
  misc_feature: Ceres CLONE 1871239
  misc_feature: Encodes the peptide sequence at SEQ ID NO. 26624
cttagcccccgccgccgccgccagttctcgccctctcccaaaccctacccgccgccgccgccatgccgccgaagctcgacccgtcgcaggtggtggaggtgttcgtccgcgtgacgggcggcgaggtcggcgcggcgtcgtcgctggcgcccaagatcggcccgctggggctctccccgaagaagatcggggaggacatcgccaaggagacggccaaggactggaagggcctccgcgtcaccgtcaagctcacggtgcagaaccgccaggccaaggtctcggtcgtgccctccgccgccgcgctcgtcatcaaggcgctcaaggagcccgagagggaccggaagaaggtcaagaacatcaagcacagcggcaacatcggcctcgacgacgtcgtcgagatcgccaggaccatgaggcccaggtccatggccaaggagatggccgggaccgtcaaggagatcctcggcacctgcgtcagcgtcgggtgcaccgtcgacggcaaggaccccaaggacctgcagcaggagatcgatgacggcgacgtcgagatcccctcagcttaaaaggctaaggagactgtaattgatgctgctgaagtggtgttttgttctgcatgctgttgtacctccaaacaatgtgattccacctttttcgtctagctctattagtgttattctgtgag

SEQ ID NO: 26624 - protein, 166 aa, Panicum virgatum; identical to SEQ ID NO: 12538
  misc_feature: Ceres CLONE 1871239
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 26625 - DNA, 741 bp, Panicum virgatum
  misc_feature: Ceres CLONE 1871249
  misc_feature: Encodes the peptide sequence at SEQ ID NO. 26626
gccattcgccgaccacaagccgcaccaaacccgcagcgcccatccatcgacgagacgacgacgtcgccggcgagagagaaggggagacagttgacagatggaggcggcggcggcagcggccggcgtgcagctcggctcctccaagccccagatcgccacgcaggcggagatggcggaggcccgggtgccgctcccctaccgcgaccagtgcgcgcacctcctcatcccgctcaacaagtgccgcgtcgccgagttctacctcccgtggaagtgcgagcccgagcgccacgcctacgagaaatgccagtacgagctcgtcatggagcggatgctccagatgcagaagatccgcgaggcgcaggaggccaaggtcaagggcggcgcctccattggcctcatcccggccaccgccaagctcgcctgatccttccccggtccgatccggttgatttaggtctgctggttatcacagcgtgcagaggcattgtgcaagaatcctgaatgtttgttgtatgaacaaacatctgttgaatttggcataaagttaactgttatcttctcctcatcccccttttctccttggtgggcatcttcaagtttcaatttgatggaataacgaaacctactgtcttacgcttgatgactgaatgacgccttgaagttttgaatgcaattcgtggacccttcatatgtagacagacctactttgtgctgtaggttatgtaatgacctacccgcctt

SEQ ID NO: 26626 - protein, 108 aa, Panicum virgatum; identical to SEQ ID NO: 12524
  misc_feature: Ceres CLONE 1871249
  misc_feature (1)..(89): Pfam Name: NDUF_B7 Pfam Description: NADH-ubiquinone oxidoreductase B18 subunit (NDUFB7)

SEQ ID NO: 26627 - DNA, 688 bp, Panicum virgatum
  misc_feature: Ceres CLONE 1871276
  misc_feature: Encodes the peptide sequence at SEQ ID NO. 26628
aaagctcgccgcgccgcagccaccccccaccaggccaccagcaccccgagtcccggagagaagcagatcggcggcgcgtcactccaacttccggtaagcttaaatggcgacggttcctgattctctgatctgggagatcgtgaggaagaataattccttcctggtcaagcagtttggcaatggcaatgccaaggttcagttcagcaaggagcccaacaacctctacaatgtccactcctacaagcactctggccttgccaacaagaagaccgtgactgtgcaaccggccagtggcaaggagatggcggtggtcctctcaacaaccaagacaaagaagcagaacaagcctgccagcctctaccacaagtctgtcatgcgcaaggaattccgcaagatggccaaggctgttaagaaccaggttggcgacaactactacaggcctgatcttaccaagccagctcttgcaaggctgagcgcagtgtaccgcagcctccaggttgccaagtctggtgtcaagaagaagaataggcaggcgaactaagtcacaaggaattgttttgatgggcgatgtttatgtttcatggtttctagatttggagcatgatggatgatgtgcgccgtacctaagactgccacaaatgaaatttcattgtaggttccaccttttgtacttgtacccatgacatga

SEQ ID NO: 26628 - protein, 145 aa, Panicum virgatum
  misc_feature: Ceres CLONE 1871276
  misc_feature (5)..(137): Pfam Name: Ribosomal_L28e Pfam Description: Ribosomal L28e protein family
  misc_feature: Functional homolog of the protein sequence given in SEQ ID NO 50137
  misc_feature: Useful for making plants with altered oil content
  misc_feature: Useful for making plants with modulated cold sensitivity
MATVPDSLIWEIVRKNNSFLVKQFGNGNAKVQFSKEPNNLYNVHSYKHSGLANKKTVTVQPASGKEMAVVLSTTKTKKQNKPASLYHKSVMRKEFRKMAKAVKNQVGDNYYRPDLTKPALARLSAVYRSLQVAKSGVKKKNRQAN

SEQ ID NO: 26629 - DNA, 686 bp, Panicum virgatum
  misc_feature: Ceres CLONE 1871297
  misc_feature: Encodes the peptide sequence at SEQ ID NO. 26630
ttcatcactcacgtagaacacagaaccagatctgttaatccaggagctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggtggccgggtacgtcgacgccggcaaggtgatgcggcgggtggcgcgccggacgggcaagcgggtggagccctggccctacgtcgtcgccgaccccgccgccgcgccgctcgcccgggcctcgtccaccgaggtcaggtacaccgccgccttcagcgacgagaaccccaacgccgcctgcgccgtcatgtagagctgcacgctgcctcgctcctgtagtagtaggagtagatggactaggaagttgctgctgtttcttggagcatttttttttctactttagtatttctctacgcttgtgctctggttcgattcgctgtaaaaaaagaagatggttttgattcctcagtggtagtaagtaggcttgaaggctagctagtagtgtttgttgccttgttgattgatgtatcatttctgaaaaagaagatattttga

SEQ ID NO: 26630 - protein, 130 aa, Panicum virgatum
  misc_feature: Ceres CLONE 1871297
  misc_feature (29)..(91): Pfam Name: HMA Pfam Description: Heavy-metal-associated domain
MGIVDVVSVFCALPRTRRHLKKRKEFQTVEMKMRIDCEGCERKVRKALEGMEGVSSVEVAPRQHKVTVAGYVDAGKVMRRVARRTGKRVEPWPYVVADPAAAPLARASSTEVRYTAAFSDENPNAACAVM

SEQ ID NO: 26631 - DNA, 654 bp, Panicum virgatum
  misc_feature: Ceres CLONE 1871340
  misc_feature: Encodes the peptide sequence at SEQ ID NO. 26632
atgcccggggcagagcacgagccgacggacgcgtttgacgcgcacatggaggccgccgtccggcggtaccagtccacgctcagcctgcccgtcacggggcagctcgactccgccacgctcgaccggatcatggccccgcgctgcggcgtcggcgacaacggccacggcgccacgcccgtgtccctgacggccgcccccggcgcggtcagccggttcaccttcttcaggggcgagccgcggtggacgcagccggacccgctcgtgctcacgtacgccatctcgccaacggccaccgtcgactacctgccggccgagaccgtgcgcgccgtgttccggcgcgcgttcgcgcggtgggcgcgggtcatccccgtgggcttcgtcgagaccgacgactactacgcggccaacatcagggtgggcttctacgtgggcagccacggcgacgggatccccttcgacgggccgctgggcgtgctcggccacgccttctcccccaggaacgggcggctccacctcgacgcggcagagcggtgggcggttgacatggacacggagacggcgcactcggctatcgacttggagtccgtggccacgcacgagatcgggcacatcctcggcctgcggcactcctcgtcgcccaaggcggtcatgtac

SEQ ID NO: 26632 - protein, 202 aa, Panicum virgatum
  misc_feature: Ceres CLONE 1871340
  misc_feature (65)..(202): Pfam Name: Peptidase_M10 Pfam Description: Matrixin
  misc_feature: SWISSPROT Homolog: EC 3.4.24.17 Stromelysin 1
MEAAVRRYQSTLSLPVTGQLDSATLDRIMAPRCGVGDNGHGATPVSLTAAPGAVSRFTFFRGEPRWTQPDPLVLTYAISPTATVDYLPAETVRAVFRRAFARWARVIPVGFVETDDYYAANIRVGFYVGSHGDGIPFDGPLGVLGHAFSPRNGRLHLDAAERWAVDMDTETAHSAIDLESVATHEIGHILGLRHSSSPKAVM

SEQ ID NO: 26633 - DNA, 323 bp, Panicum virgatum
  misc_feature: Ceres CLONE 1871356
  misc_feature: Encodes the peptide sequence at SEQ ID NO. 26634
tatctcttcaattttaagcctaatgactttagaggagtaccaatggattttatcatgaaattaattcctcagcatgccaagaagcaatgcgccttcttaggaatatgaggaagcagttcagagtgctcacaaaaagaagcaagcagcagtttggaggttacctgcctattacatcaatattgtgttgaaaactgcacactcccattcgcctacagcattattgcatgggcaatgcatgctgttttctttcacttcggctgtgatgctgcatggttgttctacaatgggggggagcactttcaccacattctgttaaagctgat

SEQ ID NO: 26634 - protein, 35 aa, Panicum virgatum
  misc_feature: Ceres CLONE 1871356
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
YLFNFKPNDFRGVPMDFIMKLIPQHAKKQCAFLGI

SEQ ID NO: 26635 - DNA, 564 bp, Panicum virgatum
  misc_feature: Ceres CLONE 1871360
  misc_feature: Encodes the peptide sequence at SEQ ID NO. 26636
ttacgataaatgataacttcttcccaggacatttccctgaacgccccataatgcctggtgttctcatggttgaggctatggctcaggttgggggtctggtgatgctgcaacctgaagttggtggatctcgagacaacttcttttttgcagggattgacaaagttaggttccggaagccagtgattgctggggacacattgatcatgagaatgactctgacaaagtaccagaagagatttggactcgcaaagatggatggaaaagcttatgttggtggtgacctagtttgtgagggggagttcctccttgtcagtgcaactgaatagtccaaagatatctagcactgcccaattcccttccagagtcattggctaggatgggaccaggttagtttcttgaaagaatcaagttttgagctaaacatacaatcggcatgaggcaatcctttacctgttaagtgtgttgagtccatgttcacacgatttctatcgcctaccagagcttaatctagctctattgctgttgtaatacaggattacagtatgtgaggtagttgtttgatgg

SEQ ID NO: 26636 - protein, 107 aa, Panicum virgatum
  misc_feature: Ceres CLONE 1871360
  misc_feature (1)..(99): Pfam Name: FabA Pfam Description: FabA-like domain
  misc_feature: SWISSPROT Homolog: EC 4.2.1.60 3-hydroxydecanoyl-[acyl-carrier-protein] dehydratase
TINDNFFPGHFPERPIMPGVLMVEAMAQVGGLVMLQPEVGGSRDNFFFAGIDKVRFRKPVIAGDTLIMRMTLTKYQKRFGLAKMDGKAYVGGDLVCEGEFLLVSATE

SEQ ID NO: 26637 - DNA, 518 bp, Panicum virgatum
  misc_feature: Ceres CLONE 1871361
  misc_feature: Encodes the peptide sequence at SEQ ID NO. 26638
attcccggactccggtcatacgtggcaccgcccgccccggccctcctctcgggccctttccccgctgccggtcgccgtggacggcctcgaccgaggcctcctctacggtgctacgcacccatatctacctgctccaccccccggctgagctcgagactctcaactgcaacaagaaccgcctcgtgcagtccccgaactctttcttcatggacgtcaagagccagggatgcttcaacataaccactgctttcaaccactcccggactgttgaggcgtggccggggagcctacctgtcctctgccaccccactggaggaaaggctacgataacttagggctgctccttcccccgagaggcatactacactgtattctggtggaggatggttgtactctgctaacttttttccttgagtatgtatccttcgaattttgcgctatgtaaaatggtacggtcctgaactgctgcttaggctttcaactatctaatccaatgttatgtgctgcatgctattcaa

SEQ ID NO: 26638 - protein, 110 aa, Panicum virgatum
  misc_feature: Ceres CLONE 1871361
  misc_feature (64)..(110): Pfam Name: Ribosomal_S27e Pfam Description: Ribosomal protein S27
SRTPVIRGTARPGPPLGPFPRCRSPWTASTEASSTVLRTHIYLLHPPAELETLNCNKNRLVQSPNSFFMDVKSQGCFNITTAFNHSRTVEAWPGSLPVLCHPTGGKATIT

SEQ ID NO: 26639 - DNA, 946 bp, Panicum virgatum
  misc_feature: Ceres CLONE 1871382
  misc_feature: Encodes the peptide sequence at SEQ ID NO. 26640
tcttcgctgcgctgctttgcctatccaggacatggcgtcggcggcgacgcgggaggaacggagccgggtcctggtcatcggcggaacgggctacatcggccggtttatcgtggctgccagcgctcgcgaaggccaccccacctccgtcctcgtccgcgacctcgcgccggccaaccccaccaaggccgccgttctccaggggttccgggaaaccggagtcaccctcgtcaagagattcctgccatcagagtatgggaatgatgtggaccgtgtgcatgcggttgagcctgcaaaattaatctttgctggcaaagctcgtataaggcgtgccattgaagctgaagggattccgtacacctatgtatcatccaacttctttgctggtcatttcttggcaagtcttggacagattggggttactggccttccaacagataatgttctcatcatgggtgatggaaatgttagagcaatatttgcggcagaggaggatgtcggcacctacacaatcaaagctgtagatgatccaagaaccctgaataagatcttgtatttgaggccaccgagcaacatcttgtctcataatgagcttgtctcactctgggagaagaaagttggaaagaggtttgagagggtgtacattccagaagatgaggtcctaaagaagattcaagagtctgcgattccactgaacataaggatgtcaataagccattctgtgtgggtgaagggggaccacaccaactttgagattgatccttcatttggagttgaagccaccgagctttaccctgatgtcaagtacactactgtcgatgaatacctaaacaagctcctttgaactcctatatcctaagtctactattcaaatacatcgaaatataggaaaatatatgcagtgattagaaacccatggctttaaaatatcacgagacctcaatcgtgt

SEQ ID NO: 26640 - protein, 269 aa, Panicum virgatum
  misc_feature: Ceres CLONE 1871382
  misc_feature (13)..(260): Pfam Name: NmrA Pfam Description: NmrA-like family
  misc_feature: SWISSPROT Homolog: EC 1.3.1.45 2'-hydroxyisoflavone reductase
MASAATREERSRVLVIGGTGYIGRFIVAASAREGHPTSVLVRDLAPANPTKAAVLQGFRETGVTLVKRFLPSEYGNDVDRVHAVEPAKLIFAGKARIRRAIEAEGIPYTYVSSNFFAGHFLASLGQIGVTGLPTDNVLIMGDGNVRAIFAAEEDVGTYTIKAVDDPRTLNKILYLRPPSNILSHNELVSLWEKKVGKRFERVYIPEDEVLKKIQESAIPLNIRMSISHSVWVKGDHTNFEIDPSFGVEATELYPDVKYTTVDEYLNKLL

SEQ ID NO: 26641 - DNA, 718 bp, Panicum virgatum
  misc_feature: Ceres CLONE 1871442
  misc_feature: Encodes the peptide sequence at SEQ ID NO. 26642
taagcttaaggagataaagtcaacactgactaccatgatcaatgatgaggctgaaatatctgaagtcattgagactgtcaagcaacaagttaaatatgctaaatttcctgatatagaggttatccgcatgctgtgggatgtgcttatggaggctgttcagtggtctggaaagaaccagcagcagaattctaattcagcacttcggcaggtgaaagcttgggctgagcttttgaatgccttttgcacgagtggcagactagaactggaactcatatacaaagttcagacacaatgttatgaggatgctaagctgatgaagctgtttcctgagatcataaggacactatatgaccaagatgccctagctgaagatactatccttctttggttccgtaaaggttcaaacccgaagggcaggcaatctttcgttaaagctctggagccatttgtcaaatggctagaggaggcagaggaagaagaataagtgttgtgctactggaggctggtcagatctgcctgaagtatttcccaatatttctatggtttgaagtttatggaggaagttgtgtatctcctgcttgttacagggcggataattttattttctcatgttgtgccgcatggctctcttctgctggatgctataatatgatgcatatacagtcgctgttgactttgcgaggattctgagacggttgctatcaattactaaactgag

SEQ ID NO: 26642 - protein, 160 aa, Panicum virgatum
  misc_feature: Ceres CLONE 1871442
  misc_feature (84)..(160): Pfam Name: W2 Pfam Description: eIF4-gamma/eIF5/eIF2-epsilon
KLKEIKSTLTTMINDEAEISEVIETVKQQVKYAKFPDIEVIRMLWDVLMEAVQWSGKNQQQNSNSALRQVKAWAELLNAFCTSGRLELELIYKVQTQCYEDAKLMKLFPEIIRTLYDQDALAEDTILLWFRKGSNPKGRQSFVKALEPFVKWLEEAEEEE

SEQ ID NO: 26643 - DNA, 635 bp, Panicum virgatum
  misc_feature: Ceres CLONE 1871460
  misc_feature: Encodes the peptide sequence at SEQ ID NO. 26644
aaaaataccgatagcaatccgcagccgcaaccagcctctccgccgcttgctctcctccccgtctcgtgaagctttcggcacgcacgtatggcggcggtggcgggcccgacgagggcagaggcgctgtccctcttccggtccctcctccgcacggcgaagcagttctccgactacaacatccgggagtacacgcgccgccgcgccgcggacgccttccgcgagaaccgcgccctccccgacgcggcggccgcggcggcggcgttcgcggaggggaagaagcagctcgaggtcgcgaagcggcaggcggtggtgtactcgctctacacccccaagtccaagagcgtgatggagttgaaggtgcagtgatggacgagggagagaggcactaatcaagaacatggattagcaaggtgaccaatgtctttagagacttgatggatttgagaataataaaggggcagtatcatgtacattatataactggccgtggctactggctgctgttgttcccgaagaaatggaaggtcttgctcagttaattggacattgttagttgctttatactttacacatttaacatgtgcgcatctgtagtttggtaagtttggaaactaaacgtcgcagcgcctcatccc

SEQ ID NO: 26644 - protein, 92 aa, Panicum virgatum
  misc_feature: Ceres CLONE 1871460
  misc_feature (7)..(71): Pfam Name: Complex1_LYR Pfam Description: Complex 1 protein (LYR family)
MAAVAGPTRAEALSLFRSLLRTAKQFSDYNIREYTRRRAADAFRENRALPDAAAAAAAFAEGKKQLEVAKRQAVVYSLYTPKSKSVMELKVQ

SEQ ID NO: 26645 - DNA, 743 bp, Panicum virgatum
  misc_feature: Ceres CLONE 1871507
  misc_feature: Encodes the peptide sequence at SEQ ID NO. 26646
atctgtagccttcgccagcgccggaagttaaagaacaaagaagagaggacgccccggccgcaactcccctagacgaagaagagacccttgggctgacgtcgagcggagaaggcgagggaagatggggaagggcgtcctggaggtgcacctcgtcgacgccaggggcctctccggcagcgatttcctagggaagatcgacccctacgtgatcgtgcagtaccggagtcaggagcgcaagagcagcgtcgcccgaggtcagccccgctatagattctttttcttcctgctaaatccccccttttcaggtcatgcatgatcacgaatatcctgccgaccttggcacgggctgatgactgagctgccggcttgtgtgtgtgttgcagaccaggggaggaacccgtgctggaacgaggtgttcaagttccagatcaactcttcggcgtccagcgcgcagcacaagctcatcctccggatcatggaccacgaccacttctccagcgacgacttcctcggcgaggctacgatcgacgtgacggacatcatcagcttgggcgcggagcgcggctcgtaccacctcaacgcggggaagcacaacgtggtcctcgccgacagcacgtaccacggcgagatcaaggtcggcatcaccttcaccgccgcccaggttgaggaagatgatgaggattttggaggctggaggcgcagaagctccaatgcgtaggtgcggtgaaatctgaagatgttct

SEQ ID NO: 26646 - protein, 122 aa, Panicum virgatum
  misc_feature: Ceres CLONE 1871507
  misc_feature: SWISSPROT Homolog: EC 2.7.11.13 Protein kinase C
MTELPACVCVADQGRNPCWNEVFKFQINSSASSAQHKLILRIMDHDHFSSDDFLGEATIDVTDIISLGAERGSYHLNAGKHNVVLADSTYHGEIKVGITFTAAQVEEDDEDFGGWRRRSSNA

SEQ ID NO: 26647 - DNA, 720 bp, Panicum virgatum
  misc_feature: Ceres CLONE 1871521
  misc_feature: Encodes the peptide sequence at SEQ ID NO. 26648
acacacgcggacacgccactagcctcctctcggtttgagcagctcatcaacgccgccggcaagaagtcccctcgagctcgcccccggcagccagccagcccagccatcagccatgggctcgaccgccgccgacgtggccgcggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtacgccgccgcgccggtgtgcaagtggctcacccccaacgaggacggcgtctccatggccgcgctcgcgctcatgaaccaggacaaggtcctcatggagagctggtgagtgtgagtcctccatcgaaaattattcttgctgcatcagctttgagctgattaattagttttgtttttgttttgttttttttcttcactgaacttaatacggtggagtggttgtagattgcaagtagcagtagaagcttgcagagtagttaggttatccataatgtttctctaaatatgaaacgc

SEQ ID NO: 26648 - protein, 140 aa, Panicum virgatum
  misc_feature: Ceres CLONE 1871521
  misc_feature (33)..(85): Pfam Name: Dimerisation Pfam Description: Dimerisation domain
  misc_feature: SWISSPROT Homolog: EC 2.1.1.68 Caffeate O-methyltransferase
  misc_feature: Functional homolog of the protein sequence given in SEQ ID NO 51221
  misc_feature: Useful for making plants with altered carbohydrate content
  misc_feature: Functional homolog of the protein sequence given in SEQ ID NO 50401
  misc_feature: Useful for making plants with altered cell wall content and/or composition
MGSTAADVAAAAAADEEACMYALQLASSSILPMTLKNAIELGLLEVLQKDPAAALAPEEVVARLPVAPANPDAAAMVDRMLRLLASYDVVRCRMEEGKDGRYSRRYAAAPVCKWLTPNEDGVSMAALALMNQDKVLMESW

SEQ ID NO: 26649 - DNA, 1087 bp, Panicum virgatum
  misc_feature: Ceres CLONE 1871532
  misc_feature: Encodes the peptide sequence at SEQ ID NO. 26650
atcaaccttcttctccccgaaagccacgagctgtgcatagagcttgctagcatcgagcacagcgaaacagccagaaaaaaaaaaaccatgaagaagacgatcgtcctgtacccggggcctcttcgtcagccacctcatccccatgatgcagctcgccgacgtcctcctggaggagggctacgccgacctcacccaggaccaagacgccgcgctggcagccgccgtcgaccgcgtcgccgccgcccgcccgtccgccgccgtccgcaggctcccccggatccaggaccctcccgccgtcgcggactacggcggggagccgatcctctggtacctcgaggtcgtcaggcgctacaacgagcgcctccgcgagttcctctgctccctgcctccccggagcgtccacgccgtggtcatcgacgcgccttccgtcgccgcgctcgacgtcgccagggagctcggggtcccggcctacaccttcttcgcctccaatgcctccgcggtcgccatgttcctgcagcttccctggatgcgcgcggaaggacagccgagcttcaaggagctcggagacgcccgcgcccctatcgaattccacggcgtccctcccatgccggcgtcgcacctcatgcgcgagacgctcctggacccggagagctaggtgtacaaggcgatgatggaagcgatgcgccggaacgcggagcccgacggcatcctggcgaacacgttcgagtcgctggaggctcgcgcggtgggagctctcagggacccgcaggttcctcccggcggcggggagcgcaggacgcctccggtatactacgtcgggccgctggtcgcgggcgttggcggcggcgccgagacgacgaaagagaagcgcgagtgcctcgcgtggctcgacactacgctgctaatgcgcaagaatccaacccattcccgtctcgatccaaaataaatatgttttttcttactccaccccacctcattacaaatcaaattatacccaacccaacccaccatatattgagttgccataggttgctcccgtggggttgccatgaataattatataataattattcaatattatcccacc

SEQ ID NO: 26650 - protein, 170 aa, Panicum virgatum
  misc_feature: Ceres CLONE 1871532
  misc_feature: Functional homolog of the protein sequence given in SEQ ID NO 50592
  misc_feature: Useful for making plants with altered carbohydrate content
MMQLADVLLEEGYADLTQDQDAALAAAVDRVAAARPSAAVRRLPRIQDPPAVADYGGEPILWYLEVVRRYNERLREFLCSLPPRSVHAVVIDAPSVAALDVARELGVPAYTFFASNASAVAMFLQLPWMRAEGQPSFKELGDARAPIEFHGVPPMPASHLMRETLLDPES

SEQ ID NO: 26651 - DNA, 399 bp, Panicum virgatum
  misc_feature: Ceres CLONE 1871551
  misc_feature: Encodes the peptide sequence at SEQ ID NO. 26652
tcgcatctcctctccctctctgttgtgttattgtatctgccataaagctctctgcttgcttgtgttacagcctcttactctcgcgaggatgtctggatgtccagccacctgcgcgtgcccctccggctacgattgcggctccggctgcagatggtgcaacatgtacccagacctgactgacaaactcacctccaccgcctggcacactgtcatcatgggcattgcaccagccaacctcgagcacgccgagggaggatataacgccggctccggaaccgagaacggctgcacctgcggtgcctactgcacctgctacccctgcacctgcacgtgaggagctcatggccaaggtcggaccgaaagagatctgaatatagtatagctgcgtattttctgcgt

SEQ ID NO: 26652 - protein, 81 aa, Panicum virgatum
  misc_feature: Ceres CLONE 1871551
  misc_feature (1)..(80): Pfam Name: Metallothio_2 Pfam Description: Metallothionein
MSGCPATCACPSGYDCGSGCRWCNMYPDLTDKLTSTAWHTVIMGIAPANLEHAEGGYNAGSGTENGCTCGAYCTCYPCTCT

SEQ ID NO: 26653 - DNA, 737 bp, Panicum virgatum
  misc_feature: Ceres CLONE 1871630
  misc_feature: Encodes the peptide sequence at SEQ ID NO. 26654
attcgaggcggggccgcctgccagacgcctgcgccaacaccgccaggtcgctgccacgcccatcgcgatccttcttccactatccagtgcctgccctgcccgtctcttcctcctgagctgcactgcaccgcacgccaccggaggtcgtcgcaagtagggagcgtaagccaagcaaagctagctaaggtgctaagccggagccgatcaagctagtagcagccatggcggaggaggcgtcgtcggcgccggcgccggcgccagccggggcgaagatgacgatcgtggcgggggtggacgacagcgaccacagcttctacgcgctgcagtgggcgctcgaccacttcttcccgccggcgcagccgcagcagtaccgcctcgtcgtcgtcaccgcccagccctccgccgcgtccgccgtcgggctcgccgggccgggcgcggcggacgtgctgccgttcgtggaggcggacctcaagcgcgtcgcgctgcgcgtcctcgacagggccagggagctctgcgccgccgcgcaggtggccgacgccgagttcgaggcaatcgagggcgacgccaggagcgtcctctgcgacgccgtcgagaggcacctcgccgagatgctcgtcgtcggcagccacggctacggcgccatcaaaagggctgttcttggaagcgtgagcgattactgtgcccaccacgcgcactgcagcgtgatgatcgtgaagaagcccaagaccaagcactaa

SEQ ID NO: 26654 - protein, 171 aa, Panicum virgatum
  misc_feature: Ceres CLONE 1871630
  misc_feature (18)..(165): Pfam Name: Usp Pfam Description: Universal stress protein family
MAEEASSAPAPAPAGAKMTIVAGVDDSDHSFYALQWALDHFFPPAQPQQYRLVVVTAQPSAASAVGLAGPGAADVLPFVEADLKRVALRVLDRARELCAAAQVADAEFEAIEGDARSVLCDAVERHLAEMLVVGSHGYGAIKRAVLGSVSDYCAHHAHCSVMIVKKPKTKH

SEQ ID NO: 26655 - DNA, 867 bp, Panicum virgatum
  misc_feature: Ceres CLONE 1871681
  misc_feature: Encodes the peptide sequence at SEQ ID NO. 26656
gaaggcgtcaacccaccacccgacgacgacgaagcttagctgccgcgcacaaataaacctccggcgaccaaattccccacccctaccccgatcaagccgcgctagtgtttcctctgccctcctcacgaccccgcgatgccgaagaacaaggggaagggaggcaagaaccggaagcggggcaagaacgaggcggacgacgagaagcgggagctggtgttcaaggaggacgggcaggagtacgcgcaggtgacgcggatgctgggcaacggccgctgcgaggcgctctgcatcgacggcaccaagcgcctctgccacatccggggcaagatgcacaagaaggtctggatcgcggccggggacatcgtcctcgtcggcctccgcgactaccaggacgacaaggccgacgtcatcctcaagtacatgaacgacgaggcgcgcctgctcaaggcctacggcgagatccccgacaacgtcaggctcaacgagggtgtcgtcgacgaggaggacgccggcgcgcaggacgactacatacagttcgaggacgaggacatcgacaagatctgactgagatggtgatcggtaactgcgcgctatttctctgtgtcccgttgctgtgataattactacactatgtccttccgacctgaaactgaaaggatgcttgcgatgataagccgctgttgtaattatgttgtgtgttacgggcagtcagtcctctgtacaaggattggatttgggggctgctgtgctctgcccaataatcactggggagtccgtatggtgatatcacaagtgtgggattgaatcaaaatcctctctttgtgtaatttgattgggtttgatctctatgtctcttgcgttctaccg

SEQ ID NO: 26656 - protein, 142 aa, Panicum virgatum
  misc_feature: Ceres CLONE 1871681
  misc_feature (30)..(94): Pfam Name: eIF-1a Pfam Description: Translation initiation factor 1A / IF-1
MPKNKGKGGKNRKRGKNEADDEKRELVFKEDGQEYAQVTRMLGNGRCEALCIDGTKRLCHIRGKMHKKVWIAAGDIVLVGLRDYQDDKADVILKYMNDEARLLKAYGEIPDNVRLNEGVVDEEDAGAQDDYIQFEDEDIDKI

SEQ ID NO: 26657 - DNA, 549 bp, Panicum virgatum
  misc_feature: Ceres CLONE 1871700
  misc_feature: Encodes the peptide sequence at SEQ ID NO. 26658
atcgaagctccctagccccgcccacgctgatggcccaccagtgcccccaccgctgcctcgccgccctcctcatcctcctcgccgcggccgccggcgccggcgcggccacgccgaggcagctgttcctcgttaccccggcgcccgtgacgctgaccaaccaccacggccagctgctcacgggcaactactccgtgaccaacccgtacggcggcgggttcttccagggccccgccgaggcgccgctggaggccgtgacggcgtgcacgggcgtgttcggcgcgggcgcctacccggggtaccccgggcagctgccggtcgacgccgccaccggcgccagctacaacgcggtcggcgtcgccggccgacttttcctcctcccggccatgtgggaccccaagacctcgcagtgctccaccctcgtgtagcggacgctacgtacactaggatcggaggtagaggtcggacgaaatgggtgttggcttggtgtaaatgatgacgatcgaagggtgcggagctccgctggtagactaggtggcggcctttgtggtt

SEQ ID NO: 26658 - protein, 131 aa, Panicum virgatum
  misc_feature: Ceres CLONE 1871700
  misc_feature (1)..(131): Pfam Name: Phi_1 Pfam Description: Phosphate-induced protein 1 conserved region
MAHQCPHRCLAALLILLAAAAGAGAATPRQLFLVTPAPVTLTNHHGQLLTGNYSVTNPYGGGFFQGPAEAPLEAVTACTGVFGAGAYPGYPGQLPVDAATGASYNAVGVAGRLFLLPAMWDPKTSQCSTLV

SEQ ID NO: 26659 - DNA, 523 bp, Panicum virgatum
  misc_feature: Ceres CLONE 1871715
  misc_feature: Encodes the peptide sequence at SEQ ID NO. 26660
tgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcgactgtggctacatcggtaggttctgtgccggtctgagccgggatggctgcggcgtctgcccctctgcgtggagtgcatgtgtccggtggcggtgtgtatgg

SEQ ID NO: 26660 - protein, 142 aa, Panicum virgatum
  misc_feature: Ceres CLONE 1871715
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYGDCGYIGRFCAGLSRDGCGVCPSAWSACVRWRCV

SEQ ID NO: 26661 - DNA, 349 bp, Panicum virgatum
  misc_feature: Ceres CLONE 1871720
  misc_feature: Encodes the peptide sequence at SEQ ID NO. 26662
atcccatctcctctcgctctctgttgtgcgactgattgccaaaaaagctctctgcttggttgtgtgccaccctctgaatctcgtgaggatgtcctgctgcggaggcgactgcgggtgcggcgacggctgcaagtgcggctccggctgcggagagggccagatgtacctggacatgactgagcaggacaccaccaccgccagcccgactgtcatctggggcgttccacacaccaagaaggggcacgcccaggtcggatttgaggcccccacctgagccaacaacgggttccactgcggcgccaactgcacctgcaaccgcttcacctgcaaattaggagctcttggccat

SEQ ID NO: 26662 - protein, 61 aa, Panicum virgatum
  misc_feature: Ceres CLONE 1871720
  misc_feature (1)..(59): Pfam Name: Metallothio_2 Pfam Description: Metallothionein
MSCCGGDCGCGDGCKCGSGCGEGQMYLDMTEQDTTTASPTVIWGVPHTKKGHAQVGFEAPT

SEQ ID NO: 26663 - DNA, 697 bp, Panicum virgatum
  misc_feature: Ceres CLONE 1871737
  misc_feature: Encodes the peptide sequence at SEQ ID NO. 26664
aggtcccgccgagcgccggctcagaagagggaaaaggagagagggagagagggagagagagagagagagagagagagagagagagagaagaaatcgatggcgacgggcggcggcgacaacggcggcgctgcgggcgacggcgagttctacctccggtactacgtggggcacaagggcaagttcgggcacgagttcctcgagttcgagttccgccccgacagcaagctccgctacgccaacaactccaactacaagaacgacaccatgatccgcaaggaggtcttcgtctccccctccgtcctccgcgaggccaggaggatcatccaggagtccgacattatgaaggaggacgacagcaactggccggagcccgaccgcatcggccggcaggagctcgagatcgtcatgggcaacgagcacatctccttcaccacctccaagatcggctccctcgtcgatgtccagtccagcaaggaccccgagggcctccgcatcttctactacctcgtccaggatctgaagtgttttgtgttttcgctcatcaacctccacttcaagatcaaaccaattcagtcctgagctccattccatgctgttccgtgactgtgttatgaaactgcgagtgtttaagagagaaccctgtaccatgtaagatcctatttagcttgtgatgatgcactcgggttgtgtggagcat

SEQ ID NO: 26664 - protein, 160 aa, Panicum virgatum; identical to SEQ ID NO: 12560
  misc_feature: Ceres CLONE 1871737
  misc_feature (16)..(158): Pfam Name: Mago_nashi Pfam Description: Mago nashi protein

SEQ ID NO: 26665 - DNA, 748 bp, Panicum virgatum
  misc_feature: Ceres CLONE 1871741
  misc_feature: Encodes the peptide sequence at SEQ ID NO. 26666
agagagataggaagccgcagtgaagtcgccggcgccgccgcgacaggaggacccggcgatctcgacggcggccccgtggtgagggaggaagcggaggcgcggcaggatgcactcgttcgggcaccgcgcgaacgcggtggcgacgttcgcggtcaccatactggccgcgatgtgcttcgccgcctccttctccgacaacttcaacacccccgcccccaccgcctccgtcaagatcttgaacataaactggttccagaaggaggcaaacggcaacgacgaggttagcatgacgctgaacatctcggcggacctttcgtctctgttcacgtggaacacaaaacaggtgtttgtctttgtggcggctgagtatgaaactccccaaaattctttgaatcaagtttccctttgggatggaattatacctgcaaaagagcatgccaagtttttgatccatactacaaacaagtacagatttattgaccagggaagcaatctgaagggcaaggaattcaacttgacaatgcattggcacattatgccaaagactggcaagatgtttgcagataagatcgttatgacaggttataggctcccggagcagtacagatagtctgaaagatcctgaacatcgaagactgggagcagagacctgcaagaagttttagtagcagtggcatagctgatactgagccttttgttctagtctatgacgaaacatgtatcttatgagcttgtactttagctgaaa

SEQ ID NO: 26666 - protein, 167 aa, Panicum virgatum
  misc_feature: Ceres CLONE 1871741
  misc_feature (1)..(167): Pfam Name: SPC22 Pfam Description: Signal peptidase subunit
MHSFGHRANAVATFAVTILAAMCFAASFSDNFNTPAPTASVKILNINWFQKEANGNDEVSMTLNISADLSSLFTWNTKQVFVFVAAEYETPQNSLNQVSLWDGIIPAKEHAKFLIHTTNKYRFIDQGSNLKGKEFNLTMHWHIMPKTGKMFADKIVMTGYRLPEQYR

SEQ ID NO: 26667 - DNA, 707 bp, Panicum virgatum
  misc_feature: Ceres CLONE 1871781
  misc_feature: Encodes the peptide sequence at SEQ ID NO. 26668
gtgactcccgtttcattctccatcttcccttcacggggagggtcagagccgccaccggtgctcccaggggtcgccgcccccaggattcgccgccgtctctaggaggccgccgcccaaggaatcgctgcggctgcccccagcagctgccgcctccaggagccgcgggccgccaccccaaggagccgctgcggcccccagcagcagccgaccccaggagccgacgctgcccccagcagctgcactccccccaggcccctacacgcgagatccagaggctcctggggagagcgcgtccaggacagagcgcagaggcaacagcagcatccccttcgtctagatctgagaagcgtagcatggcgaagctcaagccaaaggcgttgctggcacagagcaaagtgaagaagggccctagccaaatcagtgtgatcacgatcttcacctacttggtccttggtgtcgtagtcgtatcctctgtttatgctgcttacaaatactgggtaggcaaaggaccagaagtgacaacagcaggcgtcgaggggaattaaaccccaaactatgtaactgattttgttgttgtatcatccagttggataattttggttgctgcagcccagttaatggaacatggatagattgtatcttgctacaggtttattgtaaaccgtggggacattatactgatatatgtatgctaaattcctttcctc

SEQ ID NO: 26668 - protein, 63 aa, Panicum virgatum
  misc_feature: Ceres CLONE 1871781
  misc_feature: SWISSPROT Homolog: EC 5.2.1.8 Peptidylprolyl isomerase
MAKLKPKALLAQSKVKKGPSQISVITIFTYLVLGVVVVSSVYAAYKYWVGKGPEVTTAGVEGN

SEQ ID NO: 26669 - DNA, 963 bp, Panicum virgatum
  misc_feature: Ceres CLONE 1871796
  misc_feature: Encodes the peptide sequence at SEQ ID NO. 26670
atcagctatacatacaagttctctgacacaacctgcagcctcctagctagaataaagcatcctcctgaagaagtgaagaggtagccagacatggcctcctccaagttgtttcttcactttgttcttctcgccttgatcgcttgtggggccgtggcttcggatcccagtcctctccaggacttttgtgttgctgacaaagactcacctgtacgggtcaatgggttaccatgcaaggatatgaaggatgtgaaggtagatgacttcttccttgcagctaatctggacaagccaatggatactactctgaataaggtcaagtcaaacgtcaccctgatcaatgcgatgaagctcccaggtctgaacaccctcggcatctccatggcaaggattgattacgctcctcgaggacagaaccctccacacacacacccccgcgccacagagatcctaacagttcttgagggatccctctatgttggcttcgtcacatctaaccctgacaacaagttcttcagtaagatgctgaacaaaggagacgttttcgtgttcccgcagggcctaatccacttccagttcaatccgagctatgacaagccagctgttgccatcgctgcactgaacagccagaaccctggcgcgataaccattgccaatgctgtatttggatcccacccaccaatcgcagatgatgttcttgctaaggcttttcaggtggacaagaaggttgtggattggcttcaagctcagttttgggaaaattaccacaactaagttaacatttcttgtcatggtttatatttagatgcgtaaccaaaactgtgcgtgcttcatttttgtatgtgatgtagcagactggttaagttatttatttatttacagattgtgcaaaacaataaatgaccttatttgtaatatctaatgctgtattgattagagtgctgttaatttaattattatatgctt

SEQ ID NO: 26670 - protein, 226 aa, Panicum virgatum
  misc_feature: Ceres CLONE 1871796
  misc_feature (62)..(214): Pfam Name: Cupin_1 Pfam Description: Cupin
  misc_feature: SWISSPROT Homolog: EC 1.15.1.1 Superoxide dismutase
MASSKLFLHFVLLALIACGAVASDPSPLQDFCVADKDSPVRVNGLPCKDMKDVKVDDFFLAANLDKPMDTTLNKVKSNVTLINAMKLPGLNTLGISMARIDYAPRGQNPPHTHPRATEILTVLEGSLYVGFVTSNPDNKFFSKMLNKGDVFVFPQGLIHFQFNPSYDKPAVAIAALNSQNPGAITIANAVFGSHPPIADDVLAKAFQVDKKVVDWLQAQFWENYHN

SEQ ID NO: 26671 - DNA, 642 bp, Panicum virgatum
  misc_feature: Ceres CLONE 1871830
  misc_feature: Encodes the peptide sequence at SEQ ID NO. 26672
ctaggacctcctcggccccgccgccggggacggccgcgccgcagccggcggaggcggtggtgctgcggctgaagcggcggggcaagaagaaggtgtcgtggaaggaggggacggtggacaacgagggcctcggccgcaagagctccaagaagtgctgcatcttccacaaggaggtccccttcgacgaggactgcagcgacgacgagggccccggcggcgggcaccggtgcccgcggggagatgctggcgagggcaccaacggcagcggcggatgcccgtcgtcctcccacgaccacagccatcaccaccactgatctcggcagctttgatgggcctcttcgtcaatacctgaagtaattggttatcctgccaaggaaactgatgcttctttatgccggcttttagtgaaaagttactgtacttttatgctgatgctaagctagtattacctcatatcggaacttgcaagagacaaccattgggccaggcattgttaggctgcagcttctatgattgatgtattgttctggcgtccaaatatatattttgagatgaaatctttttcctgttattattgtcatagttttaattgtctcaatgttactaaatctgtttcttctaaggcaattcactggtccaatt

SEQ ID NO: 26672 - protein, 103 aa, Panicum virgatum
  misc_feature: Ceres CLONE 1871830
  misc_feature (20)..(68): Pfam Name: PPI_Ypi1 Pfam Description: Protein phosphatase inhibitor
RTSSAPPPGTAAPQPAEAVVLRLKRRGKKKVSWKEGTVDNEGLGRKSSKKCCIFHKEVPFDEDCSDDEGPGGGHRCPRGDAGEGTNGSGGCPSSSHDHSHHHH

SEQ ID NO: 26673 - DNA, 747 bp, Panicum virgatum
  misc_feature: Ceres CLONE 1871842
  misc_feature: Encodes the peptide sequence at SEQ ID NO. 26674
accttagctcccagcgcccagcggcggcgagaagcgattgggcggagggcccggcggggttgggttcccgcgggagcgacggcggcgcgatgccgcggcgcgggcgcgtggagctgcggcggatcgaggaccgcgtcagccggcaggtgcgcttctccaagcgccgcgcggggctcttcaagaaggccttcgagctctcgctgctctgcgacgccgaggtcgcgctcctcgtcttctcccccgccggcaagctctacgagtacgcctccgcaagcatacaagatacgtacgaccgctatcagcaattcgccggaccagcaggagacgagaatggagatcgaaatggaaacgatcgatctgatctttcaaaaaaaaaagggaacgatcaaaagatctcgaacaaggatgaagcttcttcagatttgcagtcgacgctcagagagattgtaacctggtgtctccagagcaatgctgacgaatcagatgccaatgagctagacaagttggaaaatcttttgagaaatgctttgagggatacgaaatccaagaagatccagcttctggcgaaacaaaatggtggagacggagcaagcggccagagctgcaatgtaggcatgtagctataaggcaggagcatggaacagcgtgagcacggaattgaactgttgcagctcgcgaatgaaacagaacattttgggtcttttctttgagttggttccccttattactgatttgatgcctgtactg

SEQ ID NO: 26674 - protein, 176 aa, Panicum virgatum
  misc_feature: Ceres CLONE 1871842
  misc_feature (10)..(60): Pfam Name: SRF-TF Pfam Description: SRF-type transcription factor (DNA-binding and dimerisation domain)
  misc_feature: Functional homolog of the protein sequence given in SEQ ID NO 50571
  misc_feature: Useful for making plants with modulated flowering time
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1963 in the 10/412,699 US patent application
MPRRGRVELRRIEDRVSRQVRFSKRRAGLFKKAFELSLLCDAEVALLVFSPAGKLYEYASASIQDTYDRYQQFAGPAGDENGDRNGNDRSDLSKKKGNDQKISNKDEASSDLQSTLREIVTWCLQSNADESDANELDKLENLLRNALRDTKSKKIQLLAKQNGGDGASGQSCNVGM

SEQ ID NO: 26675 - DNA, 762 bp, Panicum virgatum
  misc_feature: Ceres CLONE 1871848
  misc_feature: Encodes the peptide sequence at SEQ ID NO. 26676
agtaattatgctgggatgttcttcattctgctttttgcctccatctttgctaccggtattctggagcttcgatggagtggtgtcggtattgaggactggtggagaaatgagcagttttgggtcattggtggcacctctgcacatctctttgctgtattccagggtctgttgaaagtgttggcagggattgacacaaactttacagttacgtcaaaggcaactgacgatgagggtgattttgctgagctatatgtgttcaagtggaccagccttctaatccccccgaccacggtgctcgtgatcaacctagtgggcatagtggcaggagtgtcatacgctatcaacagtggctaccaatcctggggtccgctttttgggaagcttttcttctcaatctgggtgatcctccacctctaccctttcctgaagggtctcatggggaaacagaaccgcacaccgaccattgtcatcgtctggtctgtcctcctcgcttccatcttctcgctgctgtgggtgaagatcgatcctttcatttcacctacacagaaagctctttcccgggggcaatgcggcgtaaactgctgatctgatctgaactgctcgctggattgtaacatggcacagcctcaatcaaagtctaccccacttcgtgtaaatacctgaggaggttaggcaagattttgtcagtagatggagaagaagatgcgttgtccaagttatgcggttgtgtggtgggcatcgtaaaaactgtcaactttatgt

SEQ ID NO: 26676 - protein, 194 aa, Panicum virgatum
  misc_feature: Ceres CLONE 1871848
  misc_feature: SWISSPROT Homolog: EC 2.4.1.12 Cellulose synthase (UDP-forming)
  misc_feature: The sequence is a functional homolog of SEQ ID NO 6 in US patent 7285702
  misc_feature: Functional homolog of the protein sequence given in SEQ ID NO 50499
  misc_feature: Useful for making plants with altered cell wall content and/or composition
  misc_feature: Useful for making plants with modulated biomass
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
  misc_feature: Functional homolog of the protein sequence given in SEQ ID NO 50125
  misc_feature: Useful for making plants with modulated plant growth and development
SNYAGMFFILLFASIFATGILELRWSGVGIEDWWRNEQFWVIGGTSAHLFAVFQGLLKVLAGIDTNFTVTSKATDDEGDFAELYVFKWTSLLIPPTTVLVINLVGIVAGVSYAINSGYQSWGPLFGKLFFSIWVILHLYPFLKGLMGKQNRTPTIVIVWSVLLASIFSLLWVKIDPFISPTQKALSRGQCGVNC

SEQ ID NO: 26677 - DNA, 641 bp, Panicum virgatum
  misc_feature: Ceres CLONE 1871853
  misc_feature: Encodes the peptide sequence at SEQ ID NO. 26678
attcagctgactgtgctcgatcatcacgcaatgagaaagcctcccaattatcatttcatcacatcatcttccttcttccaagatgtcgtgcacgctgccgatcatgctgcgactgccggtccgactgcgagcgcagcaagatgtaccctgaccttgaggagaagagcagcggcggcgctcacgccaccatcgtcctcggcgtggccccggagaagaaggccggccagttcgaggcagcggcggagtccggcgagaccgcccacgcctgcaagtgcggtaacagctgcagctgcgacccctgcaactgctgatttcgatggggaacatcagaacacacctgcatgcatgctagctactacctactactctgcttgtgtgtgacgatgattgaacaagaataaggatgagcctgagccatcatgtctcatggatcggtttggctccggcctcatcgagcatgcatgcgtctgcccctgtgtgtgctttgctaccttcccttaccctgtgctgcttggcgtccgtcctgtgtctgtatgtgttgatcattgcaaataaaccatgcaggcatacatctctgcatgtgtctctgtaatgatcggtccagagtgatgaatatataaaactggtttgctttatctgcc

SEQ ID NO: 26678 - protein, 102 aa, Panicum virgatum
  misc_feature: Ceres CLONE 1871853
  misc_feature (33)..(102): Pfam Name: Metallothio_2 Pfam Description: Metallothionein
SADCARSSRNEKASQLSFHHIIFLLPRCRARCRSCCDCRSDCERSKMYPDLEEKSSGGAHATIVLGVAPEKKAGQFEAAAESGETAHACKCGNSCSCDPCNC

SEQ ID NO: 26679 - DNA, 585 bp, Panicum virgatum
  misc_feature: Ceres CLONE 1871865
  misc_feature: Encodes the peptide sequence at SEQ ID NO. 26680
ttaaactcaagcaggcctgcctcttcttctctttatttaatgttctagtaatataagcaagcatacactaccaagccaagccatggcccccaccgtgatggcctcgtcggccacctccgtggttcctttccagggcctcaagtccaccgctggcctccccgtcagccgccgcgcccaatgctccggtttcggcaacgtcagcatcggcggaaggatcaggggcatgcaggtgtggccaacgaaaaacaacaaaaagttcaaaaccctgtcgtacctgccccccctctccacggagaacctcctgaagcaggtcaactacctgatccggaacaactgggtcccctgcctcaagttcagcaaggtcggcttcttcttccgcaaaaattttttttcccccgggtactacaacggccgctactggaccatgtgaaagctgcccatgttcggctgcaccgaccccacccaggggtacgccaagctcaagaagtgcaaaaaggcctaccccaacaactacttccgcatcctcggtttcaacaaggtcaggcaggtgcagtgcgtcatgttcatcgcctacaagcccccggc

SEQ ID NO: 26680 - protein, 115 aa, Panicum virgatum
  misc_feature: Ceres CLONE 1871865
  misc_feature (58)..(114): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMASSATSVVPFQGLKSTAGLPVSRRAQCSGFGNVSIGGRIRGMQVWPTKNNKKFKTLSYLPPLSTENLLKQVNYLIRNNWVPCLKFSKVGFFFRKNFFSPGYYNGRYWTM

SEQ ID NO: 26681 - DNA, 719 bp, Panicum virgatum
  misc_feature: Ceres CLONE 1871870
  misc_feature: Encodes the peptide sequence at SEQ ID NO. 26682
accagcgcagtagccagccgagccacctcaccccacctcgccgctcgcgatggcggtcatgcgcgtcgcggtggccgccgcactccttgccgcgccgccctcctcccgccgccgccgggccgtgctcccctcctcctgccggcctctccccacctcccgcgtgtccaaggcgctgcacgccgccgcccccgccgcaggcgcggtcgacgaggagacccccgccgcgtcgccttcctcagattctagcaagggagtggagaacttggtgatcattggttccggcccggccgggtacactgctgcaatctacgctgccagggcaaacctgaagcccgtcgtgttcgaaggttaccaggcgggtggtgtccctggtgggcagctgatgaccacgaccgaggtggagaatttcgctgcacaaggggaggggagggtgacgggagggtttcgtggaggtcgagctgccgcgccgccttcgtgtccgatggtttgcgcgggggacgccacgccggaaggccgccggatccacctcgccgccgctcccgttcccttctgagcctcggcggcgatggcgctccagacggccaggcggcgacggacgcttctgccaactccataaatctggcccaaagcccatcatcgctactgggcgcggcgaggcgcgcggcccacctagtgaccctattatctatcctgggcagcggcaccgtgctgcatgccgc

SEQ ID NO: 26682 - protein, 167 aa, Panicum virgatum
  misc_feature: Ceres CLONE 1871870
  misc_feature: SWISSPROT Homolog: EC 1.8.1.9 Thioredoxin-disulfide reductase
MAVMRVAVAAALLAAPPSSRRRRAVLPSSCRPLPTSRVSKALHAAAPAAGAVDEETPAASPSSDSSKGVENLVIIGSGPAGYTAAIYAARANLKPVVFEGYQAGGVPGGQLMTTTEVENFAAQGEGRVTGGFRGGRAAAPPSCPMVCAGDATPEGRRIHLAAAPVPF

SEQ ID NO: 26683 - DNA, 729 bp, Panicum virgatum
  misc_feature: Ceres CLONE 1871872
  misc_feature: Encodes the peptide sequence at SEQ ID NO. 26684
agagctgcacgggcacccctcccctcgtgattgaactcgctggctcgcaaggaacgctccagcttccatctaggatccgaaaggaactggccaccagctcgtccttcgctcctcttcttcccccagtgaggagcaagcttgcgacatctgagctcgtttctttcttgctctgttcttcttcttcatctccggtgggctgcgcgatggcgacggcgttggcgctggcggccgccgtgctcctcttgtcctccacgctcgctgcttcagagttctgcgtgtgccggccggaccagccgacgacggcgcagcagaaggtgatcgacttctcgtgcggggacggcgcggactgctcgtcgatcctacagggcggcggctgctacaaccccaacaccgtcgccgcgcactgctcctgggccgccaacagctactaccagaacaacaaggccaagggcgccacctgcgacttcggcggcgccgccgccatctccaccaccgaccccagtttctccgggtgcactttcccttcgactgccagtgcttccgggacgacgggcaccacgaccgttggcggcgcgacgtcgacgggcaccctgagccccggcgtgggcaccgggttcaacggcacggcggtgggcagcggcggcctggggccggcgggcaccatggacagcgccgcggccggcctgctccccggcaccttcctcgccgctgccatcctctcgctcctag

SEQ ID NO: 26684 - protein, 175 aa, Panicum virgatum
  misc_feature: Ceres CLONE 1871872
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50404
  misc_feature: Useful for making plants with altered carbohydrate content
  misc_feature: Functional homolog of the protein sequence given in SEQ ID NO 50405
  misc_feature: Useful for making plants with altered alkaloid content
MATALALAAAVLLLSSTLAASEFCVCRPDQPTTAQQKVIDFSCGDGADCSSILQGGGCYNPNTVAAHCSWAANSYYQNNKAKGATCDFGGAAAISTTDPSFSGCTFPSTASASGTTGTTTVGGATSTGTLSPGVGTGFNGTAVGSGGLGPAGTMDSAAAGLLPGTFLAAAILSLL

SEQ ID NO: 26685 - DNA, 571 bp, Panicum virgatum
  misc_feature: Ceres CLONE 1871892
  misc_feature: Encodes the peptide sequence at SEQ ID NO. 26686
cacgaggtcgctcgttcatattttcgacttccttgccggtgtctgtggttgcttctgtcaatgcggcgatctatgtctcaaagaaggagatatggcgaagatcaattatttgggatcatgtgcggtattttgcttctttgaccaaacttgagataactagtcccatcattgtcattgtagttggaagtgaagaagcagctgtcagagctcacaggcatcttctaagatctggatttcttgtccaaccaatacgaccgcccgtagtgccacccaactcatctaggttgcgaattacccttagtgcagctcattcttcggatgacatcaaaaggcttgttgatgcgctcactccctggctccctattaatcatgctgagcagagttacgctgcatcttcaagactataaggaatggaccatctactgcgttggtgtatgcccaagaaccatcatggggataattgtatctcacttctgcatttgatataattttgaacaatgtgtttttttttggccaggagatggaacaatgcgttattctctgtttgttggataattatcttttttaacat

SEQ ID NO: 26686 - protein, 134 aa, Panicum virgatum
  misc_feature: Ceres CLONE 1871892
  misc_feature: SWISSPROT Homolog: EC 2.3.1.47 8-amino-7-oxononanoate synthase
RGRSFIFSTSLPVSVVASVNAAIYVSKKEIWRRSIIWDHVRYFASLTKLEITSPIIVIVVGSEEAAVRAHRHLLRSGFLVQPIRPPVVPPNSSRLRITLSAAHSSDDIKRLVDALTPWLPINHAEQSYAASSRL

SEQ ID NO: 26687 - DNA, 727 bp, Panicum virgatum
  misc_feature: Ceres CLONE 1871946
  misc_feature: Encodes the peptide sequence at SEQ ID NO. 26688
ctcaggcatttcttcgtctccacagctcccgccgcagccgccgccgcttggggtcagtgcgttcctcgccaccgggcaccggcgcctcctcgttcgcgcggcgaccatggcagagcagacggagaaggctttcttgaagcagcccaaggtgtttctctgtcccaagaaggctgccaaggggaacaagcctggcaagggtgggaacaggttctggaagaacatcggccttgggttcaagacccccagggaagccattgaaggaacctacattgataagaaatgcccattcactggcactgtgtctatcaggggtcgcatcattgctggaacatgccacagtgccaagatgaacaggaccatcattgttcgtaggaattaccttcactttgtcaagaagtaccagaggtatgagaagaggcactccaacatccccgcacacatttcaccatgcttccgcgtgaaggaaggagaccatgtgatcattggccagtgcagaccactatcaaagactgtgaggttcaatgtgctcaaagtcattccggcaggttcaaagagtagagcagtgaagaaagctttcacggctgcttaagatgatgatgagtaacccatctgagggcctgaaaagcctttgttataccattttgatgctgtctagcctttttcttttcatatctactgtgtactaggaacttgaatcacttccagtgcttgaaatcgtggaaatttc

SEQ ID NO: 26688 - protein, 160 aa, Panicum virgatum
  misc_feature: Ceres CLONE 1871946
  misc_feature (74)..(143): Pfam Name: Ribosomal_S17 Pfam Description: Ribosomal protein S17
MAEQTEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSRAVKKAFTAA

SEQ ID NO: 26689 - DNA, 626 bp, Panicum virgatum
  misc_feature: Ceres CLONE 1871986
  misc_feature: Encodes the peptide sequence at SEQ ID NO. 26690
ccatatcggcgtctctccggcagctgcgccgcggcctggatcgcgtcccccgccggagccaccatggctgggaagcttgtcgcaaacctgattgtcatgggctctgcggtaataggaagagctatgcttcaggcatatcgtaaagcgcttgataatgcaaataagactggtgtggcccatgaggcaataaataatatccgcagagccagtaaaacaatgaccgagcaggaagcgaggcagatactgggtgtatcagagaattcatcctgggaagagattgtacagcggtacgataacttatttgaaagaaacgccaaagctgggagtttttacctccaatcgaaggttcaccgagccaaggagtgcctagaaactgtgtaccaaaagaacaagcaagatgaacctcctacttgagatcccattcctcaagtccagttgagattctttttcccctcataagaaaaatgtacataacagcaaaggtcgctgctgttgtatcactagtgtgcagcgtggaaccaataaggctgatctgttaagcgcagctgctgcgaacctgtacaagactgatctgttaattaagggcttaaggcgtaagggacactggcgcagtggggcgtgcctgt

SEQ ID NO: 26690 - protein, 116 aa, Panicum virgatum
  misc_feature: Ceres CLONE 1871986
  misc_feature (1)..(116): Pfam Name: Pam16 Pfam Description: Pam16
MAGKLVANLIVMGSAVIGRAMLQAYRKALDNANKTGVAHEAINNIRRASKTMTEQEARQILGVSENSSWEEIVQRYDNLFERNAKAGSFYLQSKVHRAKECLETVYQKNKQDEPPT

SEQ ID NO: 26691 - DNA, 673 bp, Panicum virgatum
  misc_feature: Ceres CLONE 1872012
  misc_feature: Encodes the peptide sequence at SEQ ID NO. 26692
cacccatggtgcgatacagttcacggcctatgaggaacttcgcaaagctatgatatttatgaaaactacacaaacaaggacagaagatagaggaggcgaggagtcattgaattctattgacttcgcggcacttggagctagttcaaaagtagctgctattttacttacctatccttatcaggtcatccgagcccgcttgcagcaacggcctgggagtgatggtactccaaagtactcgaatagctggcatgtggtgaaggaaactgcaaagtatgaaggtgtccgtggattttacaggggcatcacgtccaacctattgaaaaaccttcctgcggcttccctcacgttcgtggtgtatgaaaatgtaatcaaactattcaaagcagccaaggagaagacgtagtgaaatccaagtaaaacagagaaggaagaaaagaatattgagatttgtaacactcccggattcatggtcataccctacagtttccacttcagggttgagtccatatctcggtcgtttagcatcccagactacagatttgcagccgtagaggttgtgggcttgtgtctaacatgataagtgggaaattttgtttcgagaaatttgcattttgtagagggaaggagcattttttatgtttcttccaggtgaacagtacactgctaatggtcg

SEQ ID NO: 26692 - protein, 133 aa, Panicum virgatum
  misc_feature: Ceres CLONE 1872012
  misc_feature (37)..(130): Pfam Name: Mito_carr Pfam Description: Mitochondrial carrier protein
THGAIQFTAYEELRKAMIFMKTTQTRTEDRGGEESLNSIDFAALGASSKVAAILLTYPYQVIRARLQQRPGSDGTPKYSNSWHVVKETAKYEGVRGFYRGITSNLLKNLPAASLTFVVYENVIKLFKAAKEKT

SEQ ID NO: 26693 - DNA, 667 bp, Panicum virgatum
  misc_feature: Ceres CLONE 1872027
  misc_feature: Encodes the peptide sequence at SEQ ID NO. 26694
gaccaaatctcgcggcgactgcaactcggagccccggcggaagaccacgccctcgcttctgaaggtctgatctccggccggtgcgaccacaggcgaatcgaagatgcagcagggggacggcacggaggcgctggtgacgtgggaggaccaacagaatatcaaccgcttcggccgcctcaacaaccgcctccacgagctccaggacgagatcaagctcgccaaggaagcaaatgaaaacctagacgatgctgggaacgagctcatcttgtcagatgaagatgtggtacggttccagattggggaagtgtttgcccacatgccaagggacgacgtcgagactaggctggagcagatgaaagcggacgcggcgaagaagctggagaggctggaggaggagaaggaatccatcctcgcccagatggccgagctgaagaaaatactgtacggaaagttcaaggatgccatcaacctggaggaagattagcagaagataatgtacggaaagttcaaggatgccgtcaaacctggaggaagattagcagcgagtacttgagctgttgcccgttcagttgtacgtcgctttttttagtgctgtttttcgctagcttgcgtaacagaagactgttgagcctgctgtattaaaaaaaacagaagacagttcacttcg

SEQ ID NO: 26694 - protein, 126 aa, Panicum virgatum
  misc_feature: Ceres CLONE 1872027
  misc_feature (16)..(120): Pfam Name: Prefoldin_2 Pfam Description: Prefoldin subunit
MQQGDGTEALVTWEDQQNINRFGRLNNRLHELQDEIKLAKEANENLDDAGNELILSDEDVVRFQIGEVFAHMPRDDVETRLEQMKADAAKKLERLEEEKESILAQMAELKKILYGKFKDAINLEED

SEQ ID NO: 26695 - DNA, 737 bp, Panicum virgatum
  misc_feature: Ceres CLONE 1872047
  misc_feature: Encodes the peptide sequence at SEQ ID NO. 26696
gacgcgattaatctccatcgccaagccttgacgaagtcctcctccttccccccgccaacacccacccagacagatcctgccgaccacggggggctccatgtccaccggcggcgcggcgagcccggcgctggcgccggacgcggacgcgccggccggcgaggccctggcgctggcgcagttcgcggcgtggtgcttctggagcgtggagctggtgtaccagcggctccccggcgtggcgcgcacggaggtgggctactcgcagggccgccgccacgcgcccacctaccgcgacgtctgcggcggcggcacggggcacgccgaggtggtgcgcgtgcactacgaccccgaggcctgcccctacggcgccctcctcgacgtcttctgggccaagcacaaccccaccacgctcaacagacagggcaacgacgtcgggacgcattacaggtcggggatctactactacacggcggagcaggagaggctggcgcgggagtcgctggcggagaagcagaaagagtggaaggacgccatcgtcaccgaggtcctgccggcgcggcggttctaccccgccgaggactaccaccagcagtacctggagaagggcggccagtccgcaaggaaggggtgcagcgaccccatccgatgctacgggtgagaggtcccgggtcacgtgacgcgcgtgctgcacattgtgtcactgtcaccggcaatgtatcagtacgtgtcaggatggatgt

SEQ ID NO: 26696 - protein, 185 aa, Panicum virgatum
  misc_feature: Ceres CLONE 1872047
  misc_feature (24)..(179): Pfam Name: PMSR Pfam Description: Peptide methionine sulfoxide reductase
  misc_feature: SWISSPROT Homolog: EC 1.8.4.11 Peptide-methionine-(S)-S-oxide reductase
  misc_feature: Functional homolog of the protein sequence given in SEQ ID NO 50429
  misc_feature: Useful for making plants with modulated flowering time
MSTGGAASPALAPDADAPAGEALALAQFAAWCFWSVELVYQRLPGVARTEVGYSQGRRHAPTYRDVCGGGTGHAEVVRVHYDPEACPYGALLDVFWAKHNPTTLNRQGNDVGTHYRSGIYYYTAEQERLARESLAEKQKEWKDAIVTEVLPARRFYPAEDYHQQYLEKGGQSARKGCSDPIRCYG

SEQ ID NO: 26697 - DNA, 735 bp, Panicum virgatum
  misc_feature: Ceres CLONE 1872051
  misc_feature: Encodes the peptide sequence at SEQ ID NO. 26698
agagaggccacaatccaaaaatctcccggcctctgcggcgctgccctgcccctatcgcttcggttcgccgccgccaccgcctccgcctccgcctccgcctcaggccctccctccgcctcctttcgctcgcccgcccgccatgtcgttgctcaccacggccactcccaccacctccgctcacttctccgcacccctcctctcctcctcccacgcgcaccgccggtacgtcgcggcaccactcggccgcatccgccgtccgcgcctggttcccgtcgtcgcctccgtccccgaccccgcggcggggccaatggagtacacgccctggctcatcgccggcctcggcaacccaggcaacaagtactacggcacgcggcacaatgtggggtttgagatggtggatcgaattgcactggaggaggggatcacgatgaacacaatccagtccaagtcgctgctgggagtaggttcaattggcgaggtgccagtcttgctggtaaaaccacaatcatacatgaactacagtggggaggcgattggacctcttgcagcctattatcaagtaccgttacgacacatcctcttggtttatgatgacatgagtctgcccaatggtgtactaaggattcaaaggaaaggtggtcatggtcgccacaatgggttacagaatgtgattgagcaattggatggccgccgggagtttcctcgtttatctatcggcattggtagcccgcccgg

SEQ ID NO: 26698 - protein, 198 aa, Panicum virgatum
  misc_feature: Ceres CLONE 1872051
  misc_feature (63)..(198): Pfam Name: Pept_tRNA_hydro Pfam Description: Peptidyl-tRNA hydrolase
  misc_feature: SWISSPROT Homolog: EC 3.1.1.29 Aminoacyl-tRNA hydrolase
MSLLTTATPTTSAHFSAPLLSSSHAHRRYVAAPLGRIRRPRLVPVVASVPDPAAGPMEYTPWLIAGLGNPGNKYYGTRHNVGFEMVDRIALEEGITMNTIQSKSLLGVGSIGEVPVLLVKPQSYMNYSGEAIGPLAAYYQVPLRHILLVYDDMSLPNGVLRIQRKGGHGRHNGLQNVIEQLDGRREFPRLSIGIGSPP

SEQ ID NO: 26699 - DNA, 721 bp, Panicum virgatum
  misc_feature: Ceres CLONE 1872053
  misc_feature: Encodes the peptide sequence at SEQ ID NO. 26700
acaggtccggaaaagcgaattgccttcctcctctcgcctctttctctactccctggattttccccccttcacgcagcaggggttctatatataggctcggtttttgcctcgcagggttgagagttcgttgttgtcggaaggggagctgagccttggacttggagatggcaagcttcagtgaagagaagagagcagctccgcagagggacgaggcaccttcccggagcaagtacggcggcatttcgccgaagaagcccctgatcagcaaggaccacgagcgcgcctacttcgactcggcagattgggtcctcggcaagcacggcgcgagcagcatcaacggcgcgacggtcccggccgccgagcccctcaagcccaagctgcagcggacggcgtaccaccagctccccccgcgaaggccggcgtgcacgtcggagtagctggcgcgcggctcccctgtcccgtcgcgtcggcggcgtcgctgctgctactgctagctcgtgatgcgcaggcggaacggtgctgtggatgtgaatgtgatgagcgatcactcacactatagggagccaggatccgtggagttggggccaattgggttgtaaatacggggacgcatgctgtcagcctgtcactgctcagcagtgtggagctatctgaaatgaagtgatcggtgcacccggcgtctcgtcttcactcttcagtcttcgttttggtttctgctgct

SEQ ID NO: 26700 - protein, 90 aa, Panicum virgatum; identical to SEQ ID NO: 18737
  misc_feature: Ceres CLONE 1872053
  misc_feature (20)..(90): Pfam Name: Lg106 Pfam Description: Lg106-like protein
  misc_feature: Functional homolog of the protein sequence given in SEQ ID NO 50181
  misc_feature: Useful for biocontainment applications

SEQ ID NO: 26701 - DNA, 628 bp, Panicum virgatum
  misc_feature: Ceres CLONE 1872056
  misc_feature: Encodes the peptide sequence at SEQ ID NO. 26702
catctgcaaaaccgccaggcgtccagcccagccgaactagggtttcctctcgccgccgccttccttctcgcctccacgcccaggtaagactgccggctctacttggtgagccgcacggatggcggaggaagccaatggaaagaaggaggaggaggaattcagcacaggccccctgtcagtgctgatgatgagcgtcaagaagaatacccaggttcttatcaactgccggaacaacaagaagttacttggtcgtgtgagggcatttgatcgacattgcaacatggttcttgagaatgttagggagatgtggactgagataccaaagactggtaaaggcaagaagaaggctcttccggtgaacaaagacaggttcataagcaagatgttcctccgtggggattcagtcatcattgttctcaggaacccgaaatgagttggacaactttgctagcttgctgtctagtctgtatgccaaacactccaaacatgggtgtataagagacgattcttgagacggatttatccgtagtgatggttgagtgttttagttggatgctgtgatgcacctcttgtattcactggtactttctatttggctcgatcatcagtatatcaaatttagaactct

SEQ ID NO: 26702 - protein, 104 aa, Panicum virgatum
  misc_feature: Ceres CLONE 1872056
  misc_feature (22)..(101): Pfam Name: LSM Pfam Description: LSM domain
MAEEANGKKEEEEFSTGPLSVLMMSVKKNTQVLINCRNNKKLLGRVRAFDRHCNMVLENVREMWTEIPKTGKGKKKALPVNKDRFISKMFLRGDSVIIVLRNPK

SEQ ID NO: 26703 - DNA, 740 bp, Panicum virgatum
  misc_feature: Ceres CLONE 1872059
  misc_feature: Encodes the peptide sequence at SEQ ID NO. 26704
gatttcgcatcgagagggaaacctaaaaccctgccctcctgatggcggcggcgaacggcggcgcctcgcggcgctcgcggccgaacgtgttggtgacggggacgccgggcacggggaagacgacgacgtgctccctcctctccgaagctgcgggcctccgccacgtcaacatcggcgacatcgtccgcgagaagagcctccacgacggctgggacgatgacctcgagtgccacgtcatcaacgaggacttggtctgcgacgagcttgaggacatgatggaagaaggtggtatactggtagattaccacggatgtgatttctttccagagcgttggtttgacctagtagttgtgctccagactgataactcaattctgcatgatcgcttgaccagcagaggctacacgggttccaagctctcaaacaacatagagtgcgagatcttccaagtgctcctggaggaggcgagggagagctacaaggaggacattgtcatgcccatgcgaagcgacaacgtggaggatattagtaggaacgtaggtacattgacagactgggtaaataactggagaccttcctgatgagctagttgacctggaacctatatgttggatcgtatgctttgtgtattgatttgtattgttttgacgaagtgggttttttcccctaacatatgtatgtctaatgtctgagattgtaagaatataattttgaatgtgtaaattattagtttggaattt

SEQ ID NO: 26704 - protein, 179 aa, Panicum virgatum
  misc_feature: Ceres CLONE 1872059
  misc_feature: SWISSPROT Homolog: EC 2.7.4.3 Adenylate kinase
MAAANGGASRRSRPNVLVTGTPGTGKTTTCSLLSEAAGLRHVNIGDIVREKSLHDGWDDDLECHVINEDLVCDELEDMMEEGGILVDYHGCDFFPERWFDLVVVLQTDNSILHDRLTSRGYTGSKLSNNIECEIFQVLLEEARESYKEDIVMPMRSDNVEDISRNVGTLTDWVNNWRPS

SEQ ID NO: 26705 - DNA, 726 bp, Panicum virgatum
  misc_feature: Ceres CLONE 1872119
  misc_feature: Encodes the peptide sequence at SEQ ID NO. 26706
tcaaggaagctttctgttgagcgatcggaccccagaaatcgacaactcctgcaaaaacgtcagtttttccattcccacagggcacagccaatggcaatggaacaagtcttctcggatcatgatagtgaagatgaagttgatgatgatattgccgactttgaggatagaaggatgcttgacgattttgttgatgttacaaaagatgagaaacttataatgcatatgtggaattcatttgttcgaaaacaaagggtgctagctgatggtcatataccttgggcctgtgaggccttctccagatgccatggccaacaacttgtgcaaaaccctgctctgctgtggggctggcgttttttcatgattaaactctggaaccacagccttcttgatgcccgtaccatgaatgcgtgcaacataattcttcaaggctaccaagacggaagtttaggccccaagtaaattccatgcaaagaaactgctaggcaacttgtgtaaaatggcatccgttgtaggtctggtagatccagaagttttccgaaccccccacggccccaccccacccaaaaaaaaaaaactttctgtagaagtagttggttggagggaaggcttaagagtccgcccctgggaagaaatggagggaatgatggggcaagccggcaaggcttgatctgtgaccaagacaatcattgtttcattcatgactcttattgactattgattgatact

SEQ ID NO: 26706 - protein, 152 aa, Panicum virgatum
  misc_feature: Ceres CLONE 1872119
  misc_feature: Functional homolog of the protein sequence given in SEQ ID NO 51222
  misc_feature: Useful for making plants with modulated flowering time
SRKLSVERSDPRNRQLLQKRQFFHSHRAQPMAMEQVFSDHDSEDEVDDDIADFEDRRMLDDFVDVTKDEKLIMHMWNSFVRKQRVLADGHIPWACEAFSRCHGQQLVQNPALLWGWRFFMIKLWNHSLLDARTMNACNIILQGYQDGSLGPK

SEQ ID NO: 26707 - DNA, 744 bp, Panicum virgatum
  misc_feature: Ceres CLONE 1872147
  misc_feature: Encodes the peptide sequence at SEQ ID NO. 26708
atgtagcaataccgaattaagtcaacaggcattacaaacaaaaactaggagggagataatgcttcttggcacgcagcttggtaagacaaacattgcagcatgggcaagcaagaaggaagaggaaaagaacgcatcactttcactgaaaacagtgcccatggaccaatcaacacagaacataactgaagtccgtgcagctgcatgggaggaggcagagaaggccaaatacttagccaggttcaaacgagaagagatcaagatccaggcatgggaggatcatcaaaaggccaaaattgaagctgaaatgagaaaaatcgaagttgaagtggagaggatgcgtgcccgtgctcaagacaagttgatgacccagctcgcatcagcaaggcacaatgcagacgagaagcgtgctgctgcggagctgaaaaggaaccgtgcggcagcaaggacagccgaacaggcagagcacatcaggagaacgggccgagtgccgccctcctttggctgctggaactggtgctcgtaggaagcaatctagtgcctctcctccctctgcccctgtgaagcatctcgcctgttactgtctactagtgaaatgaatatcgaatgtcttataggatcttccttttggattggttcagtagatatgtgacagaagaagagtgaatcagctgtaactatatatataagatgtgtgcctcatggcgtttgtgctgtgcagttactgtcagagtcacagatgtctcg

SEQ ID NO: 26708 - protein, 173 aa, Panicum virgatum
  misc_feature: Ceres CLONE 1872147
  misc_feature (56)..(167): Pfam Name: Remorin_C Pfam Description: Remorin, C-terminal region
  misc_feature: The sequence is a functional homolog of SEQ ID NO 1040 in the 10/666,642 US patent application
  misc_feature: The sequence is a functional homolog of SEQ ID NO 264 in the 10/666,642 US patent application
  misc_feature: The sequence is a functional homolog of SEQ ID NO 1041 in the 10/666,642 US patent application
CSNTELSQQALQTKTRREIMLLGTQLGKTNIAAWASKKEEEKNASLSLKTVPMDQSTQNITEVRAAAWEEAEKAKYLARFKREEIKIQAWEDHQKAKIEAEMRKIEVEVERMRARAQDKLMTQLASARHNADEKRAAAELKRNRAAARTAEQAEHIRRTGRVPPSFGCWNWCS

SEQ ID NO: 26709 - DNA, 699 bp, Panicum virgatum
  misc_feature: Ceres CLONE 1872158
  misc_feature: Encodes the peptide sequence at SEQ ID NO. 26710
tgcatgcttgtcatatcatggcacatgaaagctgccacaatgtgtgaatttactcgccaggaattcattggtggactgcagtctattggggtagattcaatcgaaaaatttcgtgcaaagttaccatcattacgagctgagctaaaagatgacaataagttccgtgagatatacaacttcgctttcacttgggcaagagaaaagggtcaaaagtctctctcactggagactgctattgggatgtggcagttgctatttgctgaaaggaactggcctcttctggatcattggtgccaatttttacaggtcaggcacaataaagccatatctagagacacctgggcgcagctgctggaatttgtaaagtcgattgatccacagctatccaactatgacgaggaaggtgcttggccctacctcatagatgaatttgtggaatacctgactgacaatgggttggttcagcgcacgaaatgaactgcaatggggaggattcgcccctcaccgaacaaacggttgggctgtacaaacacgattcatctttggtgtatacgatgcccaggacccgatgttggcaatccactcgccaaactgttggcctatcattgcatgacagaatttgctgataaacgcggagaaaacgcaacctaagcctgggaagtggtggtcccgagcctgccatcgtgaactactcccaaa

SEQ ID NO: 26710 - protein, 158 aa, Panicum virgatum
  misc_feature: Ceres CLONE 1872158
  misc_feature: Functional homolog of the protein sequence given in SEQ ID NO 51082
  misc_feature: Useful for making plants with altered lignin content
CMLVISWHMKAATMCEFTRQEFIGGLQSIGVDSIEKFRAKLPSLRAELKDDNKFREIYNFAFTWAREKGQKSLSLETAIGMWQLLFAERNWPLLDHWCQFLQVRHNKAISRDTWAQLLEFVKSIDPQLSNYDEEGAWPYLIDEFVEYLTDNGLVQRTK

SEQ ID NO: 26711 - DNA, 736 bp, Panicum virgatum
  misc_feature: Ceres CLONE 1872161
  misc_feature: Encodes the peptide sequence at SEQ ID NO. 26712
gtgctacacagctgctaccgcggtctcctctcccatagcaggagtggccggcctgtccttttccctccacacagccgccgccgccgccgcggcgcttccctcgtcgcgtccaagatcgagaggagcgtggacgtgcggaggagggcacggccacaggcgaaccgccgtccgcgccatgggctccgcaccgtcgtcgtcgtcgtccccgtcgccgcaaacgccgccaggacaagcccaagagaaagctaactataagtccctgagtgaagatgagtggaagaagcggctgactgaagagcagtattacgtgactcggcagaagggcacggagagagcattcactggtgaatactggaacactaaaacctccggcatttatcactgcatctgctgtgacacccctctatttgaatcatcgaccaagttcgacagtggtactggatggccctcctactataaaccgattggcgacaatgtcaagagcaagctcgatatgtcaatcatattcatgccccggactgaggtgctttgtgctgcctgtgatgcccatctggggcatgtctttgatgacgggccaccaccgacagggaagagatactgcatcaatagcgcgtctctcaaattgaagccacaataatcgctggatgctttaagatgaagtcaactgtaacttctacctgttcataacgggatgcttcgatgtatttaactttgttacatgtgcatgtaaagtacc

SEQ ID NO: 26712 - protein, 211 aa, Panicum virgatum
  misc_feature: Ceres CLONE 1872161
  misc_feature (89)..(211): Pfam Name: SelR Pfam Description: SelR domain
  misc_feature: SWISSPROT Homolog: EC 1.8.4.12 Peptide-methionine (R)-S-oxide reductase
  misc_feature: The sequence is a functional homolog of SEQ ID NO 12 in US patent 7220585
CYTAATAVSSPIAGVAGLSFSLHTAAAAAAALPSSRPRSRGAWTCGGGHGHRRTAVRAMGSAPSSSSSPSPQTPPGQAQEKANYKSLSEDEWKKRLTEEQYYVTRQKGTERAFTGEYWNTKTSGIYHCICCDTPLFESSTKFDSGTGWPSYYKPIGDNVKSKLDMSIIFMPRTEVLCAACDAHLGHVFDDGPPPTGKRYCINSASLKLKPQ

SEQ ID NO: 26713 - DNA, 472 bp, Panicum virgatum
  misc_feature: Ceres CLONE 1872162
  misc_feature: Encodes the peptide sequence at SEQ ID NO. 26714
aattaccgccccactacctccggtcgcaattcacagcaaaaaccccgccgcccacaaaaaacccgtcaaatcctgaaaacagtcgaaggaaaaaaaaaggatgggtttcaaaaaggaaatcctgaaagccggccccggccccaagccaacaaagggccaaaaggccaccgtcccctgccccggttacggaaaggatcgtgatctatccaaaaatttttgaaccaccaaggaccctggtcagcaacctttcattttcaactttggtctgggttcatggatcaaaggatggaatgaggaatttatgaccttgcaagtgggtgaatttgctcgtatccagtgcaccccgaattatgcttatggagccagcgaatttccagcctgggaaattcaaccaaactcggggctggtattcaaaattgaggtcctcattgcccattatttcccgttgcatttctggaggaagccttctttc

SEQ ID NO: 26714 - protein, 39 aa, Panicum virgatum
  misc_feature: Ceres CLONE 1872162
  misc_feature: SWISSPROT Homolog: EC 5.2.1.8 Peptidylprolyl isomerase
MGFKKEILKAGPGPKPTKGQKATVPCPGYGKDRDLSKNF

SEQ ID NO: 26715 - DNA, 741 bp, Panicum virgatum
  misc_feature: Ceres CLONE 1872166
  misc_feature: Encodes the peptide sequence at SEQ ID NO. 26716
atccgagagaccgagacagcagcgcagtgcgcacgcccctcaccctaagcgcggctccgcaggagagcgaaaatggcgaccctttccatggtctccgtccccatcgcaccctcctccctttccctctccacccggggccgcagctcctccgtatccttccccgctcccaagaaaggagggattggtcacggcggcctgcggattgagtgcatccgtattggtggtgttgagattccaaaccacaagagggtggagtactcgctgcagtacatccatggcattgggcggtcacgctcccgtcagatccttttggacctcaatttcgacaacaagatcaccaaggacctctctgaggaggaggtcatcacactccgtaaggaggtcggcaagtacatgattgagggagaccttaaacgtttcaatcgtgtggcgattgagaggttgaaggagattaggtgctacaggggcatccggcacaagctggggctaccagttcgtggccagaggacaaagaacaactgccggacgctcaagggaaagagggcttcagttgccaagaagaaatcaccctcctcccaggaggaataaatcattaccatgtatttaagttctgtttgtttttttgtgtaacgtcactactgctgggtgttccgtctcgagctttgatgctgtcagacgaatcatggggatatgatcaggtgctgcaaattctatagctgtgaaatagctgatatgagccag

SEQ ID NO: 26716 - protein, 171 aa, Panicum virgatum
  misc_feature: Ceres CLONE 1872166
  misc_feature (48)..(152): Pfam Name: Ribosomal_S13 Pfam Description: Ribosomal protein S13/S18
MATLSMVSVPIAPSSLSLSTRGRSSSVSFPAPKKGGIGHGGLRIECIRIGGVEIPNHKRVEYSLQYIHGIGRSRSRQILLDLNFDNKITKDLSEEEVITLRKEVGKYMIEGDLKRFNRVAIERLKEIRCYRGIRHKLGLPVRGQRTKNNCRTLKGKRASVAKKKSPSSQEE

SEQ ID NO: 26717 - DNA, 400 bp, Panicum virgatum
  misc_feature: Ceres CLONE 1872171
  misc_feature: Encodes the peptide sequence at SEQ ID NO. 26718
tcgcttccgattcacaactcgcatctggagccatcggagttcatcagcactctctagtcacacagcacatcttcttctcctcctgctacagagctcaggcaaaagcttcgccgccaaaacatcccaatggctcgcttcgccgtggtcgccgccatcgtcgccctcctcgccgtcagcgcggccgcgcaggccccggccgcgacgcccaccccggcgcccaggatggccccgctgccgcgctccccggccaccgccccggcaccggccgcgaagccgcccaccgcctcggcgccgtccccgctggcctctgaccccggccccgcccgccgccgagggccacgacgcgcacgacccactccgcgctgataccgaccagctgcggctgcgcgacagccgatgc

SEQ ID NO: 26718 - protein, 79 aa, Panicum virgatum
  misc_feature: Ceres CLONE 1872171
  misc_feature: Functional homolog of the protein sequence given in SEQ ID NO 50188
  misc_feature: Useful for making plants with altered carbohydrate content
MARFAVVAAIVALLAVSAAAQAPAATPTPAPRMAPLPRSPATAPAPAAKPPTASAPSPLASDPGPARRRGPRRARPTPR

SEQ ID NO: 26719 - DNA, 646 bp, Panicum virgatum
  misc_feature: Ceres CLONE 1872172
  misc_feature: Encodes the peptide sequence at SEQ ID NO. 26720
actcactcgaacaacaagccttccagttccaggggagaagagagccagcaggaagacggctatggcggcggcggcccagtgggcgatggtggtggccgtggcggcggcggcgacgctggcgggcggcgacatgaacgcggacaagacggagtgcgcggaccagctggtggggctggcgccgtgcctgcagtacgtgcaggggcaggcgcgcgcgccgccgcccgactgctgcggcgggctccggcaggtgctcgggaagagccccaagtgcctctgcgtgctcgtcaaggacaaggacgaccccaacctgggcatcaagatcaacgctaccctcgccctcgccctcccctccgccgccgacgccgcagtaggagacgcgccaaggagagtccgcgaggaggcgaccatgacggccaagtggaagaagaagcgcatgaggaggctgaagaggaagcgccgaaagatgaggcagagatctaagtaagctgattgagatggatggttgtggtgatgctgtgacagtatgcatatcttcggatgcgatagcctcgtggagagatgtctactaggaatggcgtcactgtttatcatctgctgaatggcttgtcttgcaaacctgcgcttcattaggcctgtttttgtcgtt

SEQ ID NO: 26720 - protein, 140 aa, Panicum virgatum
  misc_feature: Ceres CLONE 1872172
  misc_feature (116)..(140): Pfam Name: Ribosomal_L41 Pfam Description: Ribosomal protein L41
  misc_feature (31)..(101): Pfam Name: Tryp_alpha_amyl Pfam Description: Protease inhibitor/seed storage/LTP family
  misc_feature: Functional homolog of the protein sequence given in SEQ ID NO 50433
  misc_feature: Useful for making plants with altered carbohydrate content
MAAAAQWAMVVAVAAAATLAGGDMNADKTECADQLVGLAPCLQYVQGQARAPPPDCCGGLRQVLGKSPKCLCVLVKDKDDPNLGIKINATLALALPSAADAAVGDAPRRVREEATMTAKWKKKRMRRLKRKRRKMRQRSK

SEQ ID NO: 26721 - DNA, 729 bp, Panicum virgatum
  misc_feature: Ceres CLONE 1872190
  misc_feature: Encodes the peptide sequence at SEQ ID NO. 26722
gcgcatccacaactccacaagaatctgtcggctgccctgcccaccacctccaccacctcaccagctagcaagctcattgacatcacccaaccacaagctagctcctcgctggtcctcctcggcgacgagcgagagaggtctcgcctcggctccccatggccgccgaacctgcggacgccgggagcagcaagccgggttcctccatggcggacgtgtacaagggcgagctcacgccgctgcagcggcacgtcgccttcttcgaccgcgacaaggacggcgtcatctacccctccgagacatacgaagggttccgcgcgatcggggccggcgtcccgctctccgccttcagcgccctcttcatcaacggcctccttggacccaagaccgtgctggagaacgagaaggctccagcgttcaagctccccatttacgtgaagaacatccaaaagggaaagcacgggagcgactcgggcgtgtacgatgccaacggaaggtttgttcctgaaaagtttgaggagatcttcaagaagcatgcccacactaggcctgatgctttgacaggcaaagagctgcaggagctgctaaaagcaaacagggagcctaaggacttcaaaggatggctgggtggtttcactgagtggaaggtgctctactccctctgcaaagacgaaaaagggttccttcacaaggacactgtcagggcagtctatgatggcagcctattcgaaa

SEQ ID NO: 26722 - protein, 191 aa, Panicum virgatum
  misc_feature: Ceres CLONE 1872190
  misc_feature (20)..(191): Pfam Name: Caleosin Pfam Description: Caleosin related protein
MAAEPADAGSSKPGSSMADVYKGELTPLQRHVAFFDRDKDGVIYPSETYEGFRAIGAGVPLSAFSALFINGLLGPKTVLENEKAPAFKLPIYVKNIQKGKHGSDSGVYDANGRFVPEKFEEIFKKHAHTRPDALTGKELQELLKANREPKDFKGWLGGFTEWKVLYSLCKDEKGFLHKDTVRAVYDGSLFE

SEQ ID NO: 26723 - DNA, 720 bp, Panicum virgatum
  misc_feature: Ceres CLONE 1872193
  misc_feature: Encodes the peptide sequence at SEQ ID NO. 26724
gctagagacggagatgcggtgagtcggaggtccgctactcaccatcggggatctcctcagcgacctcgccgtcgacggcggcgatgatcccgtcgccgctggcggagatgcgtcggttccctcctctccctcggcggcacaacaggcgtgggaagccgacccgtccgacctcagccggctcttcgaggaacactacaacaatttgatgaaggcactccaagataatgatccttcatggccatcgctgatgctgaagctatgcgcggcgttgaaggctgcagataagctggtgagctctgcgaacacggatgttgagcagttgatggagaaggtgaaagtgctggagggtgtcctcgagagaggagatcgcgtagtggaacagattgtagaaaatctccagaggtcaggcctcgccaaggatcatcggagttcccaatcaaaatcgactagcaagtagtggcataggttgtgctcttatgtttgtgttgcaaatgtgagctcttgtcactgaccgtgggtactgaaaagagttgtatgtatatcgacctttgttcatgaaccctacagtctgcttgtgctttagatctattggaaccttggaatgtgtttatgtctttatctcaatattcatgttgctagtttcttcttcgttcattagcttggttcctgctatatgtgttcaggtctgggatcaatcaaaattctgaagcaaaaacctat

SEQ ID NO: 26724 - protein, 83 aa, Panicum virgatum
  misc_feature: Ceres CLONE 1872193
  misc_feature: Functional homolog of the protein sequence given in SEQ ID NO 51223
  misc_feature: Useful for biocontainment applications
MKALQDNDPSWPSLMLKLCAALKAADKLVSSANTDVEQLMEKVKVLEGVLERGDRVVEQIVENLQRSGLAKDHRSSQSKSTSK

SEQ ID NO: 26725 - DNA, 727 bp, Panicum virgatum
  misc_feature: Ceres CLONE 1872232
  misc_feature: Encodes the peptide sequence at SEQ ID NO. 26726
caggacctgaagcgccgccgccccgcgcccaccctccggcctccgcacctccgcggccccttcctgctatcctgctgcacctcccccgcgccgcgccggtcgctgctgccctgctccctgctctccctcgcggccccgcctcggagtgccaagcagccgccggacggccggagctagggtttcgaccgaaaatcgctgcggccagggcgccggtcggttcgccgtcttcgtctctcccatctcgttcagtggtctcccaccggcatcgtttacaccccccccctgccgcggcgatggcattgtcgtcgtcgcgcccgctgctccgccgcctagcggcactggcgggcgggcgtatccgcgccaaccaccgcctgctctcctcctccccctcgtctgtctccgccgagcagatgtcgcagtcgccagcagagctggaggctgtgcgcatgacggagggttgcatccagagaataaaagaattacaagctaaagaggcatccgctgaaggtaagatgctgcggttaagcgttgaggctggtggatgttctggattccagtattctttctctctcgatgacaagaaaaactcagatgacagggtctttgagactgatggtgttaaattggttgtggatggcatttcatatgactttgtgaaaggtgccactgtagattacgaggaggaaactatacgttcagcatttgtggtctctacaaatcctagtgc

SEQ ID NO: 26726 - protein, 144 aa, Panicum virgatum
  misc_feature: Ceres CLONE 1872232
  misc_feature (50)..(142): Pfam Name: Fe-S_biosyn Pfam Description: Iron-sulphur cluster biosynthesis
MALSSSRPLLRRLAALAGGRIRANHRLLSSSPSSVSAEQMSQSPAELEAVRMTEGCIQRIKELQAKEASAEGKMLRLSVEAGGCSGFQYSFSLDDKKNSDDRVFETDGVKLVVDGISYDFVKGATVDYEEETIRSAFVVSTNPS

SEQ ID NO: 26727 - DNA, 573 bp, Panicum virgatum
  misc_feature: Ceres CLONE 1872321
  misc_feature: Encodes the peptide sequence at SEQ ID NO. 26728
cagagatttatcgagttccagtgatggtcttcaaaatgaccaggaaaagaatcacttggacaaggccattcagatgcgcgaggaccttgaaaatgaggttcaccagatgaaagataaaattgcagcaaaagaacagcacattgccgacttgcagaagaaagctcagaaattagaggatgaactggttgctgcacgcaaagtctcttcagaacgacaattagctgttacagatttgtacaaacattttctccaacttcaagactacaatgacagagtcaagacggccgaacagaggcttcagtctcttgtcaatgctgcgatggtcgagcttgacatggccgaagatgctacaaccagagacggctcgatgtatgagaatggcgtggtttgaacttctgggcgccgccagactgtatggtttttcagtaactaatttattagactttttagcttgttgctataatgctatgtaatagaactgtgtggaaagtatcgagcaatgttatgtaaaggatcagtaaacgagtggctgctcattttcttctattatggtccagacttctctttcaagct

SEQ ID NO: 26728 - protein, 129 aa, Panicum virgatum
  misc_feature: Ceres CLONE 1872321
  misc_feature: Functional homolog of the protein sequence given in SEQ ID NO 50923
  misc_feature: Useful for making plants with modulated biomass
RDLSSSSDGLQNDQEKNHLDKAIQMREDLENEVHQMKDKIAAKEQHIADLQKKAQKLEDELVAARKVSSERQLAVTDLYKHFLQLQDYNDRVKTAEQRLQSLVNAAMVELDMAEDATTRDGSMYENGVV

SEQ ID NO: 26729 - DNA, 525 bp, Panicum virgatum
  misc_feature: Ceres CLONE 1872332
  misc_feature: Encodes the peptide sequence at SEQ ID NO. 26730
gcagatcgatcgagcaccccaaacttgcacacaatcaccatcagttctagtagacaatacatatcgacatcgacgatgagctccgtggacgacaccggcggcgagaagaagacgtcgtggccggaggtggtgggcctgccggcagaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattgcccttactggtttagtttttagctagtacactagaaaagggaagatctagagatcaaataattgaagctcatcaaatagtatggggaatggagctagctgctgtctagaataaaactgatggaatgcatgaataaacaatgctgtacgtcatgagtgt

SEQ ID NO: 26730 - protein, 71 aa, Panicum virgatum
  misc_feature: Ceres CLONE 1872332
  misc_feature (12)..(71): Pfam Name: potato_inhibit Pfam Description: Potato inhibitor I family
MSSVDDTGGEKKTSWPEVVGLPAEEAKKIILKDMPDADVVVLPAGSPVTMDWRSNRVRVFVDTVAQTPTVG

SEQ ID NO: 26731 - DNA, 720 bp, Panicum virgatum
  misc_feature: Ceres CLONE 1872340
  misc_feature: Encodes the peptide sequence at SEQ ID NO. 26732
gcaatcagcaatcttcccgagcaatcccctcgtcgaatccaccagcgaagcaaatctctacccttcctcccccactcccccgatggcccgcacgaagcagacggcgaggaagtccaccggcggcaaggcgccgaggaagcagctggcgacgaaggcggcgcgcaagtcggccccggccaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagactgacctccgcttccagggctccgccgtcgccgcgctgcaggaggcggccgaggcctacctcgtcgggctcttcgaggacaccaacctctgcgccatccacgccaagcgcgtcaccatcatgcccaaggacatccagcttgcccgccgcatccgtggcgagagggcctaggtgtcgtcgccgtggaggggaagtagtagaaatagtagcttgccttctgtgtccaatcagaaggtgtggagatgtgctgggttccttagctttggttgttggttcgtctactgctgtaatttatcccatcgtatcttctgttccttggtgttgcaatggatcaatgaatgcaatggcaccttgttaccagttacctaaattttgtgccgagatccctgcttgctctc

SEQ ID NO: 26732 - protein, 136 aa, Panicum virgatum
  misc_feature: Ceres CLONE 1872340
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQGSAVAALQEAAEAYLVGLFEDTNLCAIHAKRVTIMPKDIQLARRIRGERA

SEQ ID NO: 26733 - DNA, 718 bp, Panicum virgatum
  misc_feature: Ceres CLONE 1872343
  misc_feature: Encodes the peptide sequence at SEQ ID NO. 26734
atcatcatgtgcggggtgaaggtcgtgcccgacaaccccttagacgacgtcccgccctccgacatcgggagccaccttggcgtcctgctggattctgcggacggctccgacgtgtccttcgtcgtcgacggcgaggagttccccgcccaccgagcggtgctcgccgcccgctcgccggtcttcaaggcgcagctcttgggatccatggcggacgccaagatggcatccatcaccttgcacgacatcgcgcccccgacgttcaaggccatgcttcggttcatctacaccgacgagtttcctgcggagggcgggtttgaagactccccagtagagaagctccatgatctgctcgccgccgccgaccggtacgcactggaccgcctgaagcttctgtgtgcgaggaagctgtgggatagcgtctcagtggatacagttgctgctactctgtcctgtgccgaaaagtacagctgcccggagctgaagacgaagtgcgtcgacttctttgcagacgacaagaacttcaagaaggctgtgctgactgacggttttgctcagatggtgcacaagttcccatcgattattggtgagctgagggagaaggtcggggcatagggacattcaatcatatgggcggtgtatcgtgtatgcaattcgatctcttttgagactcatcagtagtagttcttctatctgtacctgatgaagtcctcgtagtttc

SEQ ID NO: 26734 - protein, 201 aa, Panicum virgatum
  misc_feature: Ceres CLONE 1872343
  misc_feature (24)..(138): Pfam Name: BTB Pfam Description: BTB/POZ domain
MCGVKVVPDNPLDDVPPSDIGSHLGVLLDSADGSDVSFVVDGEEFPAHRAVLAARSPVFKAQLLGSMADAKMASITLHDIAPPTFKAMLRFIYTDEFPAEGGFEDSPVEKLHDLLAAADRYALDRLKLLCARKLWDSVSVDTVAATLSCAEKYSCPELKTKCVDFFADDKNFKKAVLTDGFAQMVHKFPSIIGELREKVGA

SEQ ID NO: 26735 - DNA, 604 bp, Panicum virgatum
  misc_feature: Ceres CLONE 1872368
  misc_feature: Encodes the peptide sequence at SEQ ID NO. 26736
aaccagcagtacaggaagcacaagaaagccacttctagccatcaacaacgacttcttcttcaccatcatcgtcacctaactcagacagtgagcggagtaccttgttgctttagtttttcacaattttcttgtacacatataggtacatgttttaactgtccaaggcatcgatcgatccgctggtattagcgactgaagaagaagaagatgagctcctccgcggaaccagctgtgtgcggcggcggcggcaagatcacgtcgtggccgtaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtttgaataataatggatgtgtgttctttccctgtaaatcaaataaataaacaaaggatgtgtgaaaggatcgtggcccaagaaggaggttaaattgggattttttcc

SEQ ID NO: 26736 - protein, 51 aa, Panicum virgatum
  misc_feature: Ceres CLONE 1872368
  misc_feature (1)..(51): Pfam Name: potato_inhibit Pfam Description: Potato inhibitor I family
MSIEEAKKVILKDKPDADIQVLPVGTPVTKDFRPNRVRIFVNTVAETPHVG

SEQ ID NO: 26737 - DNA, 582 bp, Panicum virgatum
  misc_feature: Ceres CLONE 1872394
  misc_feature: Encodes the peptide sequence at SEQ ID NO. 26738
attcccgccgccggcgcttgctcttcctccaagcagcgcctccgctcccatctcctgcgcccgcctcgtctcgaacccccgctctccccttcgaccatggcggacatggaagtggatgcggaggcggcggccgcggggtcctcgaaggaagaggacgttgctgcgactccggctaccgcggctcggacgtggacgcgctcctcgacatgtccaccgacgacctcgtccagctcttccccgcgcgtgcgcgccggacgttccagaggggtcagaagaggaagcccatggcgctcatcaagaagctgcgcagggcgaacaaggatgcacctgccggtgagaagccacagcccgtgaggacccacctcctcaatgtgatcattgtgcctgagatgattgctaccatgatcggtgtctacgatgggaagaccttcgaccaggttgagatcaagcctgagatgattggtcactacctcgcagagttctccatctcgtacaagcctgtcaagcatggtaggccagttatcggtgctacccactcctctaggttcattcccctcaagtgaggccagatatgaggttgtg

SEQ ID NO: 26738 - protein, 186 aa, Panicum virgatum
  misc_feature: Ceres CLONE 1872394
  misc_feature (88)..(169): Pfam Name: Ribosomal_S19 Pfam Description: Ribosomal protein S19
SRRRRLLFLQAAPPLPSPAPASSRTPALPFDHGGHGSGCGGGGRGVLEGRGRCCDSGYRGSDVDALLDMSTDDLVQLFPARARRTFQRGQKRKPMALIKKLRRANKDAPAGEKPQPVRTHLLNVIIVPEMIATMIGVYDGKTFDQVEIKPEMIGHYLAEFSISYKPVKHGRPVIGATHSSRFIPLK

SEQ ID NO: 26739 - DNA, 675 bp, Panicum virgatum
  misc_feature: Ceres CLONE 1872398
  misc_feature: Encodes the peptide sequence at SEQ ID NO. 26740
gcaactgccgccgcagcggccgagaaatgaaagcaattgcaggtttgagaagaataaatttggatgggttgcgatggcgtgtatttgatgcgaagggtcaggtccttggacggttggcatcccaaattgctgttgtgcttcaaggcaaggataagccaacctatgcaccacatgtagaaaatggagacatgtgcattgtacgtaatgcaaaggatatcagtgttacaggaaggaaaatgacagataagatctactactggcatacagggtatattggccatcttaaggaaagaaggctcaaggaccagatggagaaagacccaactgaagtgatccgcaaagctgtcctgcgcatgcttccccgcaacagattgcgtgatgacagggatcgcaaactgaggatattttctggaaatgagcatccattccatgatcgccctcttgggccatttgtgatgccaccacggcaaatacgtgagatgcgaccccgcgcaaggcgtgcactgattagggcccagaagaaagagcaggcaatcagagccaaggaggaagaaggtgcaaagaatgctgagataactgcataggcacattctgatgtgtggatatgcacattgcaaatcttccagatattgtttttggagcatccttgctttcttggacatgtagtctgttgag

SEQ ID NO: 26740 - protein, 185 aa, Panicum virgatum
  misc_feature: Ceres CLONE 1872398
  misc_feature (17)..(146): Pfam Name: Ribosomal_L13 Pfam Description: Ribosomal protein L13
MKAIAGLRRINLDGLRWRVFDAKGQVLGRLASQIAVVLQGKDKPTYAPHVENGDMCIVRNAKDISVTGRKMTDKIYYWHTGYIGHLKERRLKDQMEKDPTEVIRKAVLRMLPRNRLRDDRDRKLRIFSGNEHPFHDRPLGPFVMPPRQIREMRPRARRALIRAQKKEQAIRAKEEEGAKNAEITA

SEQ ID NO: 26741 - DNA, 893 bp, Panicum virgatum
  misc_feature: Ceres CLONE 1872402
  misc_feature: Encodes the peptide sequence at SEQ ID NO. 26742
gaagcgcgcttccaccacttctcttccgttcccacgcacacgcacgctcgggcaaactcgttcgcttcgcgcctccgccgcgtgcgctcgtgctcgtcgcgtgctgatcgctcctcgcttcgatcctctctccctctctctgtttctctctgtctcgtgagctcgcgggcggcggcggcgtcgggatggccgtcggagcaggcgtgcgcgtggcgtcctcggtggaggtgtgggggcgggggcgggggcggagcagcggcgggaggcgcggcgccgcggcggcgaccgtcaggtgcagctgcgtcggcgaggcggggccggccgccgggggcctggcggaggaacactaccggacgctgcggctgcgcccgggggccacccggggcgaggtcaagaaggccttccgccgcctcgcgctcatgtaccatccggacgtccgcaaggagagcgacggcgacggcgatggcggcgtccagtttcagaggatcaacgtggcctatcagatgctgatgagcaacatgagggaggccgacgagcggctcgagtactggcgcctcaagtacggcctcaccgaccaggatctcgacaggtacaggtactacctcmacgaggacgacgacgactggctcgacatgtgaggaggctgaagcmkccagtcgataggcagaggatttacgcagcttgcctgttgacattggtctcactcatcttaggactaccggttgattcctgttgttgccatgtcagaggcagcagcactgtgatctcatctgcttgtgtatactgaagcagtgtgtactcctcccctattttattgtgggtgaaaggatacatactgcagacagacagattaaagtgtactgacattcgtgtatcagaaagaacccttgttc

SEQ ID NO: 26742 - protein, 150 aa, Panicum virgatum
  misc_feature: Ceres CLONE 1872402
  misc_feature (53)..(116): Pfam Name: DnaJ Pfam Description: DnaJ domain
  misc_feature (141)..(141): Xaa is any aa, unknown, or other
MAVGAGVRVASSVEVWGRGRGRSSGGRRGAAAATVRCSCVGEAGPAAGGLAEEHYRTLRLRPGATRGEVKKAFRRLALMYHPDVRKESDGDGDGGVQFQRINVAYQMLMSNMREADERLEYWRLKYGLTDQDLDRYRYYLXEDDDDWLDM

SEQ ID NO: 26743 - DNA, 746 bp, Panicum virgatum
  misc_feature: Ceres CLONE 1872434
  misc_feature: Encodes the peptide sequence at SEQ ID NO. 26744
atcgcgcgagtcagcactagggtttttgccaagcagccgccgccgcactgccccccgcatcccatcctacccaccgagagaccaagatgacggcgcagaccgccgaggagctcgccgcccagatcgagcagcagaagctcgaggagcagaagactgaggcagaggatgttgtggttgaggatgaggacgatgaggacgaggacgatgacgatgatgacaaggatgatgaagatggacaagaaggcgatgccagtggcaaatcaaaacaaagcaggagtgagaagaagagccgcaaggccatgctgaaacttggcatgaagccgatcactggtgtcagccgtgtcactgtgaagaaaagcaagaatatactgtttgtcatctccaagccagatgtgttcaagagcccaaactcagacacctatgtcatcttcggtgaggccaagatcgaggacctcagctcccagctgcagacccaagctgcggaacagttcaaggctcctgacttgagccagatgatctccaagcctgagacatctggcctaggccaggaggacaatgaggaggaggttgatgagactggtgtcgagcccaaggacattgagttggtgatgacgcaggcatccgtctcgaggcccaaggctgtcaaggccctcaaggctgccgatggggacattgtcactgccattatggagctgaccacttagagcgttatttttggcatggtcgaaacattttccctctctgag

SEQ ID NO: 26744 - protein, 205 aa, Panicum virgatum
  misc_feature: Ceres CLONE 1872434
  misc_feature (63)..(122): Pfam Name: NAC Pfam Description: NAC domain
  misc_feature (166)..(203): Pfam Name: UBA Pfam Description: UBA/TS-N domain
MTAQTAEELAAQIEQQKLEEQKTEAEDVVVEDEDDEDEDDDDDDKDDEDGQEGDASGKSKQSRSEKKSRKAMLKLGMKPITGVSRVTVKKSKNILFVISKPDVFKSPNSDTYVIFGEAKIEDLSSQLQTQAAEQFKAPDLSQMISKPETSGLGQEDNEEEVDETGVEPKDIELVMTQASVSRPKAVKALKAADGDIVTAIMELTT

SEQ ID NO: 26745 - DNA, 697 bp, Panicum virgatum
  misc_feature: Ceres CLONE 1872441
  misc_feature: Encodes the peptide sequence at SEQ ID NO. 26746
agggctaaacctagggtttctccgccgccgccgccgccgccgccgccggagggaacagggagggagtgccgcgatggcggagaagaagcagcgacccggcggggccaggaaggacgaggtggtcacccgcgagtacaccatcaacctccacaagcgcctccacggatgcaccttcaagaagaaggcccccaatgccatcaaggagatcaggaagtttgcacagaaggcgatgggcaccacggatgtcaggatcgacgtgaagctcaacaagcacatctggagcagtggtatccgcagtgtgccaaggcgcgtccgtgtcaggatcgcacgcaagagaaacgatgaggaagacgccaaggaggagctctactctctggtcacggttgctgagatccccccggaggggctcaagggtctgggcaccaagcttgtcgaggacgatgaatagatctgcccgtgtacctgccttcctctatgaaagcaaattttggtgttgagtttgttagcactatgttcaatatccttacgatgaaacatgcggtgtcttttgatgtctcaattgctttcttggcttggtattgaactcttcaagatacctgggtggtttgtggatcccgaattccagatcctttgtgcagctatgctagatgtctgacgaatatcatgaatcatgtcccgtttccctttgaattcgatc

SEQ ID NO: 26746 - protein, 124 aa, Panicum virgatum
  misc_feature: Ceres CLONE 1872441
  misc_feature (12)..(106): Pfam Name: Ribosomal_L31e Pfam Description: Ribosomal protein L31e
MAEKKQRPGGARKDEVVTREYTINLHKRLHGCTFKKKAPNAIKEIRKFAQKAMGTTDVRIDVKLNKHIWSSGIRSVPRRVRVRIARKRNDEEDAKEELYSLVTVAEIPPEGLKGLGTKLVEDDE

SEQ ID NO: 26747 - DNA, 623 bp, Panicum virgatum
  misc_feature: Ceres CLONE 1872467
  misc_feature: Encodes the peptide sequence at SEQ ID NO. 26748
accaccgcttcaccctttgttccctgtaccctcctcctctgctctctctaggtttatccgtctatgcggtctcgatcggaaccgcagagggcaggggagaacagagccctgtcactggtgtgattctgagggagccctccccggccccgatcccgcgtccccctggccgaaaatggcctcccccacaagtacgtgccggcgcacccgcccgcttcgagcttagatccacgctgcgctccaaccccgtgcccaccacgatccccgtgctcctccgcgacggccgccccgtgtgctcgtccctcatcctcctccactacaacaacgagcccccccccctccacccggggctgctccccgcctacccctacccctgcccgctcgcccccttctgcgccgactacccccagctcaagatcctcgactaccgcacccgcgctgtgcagcgctcagagctgaggcccagcccctcgcccgctccgagatgctccagatcctccacatcctcgacaggcccctcaacgacgacacgctcttcgactgccacgactacctcttcgactacttcgcgctctcaccacttcctgagtgctgcctcacctactaccgcccgcggcagttcggcc

SEQ ID NO: 26748 - protein, 206 aa, Panicum virgatum
  misc_feature: Ceres CLONE 1872467
  misc_feature: SWISSPROT Homolog: EC 4.4.1.5 Lactoylglutathione lyase
HRFTLCSLYPPPLLSLGLSVYAVSIGTAEGRGEQSPVTGVILREPSPAPIPRPPGRKWPPPQVRAGAPARFELRSTLRSNPVPTTIPVLLRDGRPVCSSLILLHYNNEPPPLHPGLLPAYPYPCPLAPFCADYPQLKILDYRTRAVQRSELRPSPSPAPRCSRSSTSSTGPSTTTRSSTATTTSSTTSRSHHFLSAASPTTARGSS

SEQ ID NO: 26749 - DNA, 723 bp, Panicum virgatum
  misc_feature: Ceres CLONE 1872470
  misc_feature: Encodes the peptide sequence at SEQ ID NO. 26750
acgcagcccgcgcaaccatggccgtgtcggaggtggcggtcgacggcgtcgtcttcctcgccggcaacttcatcaagttcacggccatcggcgtgtacctggaggagggcgccgccgtgtccgcgctggcgaagaagtgggcagggaagtccgccgacgagctcgccgccgacgtcgccttcttccgcgacgtcgtcacgggcgacttcgagaagttcacgcgggtgacgatgatcctgccgctcacgggcgagcagtactcggacaaggtgacggagaactgcgtggcgtactggaaggccgtcggcgcgtacacggacgccgagggcgccgccgtggacaagttcaaggaggccttcaagcccgagacgttcccgccgggcgcgtccatcctcttcacgcactcgcccgccggagtcctcaccgtcgcgttctccaaggactcgtcggtgccggactccggcggcgtggcgatcgacaacaagcccctctgcgaggccgtgctggagtccatcatcggggagcacggagtctcgccggccgcgaagctgagcgtcgcggcgagggtgtcggagctgctcaaggaggccagcccggccggcggcgcgccacgggcggcggagcccgcggtcccggtctccgcgtgagcggggccgcgaggggaggaagagtcaggcagtcaggcgatggcatctgccggccggcgtctaagatgtgtactag

SEQ ID NO: 26750 - protein, 209 aa, Panicum virgatum
  misc_feature: Ceres CLONE 1872470
  misc_feature (1)..(189): Pfam Name: Chalcone Pfam Description: Chalcone-flavanone isomerase
  misc_feature: SWISSPROT Homolog: EC 5.5.1.6 Chalcone isomerase
  misc_feature: The sequence is a functional homolog of SEQ ID NO 2 in US patent 7202398
MAVSEVAVDGVVFLAGNFIKFTAIGVYLEEGAAVSALAKKWAGKSADELAADVAFFRDVVTGDFEKFTRVTMILPLTGEQYSDKVTENCVAYWKAVGAYTDAEGAAVDKFKEAFKPETFPPGASILFTHSPAGVLTVAFSKDSSVPDSGGVAIDNKPLCEAVLESIIGEHGVSPAAKLSVAARVSELLKEASPAGGAPRAAEPAVPVSA

SEQ ID NO: 26751 - DNA, 695 bp, Panicum virgatum
  misc_feature: Ceres CLONE 1872477
  misc_feature: Encodes the peptide sequence at SEQ ID NO. 26752
aatcgccccgttagccgcagaacaggacgagaggggaatagggtttgctcgccgccgcccgccggagcaggaagagaccgctcgctccgctccccatcgccgcgagcgggatgaagagcttcccggtggccggaggctgcagcgtctccctcgccctctactccgacgtctccaacagccgggtgctgctcgacttgatgcagtcagggaagctggaaccggaggtcgcgttcctcaacgcatcactggtgccggatgtgttccctgttcttgcagcggcgcacaaggcgctgctgtcgaaggcgagggagtcactgaccacaaggactctgcactctgagctcgtctacaactactccgggtcgaagcatattacagaatccctgaaacgatgcgggatctctgatgacacgacatacatccttgcagctcgttttgatgcttcagacgaggagatgaaagcagtggagaaactcatcagtggcaccgagatcgatttaggagaactggaaagtagagcaaaccagccacagatcctaaagcattacaagatacctccccaagaactattgatatctacactgcccgacgcaattgtatgcaggattgctgctcgagatgctctctgaggcctcaacgattattgtgacgatcccagcactgaagtttgagctcgatctctgcgcctttggctt

SEQ ID NO: 26752 - protein, 172 aa, Panicum virgatum
  misc_feature: Ceres CLONE 1872477
  misc_feature (47)..(149): Pfam Name: CGI-121 Pfam Description: Kinase binding protein CGI-121
MKSFPVAGGCSVSLALYSDVSNSRVLLDLMQSGKLEPEVAFLNASLVPDVFPVLAAAHKALLSKARESLTTRTLHSELVYNYSGSKHITESLKRCGISDDTTYILAARFDASDEEMKAVEKLISGTEIDLGELESRANQPQILKHYKIPPQELLISTLPDAIVCRIAARDAL

SEQ ID NO: 26753 - DNA, 581 bp, Panicum virgatum
  misc_feature: Ceres CLONE 1872483
  misc_feature: Encodes the peptide sequence at SEQ ID NO. 26754
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcagcggcccgcgctccggcggcggcggcggcggcgggtacgggcgccgcgagggcggcggcggctacgggtgccgcgagggcggcggtggctactgtggcgggggttactgtggccgtggtcgctgctgtggcggcggccgccgccgctgcggctactgcgatgggtgatgcaggagctgagcggggaggtcatggtggtctagttgtcctgctcctgcttctggt

SEQ ID NO: 26754 - protein, 142 aa, Panicum virgatum
  misc_feature: Ceres CLONE 1872483
  misc_feature (10)..(81): Pfam Name: RRM_1 Pfam Description: RNA recognition motif. (a.k.a. RRM, RBD, or RNP domain)
  misc_feature (48)..(138): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAASDVEYRCFVGGLAWATDDNSLHNAFSPFGEVLESKIILDRETQRSRGFGFVTFSSEQAMRDAIEGMNGKELDGRSITVNEAQSRSGPRSGGGGGGGYGRREGGGGYGCREGGGGYCGGGYCGRGRCCGGGRRRCGYCDG

SEQ ID NO: 26755 - DNA, 569 bp, Panicum virgatum
  misc_feature: Ceres CLONE 1872488
  misc_feature: Encodes the peptide sequence at SEQ ID NO. 26756
aagctatcccttctgtggatgacatcaatagcatattccgcatacatggacctatcgtggagagtgagactgagatcactaagaagttgaagattgcaaaagtagttttctctaggcgtgctgatgcagagcgggcatttagcagttcgggaaagtacagtgcattcggtccatcgctgctcacctatgaaattcaatacttgccatccgcgcctcaggtttcttaagtgctgcggtctgaacttgatatgctgtaattcagaggaaatgcaccatgaagtctggagcaatggagcattaattggtgtacctgacttagagttaggatcgcccactgaccaggtcacattagtcactgagtgggtgagcaaactttaggctttctgcagatacatgcctggttgtgtgcttggtatcaaagttagcttatgttgaattattagatggtagagtaaaccgtgcgcatcctcccacgttagcatattatcctttttgtattgcacagctgtggatctctctattatgtggtctctttagctatttatttgattgtgccaagctagttaagc

SEQ ID NO: 26756 - protein, 74 aa, Panicum virgatum
  misc_feature: Ceres CLONE 1872488
  misc_feature: SWISSPROT Homolog: EC 2.7.11.1 Non-specific serine/threonine protein kinase
AIPSVDDINSIFRIHGPIVESETEITKKLKIAKVVFSRRADAERAFSSSGKYSAFGPSLLTYEIQYLPSAPQVS

SEQ ID NO: 26757 - DNA, 657 bp, Panicum virgatum
  misc_feature: Ceres CLONE 1872498
  misc_feature: Encodes the peptide sequence at SEQ ID NO. 26758
gccccctccacctccattgccgcgcctcttcctccatctcctatagcagcaccagctacctagctagctttcagcagctctagcaataatggccaccgccctcagcagcctccgcgcgccggccagcagcttctccggcgtccgcgctgccccggcacccgcggcgcccgccatcggcgccatgcccgccgccaaacagcaggttgcccgcggcgccaggctgggcgcccaggcgacctacaacgtgaagatcggcacgcccgacggcgaggtggagctgcccgtgcccgacgacgtgtacatcctggaccaggccgaggaggaagggatccaccttccctactcgtgccgcgccgggtccagctcctcctgcgccggcaaggtcgtctccggctccgtcgaccagtccgacaagagcttcctcgacgacgaccacgtcgccagcagctgggtgctcacctgccactcctaccccacctccgacgtcgacatcgaaacccacaaggaggaggagctcacagcttaatatacaattaattaaactcgctccatcgtgcgacaatatatatcatcatcatctatagctagtatagctcactctgcctgccttgcaatatatgttgtaatcgatcgagttgactaagccggccgccggag

SEQ ID NO: 26758 - protein, 114 aa, Panicum virgatum
  misc_feature: Ceres CLONE 1872498
  misc_feature (25)..(100): Pfam Name: Fer2 Pfam Description: 2Fe-2S iron-sulfur cluster binding domain
  misc_feature: SWISSPROT Homolog: EC 1.14.13.7 Phenol 2-monooxygenase
MPAAKQQVARGARLGAQATYNVKIGTPDGEVELPVPDDVYILDQAEEEGIHLPYSCRAGSSSSCAGKVVSGSVDQSDKSFLDDDHVASSWVLTCHSYPTSDVDIETHKEEELTA

SEQ ID NO: 26759 - DNA, 676 bp, Panicum virgatum
  misc_feature: Ceres CLONE 1872499
  misc_feature: Encodes the peptide sequence at SEQ ID NO. 26760
acacactcgcagctgattcaccgcttaagtaatttgcagatcgagagagaagcgaaaccatggcgtccaaggcgctcctagtgctcgcgctcctgctcgctgctgctttccttgtcgcctcagctaacaacgagcacacccagccgaaggaggaggagagcaagcaggccggcgtgcaggactaccaccgcggcggcggctaccccggcggcggctggcgcggaggaggcggctaccccggcggcggccggcgcgggggcggtggctaccctggccacggcggcggcggcgggtactgccggtgggggtgctgcaaccgcggctactacggcggctgccgctgctgctcgcgccccgacgagatcccggagcccatgtaccgcccggagttcgtcgaggtccacgactgaatgaacaatctagctgcacgtacggcctcgttgccatgtactactactactactaagactacgtacacgacctacctagctaataaagtaataataagcagtcgatcggtaaaagtatgggttcaacaataaaggatgcatgtatgcaattgtgcgtgtgatgaatgtatgtccgtgtgtgcttgatgcagtagaatgtaactctcatgcatgtataatcatgcatgccgtcgaataaagaataagagagtcgttgttgctatagt

SEQ ID NO: 26760 - protein, 116 aa, Panicum virgatum
  misc_feature: Ceres CLONE 1872499
  misc_feature (1)..(93): Pfam Name: GRP Pfam Description: Glycine rich protein family
MASKALLVLALLLAAAFLVASANNEHTQPKEEESKQAGVQDYHRGGGYPGGGWRGGGGYPGGGRRGGGGYPGHGGGGGYCRWGCCNRGYYGGCRCCSRPDEIPEPMYRPEFVEVHD

SEQ ID NO: 26761 - DNA, 700 bp, Panicum virgatum
  misc_feature: Ceres CLONE 1872505
  misc_feature: Encodes the peptide sequence at SEQ ID NO. 26762
aggcgcagaatcgatcgagcaccccaaacttgcacacaatcaccatcagttctagtagtacaagacatatcgacgtcgacgatgagctccgtggacgccaccggcggcgagaagaagtacgtcgtggccggaggtggtgggcctgccggcggaggaggccaagaagatcatcctcaaggacatgcccgacgccgacgtcgtcgtcctgcccgccggctcgcccgtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattgcccttactggtttagcttttagctagtacactagaaaaggaaagatctagagatcaaataatcgaagctcatcaaatagtatggggaatggacaacccacccattctctttccgcgcgcggagttcaaaaagggaggagtgatgcatgcaagtttgatgtgcaagctgctgtaaagaggaggaagatggaggggagtaagaagcacgtttattaatctgctgctgtacaaattaaatttagcactagagtgagagaaagtaagctgttagccgtctaaaagaaaagccgaagccattggccctctggttgtatctgttgatatagt

SEQ ID NO: 26762 - protein, 38 aa, Panicum virgatum
  misc_feature: Ceres CLONE 1872505
  misc_feature (1)..(38): Pfam Name: potato_inhibit Pfam Description: Potato inhibitor I family
MPDADVVVLPAGSPVTMDWRSNRVRVFVDTVAQTPTVG

SEQ ID NO: 26763 - DNA, 1072 bp, Panicum virgatum
  misc_feature: Ceres CLONE 1872522
  misc_feature: Encodes the peptide sequence at SEQ ID NO. 26764
atatccacccccagtccaatgctggacaactgcttgcccagcccaccaagtttgaatggtgtgcatgccctgatctctatataaaccccgccaaatcatcacatcgatcaagcaggtccactgcagcaagggaacctagcaggcaggaactgatccaagctgtgatccggcatggcgagctcagcggcgatgtcgagggtcctgctgaccctcgggctggcaatcctctgcgccgccggcctggcagccgcgcagaacgtgggcagcgtcgtcaccgactccttcttcaacggcatcaagaaccaggccgggggcgggtgcgagggcaaggacttctacacgcggagcgcgttcctgagcgccgtcaactcgtactcgggcttcgcacacggcggctccgagacccagggcaagcgcgagatcgctgccttcttcgcgcacgtcacgcacgagaccggatctttctgctacatcagcgagatcaagaaggacgacagctactgcaacgcgagcaagccggagtggccgtgcgcggcggggaagaagtactacgggcgcggcccgctgcagatctcgtggaacgacaactacgggcccgccgggagggacatcggcttcgacgggctggggaacccggacgcggtggcgcaggaccccgtgatcgcgttcaagacggcgctctggttctggatgaacaacgtgcacggggtgatctcccaggggttcggcgccaccaccagggctatcaacggcgaccgcgagtgcgacggcaagaaccccgacaagatgaacgcgagggtgggctactacaagcagtactgccagcagctcggcgtcgaccccgggagcaaccttacctgctagagctgctgcttggtttcatggtcatcatggatgcctgctttgctcgtgaagagtgaaggatcctcggcgtcgcatacatgaaatggcaccgggagtgaaacccagagtttatgcactagtagttgcaaaaaaaaaacacgggtcggcttgtgtaattcgacctaataataataaaaaagaagcactgcgcggcgagcagttggcaagc

SEQ ID NO: 26764 - protein, 230 aa, Panicum virgatum
  misc_feature: Ceres CLONE 1872522
  misc_feature (33)..(230): Pfam Name: Glyco_hydro_19 Pfam Description: Chitinase class I
  misc_feature: SWISSPROT Homolog: EC 3.2.1.14 Chitinase
  misc_feature: The sequence is a functional homolog of SEQ ID NO 12 in US patent 7087810
MASSAAMSRVLLTLGLAILCAAGLAAAQNVGSVVTDSFFNGIKNQAGGGCEGKDFYTRSAFLSAVNSYSGFAHGGSETQGKREIAAFFAHVTHETGSFCYISEIKKDDSYCNASKPEWPCAAGKKYYGRGPLQISWNDNYGPAGRDIGFDGLGNPDAVAQDPVIAFKTALWFWMNNVHGVISQGFGATTRAINGDRECDGKNPDKMNARVGYYKQYCQQLGVDPGSNLTC

SEQ ID NO: 26765 - DNA, 757 bp, Panicum virgatum
  misc_feature: Ceres CLONE 1872543
  misc_feature: Encodes the peptide sequence at SEQ ID NO. 26766
gaacccaatccaacgtccgcagcaaacacacccagctgactccccctgtttccactccactcggaccagatcccaagcactccaccaagaacctttccctcccctccgagttactcgaggaatccatgtgcggcggcgccatcatcttcgactacatcccggcccggcgccgggtgtccgccgccgacttctggccggactccgaagccgacgccgaggactcccacgccccgcgcgcctccggcgagagagcgccgcgcgcgaagcggtgccgcaagaaccagtaccgcggcatccggcagcggccgtggggcaagtgggcggcggagatccgcgaccccgtgaagggcgtccgcgtctggctcggcacctaccccaccgccgaggccgccgcgcgcgcctacgaccgcgccgccaggcgcatccggggcgccaaggctaaggtcaacttccccaacgacatctcgtccccagcctctgtgcgcggccgcgcccgccgccgccgccgccgccgcccccgtcgcggaggagccgcaggcgccggtgccctccgggctgtggagcttcgaggactactacccggcgtccctgtcgctcttcactgaataacggacgcctcctgatgttcttttgtccgttaattttgtggaaaaaaatcccccctgctcgtccgctgtcgccatgagtggctaacgccgagctgatgatccttgtcttgtgtcgttgaacccatacattgtttcatttcatttgtgac

SEQ ID NO: 26766 - protein, 159 aa, Panicum virgatum
  misc_feature: Ceres CLONE 1872543
  misc_feature (52)..(103): Pfam Name: AP2 Pfam Description: AP2 domain
  misc_feature: Functional homolog of the protein sequence given in SEQ ID NO 51224
  misc_feature: Useful for making plants with altered alkaloid content
  misc_feature: Useful for making plants with altered lignin content
  misc_feature: Functional homolog of the protein sequence given in SEQ ID NO 51225
  misc_feature: Useful for making plants with altered cell wall content and/or composition
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
MCGGAIIFDYIPARRRVSAADFWPDSEADAEDSHAPRASGERAPRAKRCRKNQYRGIRQRPWGKWAAEIRDPVKGVRVWLGTYPTAEAAARAYDRAARRIRGAKAKVNFPNDISSPASVRGRARRRRRRRPRRGGAAGAGALRAVELRGLLPGVPVALH

SEQ ID NO: 26767 - DNA, 376 bp, Panicum virgatum
  misc_feature: Ceres CLONE 1872561
  misc_feature: Encodes the peptide sequence at SEQ ID NO. 26768
cagctcccgcgcgtcatcaccatcggagcctccgggagcgcgggagagagcaaagcgccgcaggccgtccgatcctccgagcgaatcagatgagatgggtctcgctccctccggctcggccgctctccgcgccgcgctggcctcgctgggccctcgggccgccaggggctacgcggcgtctgcggcgtccggggccatgcggcgcgcgccggccgcggcggagggcgccgccgcgggggaggccaacgaggccgggcgcggccccgccgacaccaagatctcctgggtacgctatcgcgtcaccggccacttccgccccgccaactgggccgccgccgccgaccccgccgacctcggcgccgcgctcctagcccgg

SEQ ID NO: 26768 - protein, 93 aa, Panicum virgatum
  misc_feature: Ceres CLONE 1872561
  misc_feature (1)..(93): Pfam Name: LEA_3 Pfam Description: Late embryogenesis abundant protein
MGLAPSGSAALRAALASLGPRAARGYAASAASGAMRRAPAAAEGAAAGEANEAGRGPADTKISWVRYRVTGHFRPANWAAAADPADLGAALLA

SEQ ID NO: 26769 - DNA, 669 bp, Panicum virgatum
  misc_feature: Ceres CLONE 1872601
  misc_feature: Encodes the peptide sequence at SEQ ID NO. 26770
catagcattcctggagaccctagccattgcaaatttcccgtattatgaatttgtggatcgggatataatgtataaaataggttcattgttctacgcaatatacttcattgtcagtttcccaatgttttcaaggatcgatgagaaagatgagaagtggaacctgtccagggtagctgttgactctttgggcgcggcgatgctcgttacgataatactggacctgtggcgcatatttttggggccaatagtgcccatccccgagtcgaggcagtgcggtcagccggggctcgcgtggttccagccgcagaactaaagcatctgatccggtgaagctgcaggtatcctgtgtttccacgaacattattggggactgataaaatcctcctctccctttgaaggctgaggctgcgccggagaggcatgatgtgaagtgtagagcggctgtggcatcgtgaatatttgcgtgttgtgatcttgtaatgttgtgtatcaggtccatgccatactgtaatatgcatgtatctgtagtctatctgtacgagatgtgtagcttcgccatcccgtggtccgcaacattgctgtagaaacgagaatgatacatttttttggggttttgttttgcatttcattattgccatccatttgattggaataatagtaatagctatc

SEQ ID NO: 26770 - protein, 103 aa, Panicum virgatum
  misc_feature: Ceres CLONE 1872601
  misc_feature: SWISSPROT Homolog: EC 5.5.1.9 Cycloeucalenol cycloisomerase
  misc_feature: Functional homolog of the protein sequence given in SEQ ID NO 51088
  misc_feature: Useful for making plants with altered sterol content
IAFLETLAIANFPYYEFVDRDIMYKIGSLFYAIYFIVSFPMFSRIDEKDEKWNLSRVAVDSLGAAMLVTIILDLWRIFLGPIVPIPESRQCGQPGLAWFQPQN

SEQ ID NO: 26771 - DNA, 648 bp, Panicum virgatum
  misc_feature: Ceres CLONE 1872608
  misc_feature: Encodes the peptide sequence at SEQ ID NO. 26772
gacaactccgacctctatttttctcacgccctccccgcgaataaaaacttttctagcctccctttgaatccatccacccatccattgctcgtctccctcccaaattcgatgcctttgtagcgctgccgcttcgcccctgcgtcgcgccgcgccgtgcggtgcacttgccgctgcgcttcccatggacgctggggccggtgccggatccggcaatgcctccggcggcggcgcgtccgcgtgctgctacttcgccctgctcggcatccgcaagaacgcctccgccaccgacatccgcgccgcctaccggaggctcgcgatgaagtggcacccggaccggtgggcgagcgaccccggcgccgccggcgaggccaagcggcggttccagcggatccaggaggcctattccgtcttgtcggacaaggggaagaaggccttgtacgacgccgggctcttcgatcccctggacgacgacgaccaggtgaagaaccagagcctcggtcttctttcttttctcccctcccttccgcctgctgcttgcttattgtctcgccgaaatcaagtcgaattcttttttgccatttttgtgtgagaatattatgtactacaaagttaagccgtgtttatctgcactgagacttaaatctaaac

SEQ ID NO: 26772 - protein, 135 aa, Panicum virgatum
  misc_feature: Ceres CLONE 1872608
  misc_feature (21)..(87): Pfam Name: DnaJ Pfam Description: DnaJ domain
MDAGAGAGSGNASGGGASACCYFALLGIRKNASATDIRAAYRRLAMKWHPDRWASDPGAAGEAKRRFQRIQEAYSVLSDKGKKALYDAGLFDPLDDDDQVKNQSLGLLSFLPSLPPAACLLSRRNQVEFFFAIFV

SEQ ID NO: 26773 - DNA, 686 bp, Panicum virgatum
  misc_feature: Ceres CLONE 1872644
  misc_feature: Encodes the peptide sequence at SEQ ID NO. 26774
cttccgcctgcactgcgcctactcggccgccgcggtcaccttcacgcttcaccgtcaagaaccagcacctcgtcggcgcgggcgtcctcggcgccggctccgtgcccgccgcgcgcgtcgcctcggggcagccggtcgagtgctggctcggcctccgcggcggcgagcacgcccacgagacgcactactggcgcgcgcaggtgaaccgccgcggccccatctacgtgcacgccaagctcatgatcgtggacgacgagtacgtcatcgtcggctcggcgaacctgaacgagcgatcgctggccggcaaccgggacagcgagatcgcgcaggggagctaccagccggcgcacctgaacgggccgtgcgggcgcgcgcgggggcaggtgcacgggttccggatgtcgctgtggcacgagcacttcatggcgcgccacgccggcgagggcggtggcgatgatgaccgggccgtgttcctggagcccgagagcgtggagttcgtgcgggcggtgcggcgggtcgcggagcggctgtggggcgcgtacacgcagggcagggtggagaacctgccgggccacctgctgccgttcccgataaccgtgtcggagttcggcgaggtggccgacctgccggcggacggctgcttcccggacacgagggcgccggtgagggggaggaaagcgctgaag

SEQ ID NO: 26774 - protein, 227 aa, Panicum virgatum
  misc_feature: Ceres CLONE 1872644
  misc_feature (71)..(98): Pfam Name: PLDc Pfam Description: Phospholipase D Active site motif
  misc_feature: SWISSPROT Homolog: EC 3.1.4.4 Phospholipase D
SACTAPTRPPRSPSRFTVKNQHLVGAGVLGAGSVPAARVASGQPVECWLGLRGGEHAHETHYWRAQVNRRGPIYVHAKLMIVDDEYVIVGSANLNERSLAGNRDSEIAQGSYQPAHLNGPCGRARGQVHGFRMSLWHEHFMARHAGEGGGDDDRAVFLEPESVEFVRAVRRVAERLWGAYTQGRVENLPGHLLPFPITVSEFGEVADLPADGCFPDTRAPVRGRKAL

SEQ ID NO: 26775 - DNA, 724 bp, Panicum virgatum
  misc_feature: Ceres CLONE 1872665
  misc_feature: Encodes the peptide sequence at SEQ ID NO. 26776
ggataaggacctcagggtcgccgcctccggcggcgggttcttttcttgcttccggtggtgggagcacgcgtgggcgatggcgggggaccgcgggctcctgctcctcttcctccttcttgtccgacggcgtgttccaggtgaccgctggatccacggggaggagcttgttgcaggccaagaaggattgccctgtgagctttgagttccaaaactacacaatcatcacaagcaagtgcaaagggccgaaatttcctgctagccaatgctgcgctgctctcaaggaatttgcctgcccattctatatgtacctcaatgatgacagcaacagctgtgcgtcgaccatgttcacctacatcaacctcaacggtaagtacccaccaggcctgttctccagcgagtgcaaggaaggcaagttggggctttcttgcgaaaatgtcccccaaagagatatttccactgcaaatggtggggaacgcgctcaacgcagcttccttgcatggattgtcttgagtgtggcagtagcgtcgttgttccattgaatgatagctccattcatttgcccgaaatatagggtgtttcaactgttgaggctttgagtttgatcattgcaccttatggtgctcctggtgggttagctgccagattcttcgttttgtgtgtaaaatctcttctaatataatttatgatgtattgtgtattttctggaatttgacttgtcaatgcc

SEQ ID NO: 26776 - protein, 178 aa, Panicum virgatum
  misc_feature: Ceres CLONE 1872665
  misc_feature: Functional homolog of the protein sequence given in SEQ ID NO 50713
  misc_feature: Useful for making plants with altered carbohydrate content
  misc_feature: Functional homolog of the protein sequence given in SEQ ID NO 50714
  misc_feature: Useful for making plants with altered cell wall content and/or composition
IRTSGSPPPAAGSFLASGGGSTRGRWRGTAGSCSSSSFLSDGVFQVTAGSTGRSLLQAKKDCPVSFEFQNYTIITSKCKGPKFPASQCCAALKEFACPFYMYLNDDSNSCASTMFTYINLNGKYPPGLFSSECKEGKLGLSCENVPQRDISTANGGERAQRSFLAWIVLSVAVASLFH

SEQ ID NO: 26777 - DNA, 702 bp, Panicum virgatum
  misc_feature: Ceres CLONE 1872683
  misc_feature: Encodes the peptide sequence at SEQ ID NO. 26778
acctcccgttcccgtggggtggcttctagggtttccttcctccccccgcctccccgcgccgctccctcccgcccggcagaattggatctgcgctcccgcccccggttggtccgatgggtcctggtggaaaagctgggaacgaaggagggtcattccaaaagggtcctggtctgaatgaaaaaatactggcctccatgtccaggaaatctggtgctgcgcatccttgggatgatctggagattggacctggtgcaccaaccatattcaactgggtcattgagatacccaggggcagcaaggggaagtacgaacttgacaagaaaactggactgataaagggggaccgtggactggattcatcagttgtgtaccctcacaactatggattccttcctcgcacactttgggaagaccgtgaccctctggatgtgctggttataatggaagaaccagttattccaggctggttccttcggggaaagggcatcgggcttatggctatgattgatcagggagaaggagaagaacagattattggtgtgtgcgctgatgatcctgaataccagcactacaatgatatcaaggagcttccacctcaccgcttggctgaaatcaagcgcttctttgaagactaccagaagaatgagaaccaagaagttgccgtggatgactttctgcctgctagcgctgcttatgaagcga

SEQ ID NO: 26778 - protein, 196 aa, Panicum virgatum
  misc_feature: Ceres CLONE 1872683
  misc_feature (52)..(196): Pfam Name: Pyrophosphatase Pfam Description: Inorganic pyrophosphatase
  misc_feature: SWISSPROT Homolog: EC 3.6.1.1 Inorganic diphosphatase
  misc_feature: Functional homolog of the protein sequence given in SEQ ID NO 50116
  misc_feature: Useful for making plants with modulated nitrogen use efficiency
MGPGGKAGNEGGSFQKGPGLNEKILASMSRKSGAAHPWDDLEIGPGAPTIFNWVIEIPRGSKGKYELDKKTGLIKGDRGLDSSVVYPHNYGFLPRTLWEDRDPLDVLVIMEEPVIPGWFLRGKGIGLMAMIDQGEGEEQIIGVCADDPEYQHYNDIKELPPHRLAEIKRFFEDYQKNENQEVAVDDFLPASAAYEA

SEQ ID NO: 26779 - DNA, 640 bp, Panicum virgatum
  misc_feature: Ceres CLONE 1872684
  misc_feature: Encodes the peptide sequence at SEQ ID NO. 26780
cttcgattcgcggcgcttcctctccgcgctcgccggcggagggggcggggccccgcgcgccggctcggtgtacgggttcggggacaacagccacggcgcggtgggccaggcgccgccggctgccgacgcctacgtgcccacgctcgtgccctcactcccgccgtcggtgagcgccgtcgccgccggtcactaccactccctcgccgtatccgccgccggggaggtctgggcgtggggacgcaacgacgagggccagctcggtcgcaggcttcactccccgaggtgatcaaaacccctcatacaactttcctctttttagccacggtttatcttcaaatttgttccctctttttagatggaagttagtttgatacaagcatacagcatcgggtaaatgagtaatcaaccacgatgtgtttgctccgtactagcacaagaatggatacgtgaaagctacgtggtttcctcctgatactcacgcaatcacctgattgcaccgcatatgtggatttggaggaagaaaaacagatacgcataagcagaaagcgcacatcgtgtggttgcggtgtcaattatgtatgtactacaaaataattaggagaaagcatcagggatatggaaaagagtaagaagtaaatgg

SEQ ID NO: 26780 - protein, 94 aa, Panicum virgatum
  misc_feature: Ceres CLONE 1872684
  misc_feature (20)..(69): Pfam Name: RCC1 Pfam Description: Regulator of chromosome condensation (RCC1)
  misc_feature: SWISSPROT Homolog: EC 2.7.11.1 Non-specific serine/threonine protein kinase
FDSRRFLSALAGGGGGAPRAGSVYGFGDNSHGAVGQAPPAADAYVPTLVPSLPPSVSAVAAGHYHSLAVSAAGEVWAWGRNDEGQLGRRLHSPR

SEQ ID NO: 26781 - DNA, 677 bp, Panicum virgatum
  misc_feature: Ceres CLONE 1872685
  misc_feature: Encodes the peptide sequence at SEQ ID NO. 26782
gctcggctgctcctgctccggcactgcagcctgcctcgcgcccccgcctcgatctccaccgtcgccgcgcgcgcgcccgtgagcgtgaggccgtgggcgagcggcgggccgcggggcctggcgcatgacgatgaaggggctgctccggtgcgtctcgacgggggcctgcagggtgacgccgggcgccgtggcggcgccggcgtggcacggggccggggggaaggtgccggcggggcacgtgccggtggaggtcggcgccgagggggaggagacggagcggttcgtcgtccccgccgagctgctgggccgcccgcccatcgccgagctgctccgccgcgccgcgcaggagtacggctacgcgcgccggggcccgctgcgcatcccctgccccgcggccgccttccgccgcctcctcggcacgctcgccggggccggctccggcgacggtgggctcgcggtcgcctacctcaccgtggtcgtctgaggtcggtcggagatcctcctatcgtagcggactagcggttcgatttccttgaggcgtggctgtgcaggcgtgcgttggcgctgtcattgttcttgctcctctacaggttccttttgcttcttctttttctctccttttttgtgtaataatttgtatgtaaatattttatgtaaatcccggatccaaatatgtt

SEQ ID NO: 26782 - protein, 119 aa, Panicum virgatum
  misc_feature: Ceres CLONE 1872685
  misc_feature (14)..(101): Pfam Name: Auxin_inducible Pfam Description: Auxin responsive protein
MTMKGLLRCVSTGACRVTPGAVAAPAWHGAGGKVPAGHVPVEVGAEGEETERFVVPAELLGRPPIAELLRRAAQEYGYARRGPLRIPCPAAAFRRLLGTLAGAGSGDGGLAVAYLTVVV

SEQ ID NO: 26783 - DNA, 634 bp, Panicum virgatum
  misc_feature: Ceres CLONE 1872730
  misc_feature: Encodes the peptide sequence at SEQ ID NO. 26784
cagacgaccttgcctaccgcctagcctcctcctctgctctctctagctttctccctctctgcttcttgatcgggacggcaatggcgaagggcgggctgagcaagctcaagtgcatgatcaagaggtggcactcctcgagccggatctcgcgcacgccgtcgggcagctcggcgcgctcgcacgacggcgccggcgccgccgtcggcttcgccttggaagactcgtggcggcggggcgtcccggcctcgtccgttgtcgccataggcggaggcggcggcagggggtcggcgtcattccaccacggcgcagacagcgtgcccccgggcctccacccggtgtacgtgggcaagtcgcgccgccgctacctcatcgccgcggacctcgtcggccaccccctgttccagaacctcgtcgaccgctcgggcggcgccggcgtcggagctggcggcgggaccgtcgtgggctgcgaggtcgtgctgttcgagcacctcctctggatgctcgagaacgccgacccacagccggagtcgctcgacgagctcgtcgagtactacgcgtgctgaccacctcctcacggctgtgcccaggaatgccggccgcggcgacgaggcccagctcgccagagtcacggggt

SEQ ID NO: 26784 - protein, 160 aa, Panicum virgatum
  misc_feature: Ceres CLONE 1872730
  misc_feature (41)..(142): Pfam Name: Auxin_inducible Pfam Description: Auxin responsive protein
MAKGGLSKLKCMIKRWHSSSRISRTPSGSSARSHDGAGAAVGFALEDSWRRGVPASSVVAIGGGGGRGSASFHHGADSVPPGLHPVYVGKSRRRYLIAADLVGHPLFQNLVDRSGGAGVGAGGGTVVGCEVVLFEHLLWMLENADPQPESLDELVEYYAC

SEQ ID NO: 26785 - DNA, 688 bp, Panicum virgatum
  misc_feature: Ceres CLONE 1872768
  misc_feature: Encodes the peptide sequence at SEQ ID NO. 26786
atcgcaaccgcagctagctagcacggcgtcccccgctcctgcggcagagccatccagctagcctcgctcgcttgcctccccggacgccatggcgtccgccgagcgccaccactccatcgacgcgcaggtccggcagctggcccccggcaaggtctccgaggatgacaagctcgtcgagtacgatgtcctcctcatggaccgcttcctcgacatcctcgagaacctccacggccacgacatccgcgaattcgtccaggagtgctacgagctggcggcggagtacgagggcaagcgcgacgccgaaaagcacaaggagctcgggtccaggctcgcggcgctggcccccgccgacgagaagaagcccgccgggctggtggagctcaacccggccaacgagtacgcgccaggcctcgaggacacgctcatcctcaccatgaagggtatcgccgccggcatgcagaacaccggctaggtcgacgccggccggacgccgtcaggtgctccgctcctcaactgcagactgctgctcatcgaggcaccactgtgtcgatgcgcatgtatccttttttcaattccgcactccaccactttttatccttttgatttgaatttcacgcttgatgtacgtgtcggctctgttgttattactacaaactcgtgtctgtatgagctggagctcgctcggctt

SEQ ID NO: 26786 - protein, 127 aa, Panicum virgatum
  misc_feature: Ceres CLONE 1872768
  misc_feature: SWISSPROT Homolog: EC 4.1.1.31 Phosphoenolpyruvate carboxylase
MASAERHHSIDAQVRQLAPGKVSEDDKLVEYDVLLMDRFLDILENLHGHDIREFVQECYELAAEYEGKRDAEKHKELGSRLAALAPADEKKPAGLVELNPANEYAPGLEDTLILTMKGIAAGMQNTG

SEQ ID NO: 26787 - DNA, 679 bp, Panicum virgatum
  misc_feature: Ceres CLONE 1872802
  misc_feature: Encodes the peptide sequence at SEQ ID NO. 26788
aatgataaagaacttgaactactgatcagtggtcttcctgaaattgacctggatgatctgaaggctaatgcggaatatatcggatattctgctgcatctcctgtcatccagtggttctggcaagttgttaaagctttcagcaaggaggacatggccagactactgcagtttgttactggaacatcaaaggtaccgttggaaggtttcaaagcactacaaggtatttctggtccccagagatttcagattcacaaggcttacggagctccagaccggcttccatctgctcatacatgctttaaccagttggacttaccggaatacacctcaaaggagcaattagaagagcgcctgcttcttgccattcatgaagctagtgaaggttttggctttggctgatctgttgctccatggagtgctaaagagcgcactggtcattgtttttctgcttgccatgtacagattttgaaggcaattgagatggtcacagatgctatatataacatagatcgagccaaggagcgagcgttttgggaatgctcaggttgaagttgggatccaaaattttcttggaacagtcaatcaggatgtggggcgggtacagtattagagctctgcgacaacaagaatgctggtgtaactaagcttccatttgccttcaagttaaatagtcgaatgt

SEQ ID NO: 26788 - protein, 132 aa, Panicum virgatum
  misc_feature: Ceres CLONE 1872802
  misc_feature (1)..(132): Pfam Name: HECT Pfam Description: HECT-domain (ubiquitin-transferase)
NDKELELLISGLPEIDLDDLKANAEYIGYSAASPVIQWFWQVVKAFSKEDMARLLQFVTGTSKVPLEGFKALQGISGPQRFQIHKAYGAPDRLPSAHTCFNQLDLPEYTSKEQLEERLLLAIHEASEGFGFG

SEQ ID NO: 26789 - DNA, 562 bp, Panicum virgatum
  misc_feature: Ceres CLONE 1872827
  misc_feature: Encodes the peptide sequence at SEQ ID NO. 26790
agatcgatcgagcacacgttcggcactactcatcatcacaaacttgcacactcggcgagctcgagtaattcattccacaaacactctccatcgatcgatccgatcgatctctttaattgttgactctgacatctgtgcgcgcagatcgatcgacatcgacgacgatatgagctccgtggacgccaccggcggcgagaagaagacgtcgtggccggaggtggtgggcctgccggcggaggaggccaagaagatcatcctcaaggacatgcccgacgccgacgtcgtcgtcctgccggccggctcgccggtgaccatggactggaggtccaaccgcgtccgcgtcttcgtcgacaccgtcgctcggaccccgacggtgggctgaaccaacgataaaccgcctcctgctggatcaaagccgctgctagctcacccttgattttcctgaatgtcttcaccataaaagggaagacctagagatcgaagcacaaataatggagctagctagcggctatctgaaataaaatttatggaatgcatgaataaataatgttccctgctcctc

SEQ ID NO: 26790 - protein, 71 aa, Panicum virgatum; identical to SEQ ID NO: 26583
  misc_feature: Ceres CLONE 1872827
  misc_feature (12)..(71): Pfam Name: potato_inhibit Pfam Description: Potato inhibitor I family

SEQ ID NO: 26791 - DNA, 665 bp, Panicum virgatum
  misc_feature: Ceres CLONE 1872830
  misc_feature: Encodes the peptide sequence at SEQ ID NO. 26792
attcgcacccatcgcctcaccacccaccgcttcaccaacacaagaaggaagccgcttcttctggagttgctcctcctcccatggccgactacaaccgctacggccacagctacgccggcgggtacagcagccacgcgccgccgccgacggcgccgcccgcgcccgcgcccacaacctccgcgccgccgcccccctcatacggctacggcggttacccgtcagcctacccgccgccgccccctcaggcggcggggggattcggtttcggctacggctacggctccggctccgtccccgtcgccttcccaccggggacgcacccggacgtcgagcgcgccttccgcgccgccgaccgggactgcagcggcgccatcgacgagcacgagctgcagggcgcgctctccaccgcctaccaccgcttcagcatccgcaccgtccgcctgctcatgttcctctttaacgacccggcctcctcctccccgtcacggatggggccggcacaatttgtatccctctggaattgccttgggcaatggcggggtatttttgatagatacgatagggatcggagtggaaaaattgactcccgtgagttgacggaagctcttcgcagccttggatatgccgttccaccttctgttatagagcttcttatagcgaactac

SEQ ID NO: 26792 - protein, 194 aa, Panicum virgatum
  misc_feature: Ceres CLONE 1872830
  misc_feature (151)..(179): Pfam Name: efhand Pfam Description: EF hand
  misc_feature (82)..(110): Pfam Name: efhand Pfam Description: EF hand
  misc_feature: SWISSPROT Homolog: EC 3.4.22.52 Calpain-1
MADYNRYGHSYAGGYSSHAPPPTAPPAPAPTTSAPPPPSYGYGGYPSAYPPPPPQAAGGFGFGYGYGSGSVPVAFPPGTHPDVERAFRAADRDCSGAIDEHELQGALSTAYHRFSIRTVRLLMFLFNDPASSSPSRMGPAQFVSLWNCLGQWRGIFDRYDRDRSGKIDSRELTEALRSLGYAVPPSVIELLIAN

SEQ ID NO: 26793 - DNA, 677 bp, Panicum virgatum
  misc_feature: Ceres CLONE 1872831
  misc_feature: Encodes the peptide sequence at SEQ ID NO. 26794
acacagccacaaacactcacatacttgaggactatactagctggcacatccaagtttagcttatctacttttcaccttcaagctcgatccagagaaaccaagaatggcggagagggtgtcgaggctgtcgacggagaaggcggtggtgatcttcacgaggagccagtgcccgatgtgccacacggtgtcgagcctcttcgccgagctcggcgtgtgcgcggcggtgcacgagctggacaaggacccgcgcggccgcgacatggagcgggagctcgcccgccgcctcggccgcgcgccgccggttcctgctgtcttcgtcggcggcaacctcgtcggttccaccgacaaggtcatgtcgctgcacctcgccggcaagctcgtgcccatgctgaaggccgccggcgccatatggctctgaagtctgaatcctacatccatcggcgacagcaactatatatataaatctctcgctccgatccagtattgttcagttctccaatatagttcccaaatcccaacaagaatatatgataagttttgttcagcggctagtgtaaccacttgcagggctgataagggtctggaatgaccagtccgtgtctttgaatgtacatggacatatgtaaacctgacctttccaggattttcagagtgagatatgatgtggactttgagtc

SEQ ID NO: 26794 - protein, 104 aa, Panicum virgatum
  misc_feature: Ceres CLONE 1872831
  misc_feature (14)..(77): Pfam Name: Glutaredoxin Pfam Description: Glutaredoxin
  misc_feature: Functional homolog of the protein sequence given in SEQ ID NO 51226
  misc_feature: Useful for making plants with altered protein content
MAERVSRLSTEKAVVIFTRSQCPMCHTVSSLFAELGVCAAVHELDKDPRGRDMERELARRLGRAPPVPAVFVGGNLVGSTDKVMSLHLAGKLVPMLKAAGAIWL

SEQ ID NO: 26795 - DNA, 500 bp, Panicum virgatum
  misc_feature: Ceres CLONE 1872842
  misc_feature: Encodes the peptide sequence at SEQ ID NO. 26796
gttccacccagcccctgcgctgttcgtccccttcgtttcatcctttccccacgcccgccgcctctgccctgctcctccgctccaatcctcgctgcagtggttcttccacatccgggcctattgcttcgctccaattcgacgcccagggtttggagttgctccttggcgagatttggctgctcgggctagcgcgcctgcgttcttgcgtcctcgccgcggaaccaccgcggcagctgccgccggcgagctagggtgttcaacggaatgcccctgggcaagaggggaaaagtgggcaaaggcgcacgtccaggggtggatggagaccgcatcagcgctctgccagacgcgctactgagccacgtgctctcactcctgccgggagaggaggccgtgcggacgtgcatcctggcccgacgctggcgccatctctggaagtccgcccctgccctgcgcattgggtacctcaacaagtgtgagcgcaattctgtcaatgcactccg

SEQ ID NO: 26796 - protein, 78 aa, Panicum virgatum
  misc_feature: Ceres CLONE 1872842
  misc_feature (20)..(67): Pfam Name: F-box Pfam Description: F-box domain
MPLGKRGKVGKGARPGVDGDRISALPDALLSHVLSLLPGEEAVRTCILARRWRHLWKSAPALRIGYLNKCERNSVNAL

SEQ ID NO: 26797 - DNA, 458 bp, Panicum virgatum
  misc_feature: Ceres CLONE 1872868
  misc_feature: Encodes the peptide sequence at SEQ ID NO. 26798
aaatgcacacccagcttcgttcggtatccgcccctcggcccaaactccgagctccctccgacgtctccccgagctctgacgccgccggcggcgcggcggtctgtggcggcgcactgaggcaaaagctttgcggcggcgcagtgaggcaaaagctttgcggcggcaccgtggttcagcgcggcatggcgagatctgcggcagcgcagcagtctggagctcctcggcggcgcggcggggccggagtgtggcggcccagcgcggccgggccagagctccgtgcggcgaggcggatccgagatctgcccatccggccgtggagctgcggagctcgctatcgtgcgcagcgggagctcgcgcccgcgccggcaaagctcacctgtgacggcggagcttgcgctcgccggcggtgcgcagcaggtgccggccgccagctcgccatatccttgcccgcctcccac

SEQ ID NO: 26798 - protein, 91 aa, Panicum virgatum
  misc_feature: Ceres CLONE 1872868
  misc_feature: SWISSPROT Homolog: EC 2.7.1.24 Dephospho-CoA kinase
MARSAAAQQSGAPRRRGGAGVWRPSAAGPELRAARRIRDLPIRPWSCGARYRAQRELAPAPAKLTCDGGACARRRCAAGAGRQLAISLPAS

SEQ ID NO: 26799 - DNA, 684 bp, Panicum virgatum
  misc_feature: Ceres CLONE 1872883
  misc_feature: Encodes the peptide sequence at SEQ ID NO. 26800
atcaaagcgatagaacaacgagaactcggtcctctcaaaaaaaaaacaacgagaactcgggaaaggagagggcgaaaatccgaaaggaagaagaggagagcgcgaagcaaatggcggaggcccccagcaagatcgaatccatgaggaaatgggttgtcgagcacaagctccgagccgtaggttgcctctggcttactgggatcagcagttcgatcgcctacaactggtcgcggcccaatatgaagactagcgtcaagatcatccacgcaaggttgcacgcgcaggctctaactcttgctgcattggttggttctgcatgtgtcgagtactatgataacaaatatggttcttctgggcctaaggtggacaaatacacaagccaatacttggcacattcgcataaagattaagatctccatgttggctcctgcataccggattaattttgggtgctcatgaaccatgtacctggatgctggatagttattctttgtctccccttaatgcaaaatgacagcgtacttgccagggtattcctggaaaatgacattaaggttgtagtgcagatattatcttcataatttagcctcaggttgcgttatgtaacatcacattgtggacagtcctgggatatttgtacttcttttttccagaaaagcaaaggagagagatcctgatttgtgc

SEQ ID NO: 26800 - protein, 99 aa, Panicum virgatum
  misc_feature: Ceres CLONE 1872883
  misc_feature (4)..(71): Pfam Name: HIG_1_N Pfam Description: Hypoxia induced protein conserved region
MAEAPSKIESMRKWVVEHKLRAVGCLWLTGISSSIAYNWSRPNMKTSVKIIHARLHAQALTLAALVGSACVEYYDNKYGSSGPKVDKYTSQYLAHSHKD

SEQ ID NO: 26801 - DNA, 752 bp, Panicum virgatum
  misc_feature: Ceres CLONE 1872909
  misc_feature: Encodes the peptide sequence at SEQ ID NO. 26802
aaaccggcggcactcactcctctcgtctcgtctcgccccccaccagagcatgcgcgttgccgcgacgcgactcgccgccgccgccgcccccgcccccgcccccgctccgcgccccctcctcgtcctgctgctggtcctcctcgtctccgcgcccctcgcgaccggagcagcggccatggccagccacgtcctcggcggcgtgaaggagaaccccgccgccgccaacagcgccgagtccgacgggctcggccgcttcgccgtcgatgagcgcaacaaacgccagaacgcgctgctggagttcgtgcgcgtggtagaggccaaggagcaggtggtggccggcacgctgcaccacctcacgctcgaggccattgaggccgggaggaagaaggtctacgaggccaaggtctgggtcaagccgtggctcgacttcaaggagctccaggagttcgtccacaagggggacgctaccaccttcaccagcgccgacctcggcgccaagaaaggtggacatgagcctgattggcgtgaggtgcctgtggaggatcctgttgtcaaagatgctgcacaccatgctgtgaaatcaatccaagagaggtctaactccctgtttccctatgaacttcttgagatcgtttgtgccaaggcacaggttgtggaaggcttcacgaaatttgacattctgatgaagctgaagagaggcagcaaggaggagaagatcaaagccgaggtccataagaatctggaagggggct

SEQ ID NO: 26802 - protein, 234 aa, Panicum virgatum
  misc_feature: Ceres CLONE 1872909
  misc_feature (49)..(137): Pfam Name: Cystatin Pfam Description: Cystatin domain
MRVAATRLAAAAAPAPAPAPRPLLVLLLVLLVSAPLATGAAAMASHVLGGVKENPAAANSAESDGLGRFAVDERNKRQNALLEFVRVVEAKEQVVAGTLHHLTLEAIEAGRKKVYEAKVWVKPWLDFKELQEFVHKGDATTFTSADLGAKKGGHEPDWREVPVEDPVVKDAAHHAVKSIQERSNSLFPYELLEIVCAKAQVVEGFTKFDILMKLKRGSKEEKIKAEVHKNLEGG

SEQ ID NO: 26803 - DNA, 751 bp, Panicum virgatum
  misc_feature: Ceres CLONE 1872935
  misc_feature: Encodes the peptide sequence at SEQ ID NO. 26804
ggagccctcttcagactgtaaagcgagcaaaggcatctcgttgtatgcctcctgtccaacatgtattccctcgctcttgcttcgcgcacaagcagggcattccttccttccttcctccccttccttccttgaagatccttctccatctccacacagccaggcagccagcgctaagcaacctcactcactacatatcggccttgtacattgcttccagcttcctgctgcatccgttaggacatacagacattggtcgagcagagctgccgagaagagcttgagcgaggagccgtacgcgctggaggacatgaacgccggcatgtcgccgcggccgagcacggactggggccccatcatcgtggcggtgatcctgttcgtggtgctctcgccggggctgctcttccagctccccgcgcggacgcgggtggtggagttcggcaacatgggcaccagcgccatcgccatcctcgtccacgccatcatcttcttctgcctcctcaccatcttcgtcgtcgccatcggcgtccacgtctacgccgcctaggcctagccagctcgatccccaggctgctttgacacggtgatgatgtacggctttctgcagtcccttgtaatcctgctgctcgtttcaatgaattggccggttgttacctgttctagaacccattggagcagagtgagagacagtacagttgtctgttgtcagttgagaatttagctgttcatgtacacaaaaacttcaatttggctt

SEQ ID NO: 26804 - protein, 74 aa, Panicum virgatum
  misc_feature: Ceres CLONE 1872935
  misc_feature: Functional homolog of the protein sequence given in SEQ ID NO 50117
  misc_feature: Useful for making plants with altered cell wall content and/or composition
MSPRPSTDWGPIIVAVILFVVLSPGLLFQLPARTRVVEFGNMGTSAIAILVHAIIFFCLLTIFVVAIGVHVYAA

SEQ ID NO: 26805 - DNA, 527 bp, Panicum virgatum
  misc_feature: Ceres CLONE 1872943
  misc_feature: Encodes the peptide sequence at SEQ ID NO. 26806
aaaagaacagccaccgacggacaagtcgcctccgggtctagctagggtttccgttccgcttcctctccccgcacgcgaagcagggcgcagcgttgatggcaacggcaccggcgccggcggacccgaaggcggaggcggccaagatggacctcctggaagaagaacaacaattcgaagagatcgagaacgaccaagaatgggagagacaacgaagaaaggaaaaaagcatgaagctgtccaggagtgggaggacgactgggatgatgatgacgttaatgatgatttctcgcagcagctgaggaaagaactggagggagcccagaagagctgaagtgttttcttccgtagtataaatgttactcttgtatggccgttactttctgaaccgctgtgtgcttcagacagttatgggtgcgcgtctgggagcaccacctaatttgcggaatatttctacggggaaagtttatggtcgtgctgtagtttccatattatcaatgaatttctatatgaacggcatgagtatgata

SEQ ID NO: 26806 - protein, 44 aa, Panicum virgatum
  misc_feature: Ceres CLONE 1872943
  misc_feature (3)..(41): Pfam Name: DSS1_SEM1 Pfam Description: DSS1/SEM1 family
MGETTKKGKKHEAVQEWEDDWDDDDVNDDFSQQLRKELEGAQKS

SEQ ID NO: 26807 - DNA, 611 bp, Panicum virgatum
  misc_feature: Ceres CLONE 1873006
  misc_feature: Encodes the peptide sequence at SEQ ID NO. 26808
aagctcccccccccaccagaaaacaaacaatccccaatttccttcgtgttcggcagcggcggcgatgtcggggcgcggcaagggcggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccaggggcgcaccctctacggcttcggcggctaggccgccggcgcgcctccgtcgtgtgctcgcgctccgtctcggcgcggttcctggattggggccgtctgtggttaggggtgatggttcgttgtcaagggattggctgtgttggcttagttgcggtggtggtagtagtagtagtattgctttgctcacattgttgcctcgctcaatgtagtctactactccctcctttcccgtttataagacatggtggaacatgacacggtcttct

SEQ ID NO: 26808 - protein, 103 aa, Panicum virgatum; identical to SEQ ID NO: 12044
  misc_feature: Ceres CLONE 1873006
  misc_feature (25)..(94): Pfam Name: Histone Pfam Description: Core histone H2A/H2B/H3/H4

SEQ ID NO: 26809 - DNA, 613 bp, Panicum virgatum
  misc_feature: Ceres CLONE 1873011
  misc_feature: Encodes the peptide sequence at SEQ ID NO. 26810
atctcgcaaaaaaatccccaaatcttcctcctcccaaatccctcgaatcctccgcgcctcgggcaagctctaggtcgtcgtcgcagcagcagccatgtcgggccgcggcaagggaggcaagggcctgggcaagggcggcgcgaagcgccatcggaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtgacctacacggagcacgcccgccgcaagaccgtcaccgccatggacgtcgtctacgcactcaagcgccagggccgcaccctctacggcttcggcggctgagcccctggctcccgcccgcgtcctgtgtgtcgcgtgcaggcgcaagctggggttcctgatgggttagagaagttgatgtgctgggttctgtcctgtgcctagctgcgttgtggtgttaacttaatagttggtgtttatggttgtaatggtgaagtatggtagcctatcaattgaatgaatggatgttctgaggtatgattcgtgttc

SEQ ID NO: 26810 - protein, 103 aa, Panicum virgatum; identical to SEQ ID NO: 12044
  misc_feature: Ceres CLONE 1873011
  misc_feature (25)..(94): Pfam Name: Histone Pfam Description: Core histone H2A/H2B/H3/H4

SEQ ID NO: 26811 - DNA, 667 bp, Panicum virgatum
  misc_feature: Ceres CLONE 1873035
  misc_feature: Encodes the peptide sequence at SEQ ID NO. 26812
aacaacgctatcccatcgagacaaaaatatcccccacccacgacgagcgccagcagcagcagcagccatggggatagccgtggtggttcccgtcgcggcggcctcctcctcctacctcggggcgccgccgaggcgcgccgcggcgccggcgcgcgcccacgtcgcagcggccgggatgtccgcgagggcgtcttccttcgtcgggaccgggctcgcgggggcggccgcgtcggtggccgcgcggccgaggaggagggccggctcggggggcggcggggcgctcgggtgcaagtgcctgttcgggctcggggtgcctgagctcgcggttatcgccggcgtcgccgcgctcgtgttcgggcccaagcagctccccgagatcggccgcaacatcggcaagaccgtcaagagcttccagcaggaacaaacaggtctctggtctaaaaattcaggtgatttgtgggtcatgatttggttgctggcgccctggcatgctctgggtttacccaatctacttggtaggatataaaagctgcagagaagtggtttcaagggttacaaggggcagctcgcagaagttgagaagtgcattcattttacaatgtctccagttagttgaacttgtttttaggaggcagtctgtggagaagctcactagtggctagagctt

SEQ ID NO: 26812 - protein, 152 aa, Panicum virgatum
  misc_feature: Ceres CLONE 1873035
  misc_feature (80)..(129): Pfam Name: MttA_Hcf106 Pfam Description: mttA/Hcf106 family
MGIAVVVPVAAASSSYLGAPPRRAAAPARAHVAAAGMSARASSFVGTGLAGAAASVAARPRRRAGSGGGGALGCKCLFGLGVPELAVIAGVAALVFGPKQLPEIGRNIGKTVKSFQQEQTGLWSKNSGDLWVMIWLLAPWHALGLPNLLGRI

SEQ ID NO: 26813 - DNA, 631 bp, Panicum virgatum
  misc_feature: Ceres CLONE 1873101
  misc_feature: Encodes the peptide sequence at SEQ ID NO. 26814
aagaaacactccaagcaaacgatcagaagctaaccaaatcactcgatcctcacccaagaatcctcgattactcagaaacaccacttcagaaaacccaccgaccatgtcgctgatccgccgcagcaacgtgttcgaccccttctccctcgacctctgggacccctttgagggcttccccttcggctccggcagcagcagcagcaacaaggagcaggaggagaagacggacacctggcaccgcgtcgagcgcagcagcggcaggttcatgcgcaggttccggctgccggagaacgccaagacagagcagatcagggcgtccatggagaacggcgtgctcaccgtcaccgtgcccaaggacgaagtcaagaagcccgaggtgaagtccatccagatctccggctagacatcatcgtgcctgcgtgatgaagcatgctgctgacctctggagtccgcctgggtcgtgctgctgacgaaataaaaatcgggttcgacgttgtggtctcgtgtagtgtcagtccgcgtgatgggcatgtcgtccctgcgtctggcatggcatggtttgagtccagtttgcgctcattagtgtgtctgtatttagtctccatctggtaatgaactccaatgttgtcgt

SEQ ID NO: 26814 - protein, 99 aa, Panicum virgatum
  misc_feature: Ceres CLONE 1873101
  misc_feature (16)..(98): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFEGFPFGSGSSSSNKEQEEKTDTWHRVERSSGRFMRRFRLPENAKTEQIRASMENGVLTVTVPKDEVKKPEVKSIQISG

SEQ ID NO: 26815 - DNA, 508 bp, Panicum virgatum
  misc_feature: Ceres CLONE 1873133
  misc_feature: Encodes the peptide sequence at SEQ ID NO. 26816
cttcctgcttctcgatcggattgggttgggggttctgggtaggtgtggtgtgcacgggagttggggcttcttcgttgctttgcttcgctcgtgcgcaagggagagagaacagggaggagaagtacgcggggaggcagatggcatcccagcagcatccccaaggactctcacggccccgccgaaggatcctcccacctcctgcagcgaacgcccagtcgcggaacatatgttcccctggccagcgacgattatgggtccctcagatagcccatactttggcggcgtccttttggtcacaattcacttccctccagactacccattcaaaccgcctaaggttgcattccatacaaaggtcttccatccgaatatcaccagcaatgggagcatctgtcttgatatcttgaaggaacaatggagcccaacattgacagtttctgagggactactctcattttgctcccttttgacacacccaagccctgatgacccattgctcccagaagat

SEQ ID NO: 26816 - protein, 168 aa, Panicum virgatum
  misc_feature: Ceres CLONE 1873133
  misc_feature (51)..(168): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
FLLLDRIGLGVLGRCGVHGSWGFFVALLRSCAREREQGGEVRGEADGIPAASPRTLTAPPKDPPTSCSERPVAEHMFPWPATIMGPSDSPYFGGVLLVTIHFPPDYPFKPPKVAFHTKVFHPNITSNGSICLDILKEQWSPTLTVSEGLLSFCSLLTHPSPDDPLLPE

SEQ ID NO: 26817 - DNA, 755 bp, Panicum virgatum
  misc_feature: Ceres CLONE 1873134
  misc_feature: Encodes the peptide sequence at SEQ ID NO. 26818
atcacacactcggacctgagctgatccaccactacagcctgcagttgcagatcgagagaagcaaaaccatggcgtcgtccaaggcgctcctagtgcttgcgctcctgctcgctgctgccttccttgtcgcctcagctaataacgagcacacccagccaaaggaggaggagaacaagcaggccggcgtgcaggactaccacggcggcggctaccccggcggcggctggcgcgggggaggctaccctggccacggcggcggctaccctggccgcggccgcggcgggtactgccagtgggggtgctgcaaccgcggctactacggcggctgccgctgctgctcacgccccgacgagatcccggagcccatgtaccgcccggagttcgtcgaggtccacgactgaataatgaagaagctgcacggcctcgttgccatgtactagtcgatcggtaaaagtatgggttgaacaataaaggcatgcatatatatatatgtatgcaattgtgcgtgtgaatgtatgtccgtgtgtggtggttggagtcgatatgcagtagaatgtaactctcatgcatgtatagtagggaaccggatcagctgacgttggggctgctgacattgggtcactgccagcgggccccagcgctagtgggccccacatgcagtggctcaaagtcagccaccccaactgcagcggatctcaatccgtatagtagtgcatgccgccttcgaataaaaataagagagtcgttgttgctat

SEQ ID NO: 26818 - protein, 110 aa, Panicum virgatum
  misc_feature: Ceres CLONE 1873134
  misc_feature (1)..(87): Pfam Name: GRP Pfam Description: Glycine rich protein family
MASSKALLVLALLLAAAFLVASANNEHTQPKEEENKQAGVQDYHGGGYPGGGWRGGGYPGHGGGYPGRGRGGYCQWGCCNRGYYGGCRCCSRPDEIPEPMYRPEFVEVHD

SEQ ID NO: 26819 - DNA, 523 bp, Panicum virgatum
  misc_feature: Ceres CLONE 1873137
  misc_feature: Encodes the peptide sequence at SEQ ID NO. 26820
agatcgatcgagcacacgatcggcactactcatcatcacaaacttgcacactcggcgagctcgaatcgatcgacatcgacgacgatatgagctccgtggacgccaccggcggcgagaagaagacgtcgtggccggaggtggtgggcctgccggcggaggaggccaagaagatcatcctcaaggacatgcccgacgccgacgtcgtcgtcctgccgggcggctcgccggtgaccatggactggaggtccaaccgcgtccgcgtcttcgtcgacaccgtcgctcggaccccgacggtgggctgaaccaacgataaaccgcctcctgctggatcaaagccgctgctagctcacccttgattttcctgaatgtcttcaccataaaagggaagacctagagatcgaagcacaaataatggagctagctagcggctatctgatataaaatttatggaatgcatgaataaataatgttccctgctcctcaataaagaaatgaattatgagcatgcagcttaactttggct

SEQ ID NO: 26820 - protein, 71 aa, Panicum virgatum
  misc_feature: Ceres CLONE 1873137
  misc_feature (12)..(71): Pfam Name: potato_inhibit Pfam Description: Potato inhibitor I family
MSSVDATGGEKKTSWPEVVGLPAEEAKKIILKDMPDADVVVLPGGSPVTMDWRSNRVRVFVDTVARTPTVG

SEQ ID NO: 26821 - DNA, 705 bp, Panicum virgatum
  misc_feature: Ceres CLONE 1873138
  misc_feature: Encodes the peptide sequence at SEQ ID NO. 26822
cttgcttgcttgcttgattgattgctttccgtgtagccgaagaagaatcaatccaccgtccgctcgcctcaggagaagaaccaatcaatggcgcccctcggagacggatcagcttccggcgcgtcgcccaacctggtggtgtcgttcggcgagatgctcatcgacttcgtgcccgacgtggcgggcctctcgctcgccgagtcgggcggcttcgtcaaggcccccggcggcgcgcccgccaacgtcgcctgcgccatctccaagctcggcggctcctccgccttcctcggcaaggtaacgcgccatatccatccatcacacttcatcagctcgcgcccgcttgctggaattgtctcgcctcgcgcgcattctgccggatcgtgattgctctgcttctagctaggggcagttactagtcgttgcacggttccgtatgaatcccgccggcccgcgcctagatccggtgccaccggggggacggttggtgggcagcttgggtgaactggcggcggatctggtgggtgcggatctgctcgagcccccgccgggcattgcgccgccggatccggcgagatctggcggcgatcgccgggcgttgacccggcgcgctgcgactgttgttgcattgcgctactcccgcggatgacatgatgatggatgatgtgatgccactttgaagcgcgcgattttttttttattttctgg

SEQ ID NO: 26822 - protein, 98 aa, Panicum virgatum
  misc_feature: Ceres CLONE 1873138
  misc_feature: SWISSPROT Homolog: EC 2.7.1.4 Fructokinase
MAPLGDGSASGASPNLVVSFGEMLIDFVPDVAGLSLAESGGFVKAPGGAPANVACAISKLGGSSAFLGKVTRHIHPSHFISSRPLAGIVSPRAHSAGS

SEQ ID NO: 26823 - DNA, 721 bp, Panicum virgatum
  misc_feature: Ceres CLONE 1873144
  misc_feature: Encodes the peptide sequence at SEQ ID NO. 26824
ctcccctccgccgccgccgccgccgccgccgaatcagccaagatgaagaccatcctggcttccgagaccatggacatccccgaggaggtcaccgtcaaggtggcggcgaaggtggtcacggtggaggggccgcgcggcaagctcacccgcaacttcaagcacctcaacctcgacttccagctgcaggagggcggccgcaagctcaaggtcgacgcctggttcggcacccgccgcaccatggccgccatccgcaccgccatctcccacgtccagaacctcatcaccggcgtcaccaagggataccgctacaagatgcgattcgtctacgctcacttccccatcaacgcctccatcaccaacgccaacaccgccatcgagatcaggaactttctcggagagaagaaggtgaggaaggttgacatgcttgaaggtgtgaccattctgcgttctgagaaggtcaaggatgagctcattcttgatggcaatgatatcgagcttgtctctcgctctgctgctctcataaatcagaaatgccacgtgaagaacaaggatatcaggaagttcttagatggtatctatgtgagtgacaagggtgccatcgctgaggagcagtgagctctttgttgctctctgtgcccctgctagggaaacatgtgttagacagaactgggggtcatcctttttgtgctgtgttttttggtcagtcaattacagacttcac

SEQ ID NO: 26824 - protein, 190 aa, Panicum virgatum
  misc_feature: Ceres CLONE 1873144
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASETMDIPEEVTVKVAAKVVTVEGPRGKLTRNFKHLNLDFQLQEGGRKLKVDAWFGTRRTMAAIRTAISHVQNLITGVTKGYRYKMRFVYAHFPINASITNANTAIEIRNFLGEKKVRKVDMLEGVTILRSEKVKDELILDGNDIELVSRSAALINQKCHVKNKDIRKFLDGIYVSDKGAIAEEQ

SEQ ID NO: 26825 - DNA, 740 bp, Panicum virgatum
  misc_feature: Ceres CLONE 1873160
  misc_feature: Encodes the peptide sequence at SEQ ID NO. 26826
gagacgagatccattccctccgccgcggcgcctcagctgagagccctccaaccctagccagcgagcgcgagcagcccagccatggcgcggtccctcgcgctcgtcgccctcctcctcctcggcctcgccgccgccgccgcctcggcggccgacgcgcccttcgtcgtcgcgcacaagaaggtgtcgctctcccgccccaagcccggcgtcgagcgcgttgccgtctccctcgacctctacaaccagggatccgcgactgcctatgatgtgaccattaatgatgactcttggccaacagaagcatttgagcttgtcactggagagaaatcgaagacattggaaagacttgaccccggtgccactgcttcacacacatttgtcctggaaaccaaaacacaaggcaggttccagggttcaccagctgttattacataccgtgttcccaccaagaccgctcttcaggaggcctactcaacccccatcttcccactcgatattctcgctgagagacctccagtgaagaagtttgaatgggctaagaggcttgtggcgaaatatgggtcactggtttctgttgtctcgttcgttggtgtgtttatctacctggtggcgagcccgtcgaagagcagctcaaaagcaagcaagaagagacgttgatctactcgtaggtcgtcgttgccagtgttgctggctgttttgcgtggaggaactcttgatcggttgagctgaacgaaagcttt

SEQ ID NO: 26826 - protein, 191 aa, Panicum virgatum
  misc_feature: Ceres CLONE 1873160
  misc_feature (10)..(189): Pfam Name: TRAP_beta Pfam Description: Translocon-associated protein beta (TRAPB)
MARSLALVALLLLGLAAAAASAADAPFVVAHKKVSLSRPKPGVERVAVSLDLYNQGSATAYDVTINDDSWPTEAFELVTGEKSKTLERLDPGATASHTFVLETKTQGRFQGSPAVITYRVPTKTALQEAYSTPIFPLDILAERPPVKKFEWAKRLVAKYGSLVSVVSFVGVFIYLVASPSKSSSKASKKRR

SEQ ID NO: 26827 - DNA, 678 bp, Panicum virgatum
  misc_feature: Ceres CLONE 1873168
  misc_feature: Encodes the peptide sequence at SEQ ID NO. 26828
caagaaccacaacctgcccctggcgcgcatcaagaagatcatgaaggcggacgaggacgtccgcatgatcgccgccgaggcgcccgtcgtcttcgcccgcgcctgcgagatgttcatcctcgagctcacgcaccgcggctgggcgcacgccgaggagaacaagcgccgcacgctgcagaagtccgacatcgccgccgctgtcgcgcgcaccgaggtcttcgacttcctcgtcgacatcgtgccgcgcgacgaggccaaggacgccgaggccgccgcggccgccggcatgggggccgggatcccgcaccccgccgccggcatgcccgccgccgaccccatgggctactactacgtccagccgcagtaaacccatttccgttccttgtcttttaatcttagcttcgatcgagccttgcgagttttagtaaattgttactgagagtgcgcagttgtttcccttgttctgttgttgccgcctaataactctaaagatggcgtgatgatcatctgatgtgccccctcttgaatactccccaagttatttgatttcagatttgagagaggtgagctgtcataattgagagagggactgagggaggctgtgtgatggtgatgattcatgcgtaactgaaactccttccataattattaatcgtgtgccactctctgattattgtc

SEQ ID NO: 26828 - protein, 121 aa, Panicum virgatum
  misc_feature: Ceres CLONE 1873168
  misc_feature (3)..(67): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1108 in the 10/374,780 US patent application
  misc_feature: The sequence is a functional homolog of SEQ ID NO 1109 in the 10/374,780 US patent application
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1107 in the 10/374,780 US patent application
  misc_feature: Functional homolog of the protein sequence given in SEQ ID NO 51228
  misc_feature: Useful for making plants with altered alkaloid content
  misc_feature: Useful for making plants with altered lignin content
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: Functional homolog of the protein sequence given in SEQ ID NO 51229
  misc_feature: Useful for making plants with altered terpenoid content
  misc_feature: The sequence is a functional homolog of SEQ ID NO 712 in the 11/479,226 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: Functional homolog of the protein sequence given in SEQ ID NO 51230
  misc_feature: Useful for making plants with modulated cold sensitivity
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: The sequence is a functional homolog of SEQ ID NO 1004 in the 10/225,066 US patent application
  misc_feature: The sequence is a functional homolog of SEQ ID NO 340 in the 10/374,780 US patent application
  misc_feature: The sequence is a functional homolog of SEQ ID NO 450 in the 11/435,388 US patent application
  misc_feature: The sequence is a functional homolog of SEQ ID NO 122 in the 10/225,068 US patent application
  misc_feature: The sequence is a functional homolog of SEQ ID NO 1957 in the 11/479,226 US patent application
  misc_feature: The sequence is a functional homolog of SEQ ID NO 344 in the 10/374,780 US patent application
  misc_feature: The sequence is a functional homolog of SEQ ID NO 380 in the 10/225,066 US patent application
  misc_feature: The sequence is a functional homolog of SEQ ID NO 670 in the 11/435,388 US patent application
KNHNLPLARIKKIMKADEDVRMIAAEAPVVFARACEMFILELTHRGWAHAEENKRRTLQKSDIAAAVARTEVFDFLVDIVPRDEAKDAEAAAAAGMGAGIPHPAAGMPAADPMGYYYVQPQ

SEQ ID NO: 26829 - DNA, 760 bp, Panicum virgatum
  misc_feature: Ceres CLONE 1873173
  misc_feature: Encodes the peptide sequence at SEQ ID NO. 26830
cggcttgaaaattcagattaaccgcaccaaatcctgctgaactgaaaggtgacactgaccgattcagtttctgaacacgggatggtttcaggagtacctctactacttctgcgaccccctggtgttccatgtctccgtcgactccggcaacgtgctcatggacgccaacttcgtcgccaagctatcaaacgtcggtgtggtcagcgacgacttgaagcgcgcgacaaccgaatccttccaagaccaggttgagcagaggcgcgcggggctggtgttccagtacggcgtgctggtgctggagctggtgacggggcagtcgcccggcggcgacggcgagctcgtgcggtgggtgcaggagcccgggttcgccggctccatgcacaggatggtggacgccgacctcggcggcgtctacgacgccagggagctccgggacctcgtcaacgtcgcgaggctgtgcaccaggcacgagcccggcggcggcggcggcgatggcgccgccgtctccataccgcggatcgtccggtacttgcagggcaaggtcgagcggcttgggggcgaggcaaggtcaaggtgtggatgattcgtcgtccaggggggtcatatctgattactgctacagctacaccctctctgcgcatcctctttttttttttcttctttattagcgtttccttgtagaaaagtgcgaggtttttgtccgatggtattctggaatttgttcgtgtcaatagaagcaaccaaggtgacaggtttcgtg

SEQ ID NO: 26830 - protein, 141 aa, Panicum virgatum
  misc_feature: Ceres CLONE 1873173
  misc_feature: SWISSPROT Homolog: EC 2.7.11.1 Non-specific serine/threonine protein kinase
MDANFVAKLSNVGVVSDDLKRATTESFQDQVEQRRAGLVFQYGVLVLELVTGQSPGGDGELVRWVQEPGFAGSMHRMVDADLGGVYDARELRDLVNVARLCTRHEPGGGGGDGAAVSIPRIVRYLQGKVERLGGEARSRCG

SEQ ID NO: 26831 - DNA, 683 bp, Panicum virgatum
  misc_feature: Ceres CLONE 1873190
  misc_feature: Encodes the peptide sequence at SEQ ID NO. 26832
ggcgagcgggcgagcggcgagaacctcggctcacagaaggaagggtacgaggagagggggctgtaagaggatggggtcggcgttgctgccgacgctgcggctgaagcgggaggtggacgctgccatccgcgacaccctcgacaaggtcctcgtccttcgattcggccgcaccgccgacgccgcctgcctccacctagactacatccttgctaaatcttcatgggacatatccaagtttgcttcggtagcattggttgatatggattctgaggaaattcaagtttacattgattattttgatattacattggttccagcaaccatatttttcttcaatgcccatcacatgaaaatggattcagggacacctgatcacacaaagtggataggctctttcagcattaagcaagactttattgatgtaattgaggcaatttttagaggtgcgatgaaaggtaaattgatagtgtcttgcccccttccacctgagaggatacccagattccagcttcttttcaaggatgtctgaggaaactatagctcgtcaactctcacatgcttaatcgttgtcttcgtcatgatgatctgccgaaggatatggatctgtccatggccagctgaagtttgtgaagaataatcatgagctagtacccgtaaagatatctttcatctcacttccttac

SEQ ID NO: 26832 - protein, 152 aa, Panicum virgatum; identical to SEQ ID NO: 10087
  misc_feature: Ceres CLONE 1873190
  misc_feature (5)..(139): Pfam Name: DIM1 Pfam Description: Mitosis protein DIM1

SEQ ID NO: 26833 - DNA, 749 bp, Panicum virgatum
  misc_feature: Ceres CLONE 1873196
  misc_feature: Encodes the peptide sequence at SEQ ID NO. 26834
gcagatcgatcgagcaccccaaacttgcacacaatcaccatcagttctagtagacaggacatatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacagaagcgccttgggcttcaaccagcatgcactgctgcctgaagggcaaacaatctagttgtacagctaacagttgctaggtttgcgctcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgcctttgccggaaataaatactgtatgtttgctgtaaagcctaagccattggccctctggttgtatctgttgatatagtagtggcttcctgttgtttggcctttgttgtaacataagcagaggcgcactagccttcgtttacagttaagctgaattattagtaccagctttcctggactgtttggtatgtaatatgaccttgtttcttg

SEQ ID NO: 26834 - protein, 71 aa, Panicum virgatum; identical to SEQ ID NO: 19463
  misc_feature: Ceres CLONE 1873196
  misc_feature (12)..(71): Pfam Name: potato_inhibit Pfam Description: Potato inhibitor I family

SEQ ID NO: 26835 - DNA, 716 bp, Panicum virgatum
  misc_feature: Ceres CLONE 1873201
  misc_feature: Encodes the peptide sequence at SEQ ID NO. 26836
tgagcgaggagaacaggtgcctggccgaggcgctcacggcggtggccgccaagtacgaggcgctgcggagccagtacacgcagatggtcgccgcgggcgccaccaccaccggcccgtcctccacgtcggagggcgggtcggtgtcgccgtcgaggaagcgcaagacgagcgagagcctggacaccgcggcggcggcgccgggcgcgcagcacccgcagtacggcctgcacggcgggccgcacccgggcgccgcggcggcggcggaccagacggagtgcacctccggcgagccgtgcaagcgcatccgggaggagtgcaagcccaaggtgtccaagctgtacgtgcacgcccacccgtcggacctgagcctggtggtgaaggacggctaccagtggcgcaagtacgggcagaaggtgaccaaggacaacccctgcccgcgggcctacttccggtgctccttcgcgccggcctgccccgtcaagaagaaggtgcagcgcagcgccgacgacaacaccatcctggtggccacgtacgagggcgagcacaaccacggccggcccccgccggcgccggcgcagcaggcgcacgacggcccgggcgccagcaagaacgccgccgcctagccgccgtcgccgcccaggcccgccgccccgccggcgcctcaccacctgctgctcctgctcctggatgtgtgtctgatcagtgactggctgctt

SEQ ID NO: 26836 - protein, 206 aa, Panicum virgatum
  misc_feature: Ceres CLONE 1873201
  misc_feature (125)..(185): Pfam Name: WRKY Pfam Description: WRKY DNA -binding domain
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 108 in the 10/225,068 US patent application
  misc_feature: The sequence is a functional homolog of SEQ ID NO 1330 in the 11/479,226 US patent application
  misc_feature: The sequence is a functional homolog of SEQ ID NO 218 in the 10/225,066 US patent application
  misc_feature: The sequence is a functional homolog of SEQ ID NO 2458 in the 10/374,780 US patent application
  misc_feature: The sequence is a functional homolog of SEQ ID NO 620 in the 10/412,699 US patent application
SEENRCLAEALTAVAAKYEALRSQYTQMVAAGATTTGPSSTSEGGSVSPSRKRKTSESLDTAAAAPGAQHPQYGLHGGPHPGAAAAADQTECTSGEPCKRIREECKPKVSKLYVHAHPSDLSLVVKDGYQWRKYGQKVTKDNPCPRAYFRCSFAPACPVKKKVQRSADDNTILVATYEGEHNHGRPPPAPAQQAHDGPGASKNAAA

SEQ ID NO: 26837 - DNA, 729 bp, Panicum virgatum
  misc_feature: Ceres CLONE 1873222
  misc_feature: Encodes the peptide sequence at SEQ ID NO. 26838
aattaggcccacttaaacgtgtcctgtttctcgtttccacggcatccgcacgccgccggcgaggttagcgggcggcacacaccgccggcgagcggacgagcggcgagaacctcggctcacagaaggaaagggtacgaggagaggcggccggtaagaagatggggtcggcgttgctgccgacgctgcggctgaagcgggaggtggacgccgccatccgcgacaccctcgacaaggtcctcgtccttcgattcggccgcaccgccgacgctgcctgcctccacttagacgacatccttgctaaatcgtcgtgggacatatccaagtttgcttcaatagcattggttgatatggattctgaggagattcaagtttacattgattattttgatattacattggttccagcaaccatatttttcttcaatgcccatcacatgaaaatggattcagggacacctgatcacacaaagtggataggctcttttagcagcaagcaagacttcattgatgtagttgaggcaatttttagaggtgcgatgaaaggtaaattgatagtgtcttgcccccttccacctgagaggatacctagattccagcttcttttcaaggatgtctgaggaaacgatagcccattagctctcacatgcttaatcattgtgttcgtcattgtatagaaagaaaatgttttactttagtatacacaaccagctacctagctcatgtactgtt

SEQ ID NO: 26838 - protein, 152 aa, Panicum virgatum
  misc_feature: Ceres CLONE 1873222
  misc_feature (5)..(139): Pfam Name: DIM1 Pfam Description: Mitosis protein DIM1
MGSALLPTLRLKREVDAAIRDTLDKVLVLRFGRTADAACLHLDDILAKSSWDISKFASIALVDMDSEEIQVYIDYFDITLVPATIFFFNAHHMKMDSGTPDHTKWIGSFSSKQDFIDVVEAIFRGAMKGKLIVSCPLPPERIPRFQLLFKDV

SEQ ID NO: 26839 - DNA, 728 bp, Panicum virgatum
  misc_feature: Ceres CLONE 1873257
  misc_feature: Encodes the peptide sequence at SEQ ID NO. 26840
aaaaatccccgtctccgactctccgtgccttcccgactctcgccctcgaagcagccaacagccatggcggcggtgcacctgaccgggccgcgggtggcggtggccgcgaagccggccgcgctgggcgggctccgcctgccgacgccgtcgattaccgtgccgagcgggcggagggcccgggggctcgtggtgagggccgccacggtcgtgtcacccaagtatacttccattaaaccattaggagacagagtacttgtgaaggtcaagacctccgaggctaaaagtgagggagggattttacttccagtatcagttcagacaagaccacaaggaggggaagttgttgctgttggagagggaagaagttttgggagtaaaagtattgagatcagcgttccgattggtgcgcaagttgtctactcaaaatacgcgggcacagaattggaattcaatgatgctgaccatcttattttgaaagaagatgacatcatcggtattcttgatggtgatgatgtgaaagatctgaagccgctgaatgaccgcattctgataaagattgctgaagctgaagaacaaactgctggtggtttgctactgacgcaggcaactaaagataaaccttctgttggaacagtggtagccgttggccccgggccattgggcgaggacggcagcaggacgccgctgtccatcactcctggaaagcacgtgatgtacacccagtatgc

SEQ ID NO: 26840 - protein, 221 aa, Panicum virgatum
  misc_feature: Ceres CLONE 1873257
  misc_feature (55)..(146): Pfam Name: Cpn10 Pfam Description: Chaperonin 10 Kd subunit
  misc_feature (153)..(221): Pfam Name: Cpn10 Pfam Description: Chaperonin 10 Kd subunit
MAAVHLTGPRVAVAAKPAALGGLRLPTPSITVPSGRRARGLVVRAATVVSPKYTSIKPLGDRVLVKVKTSEAKSEGGILLPVSVQTRPQGGEVVAVGEGRSFGSKSIEISVPIGAQVVYSKYAGTELEFNDADHLILKEDDIIGILDGDDVKDLKPLNDRILIKIAEAEEQTAGGLLLTQATKDKPSVGTVVAVGPGPLGEDGSRTPLSITPGKHVMYTQY

SEQ ID NO: 26841 - DNA, 723 bp, Panicum virgatum
  misc_feature: Ceres CLONE 1873265
  misc_feature: Encodes the peptide sequence at SEQ ID NO. 26842
aagctatccaccaccatagccgccccgtcgccacactcttcttgctcacggctctagcccaccgagcgcaggaatggcgtcgttcgccgtggcaacgatcccgtcgctggcggccccggcggccaggaagaggtccggcggcgtcacctacgtggagggcatgaacgcctacagcggcctcaaggggctcaacaaggtcaccatgctcgggctgcgcaagaccgccgactactccttcgccaagatcgtggcgtcgctcagccccgccggcaaggcgcggcgcggcagcgcgttcggggcgcagatgaacgccgccgcggagatcttcaggatcgccgccatcatgaacggcctcgtgctcgtcggcgtcgccgtcgggttcgtgctgctccgggtggaggccgccgtcgaggaggccgagtaggggtggatgcccgcgcccgccctgattgcagccactccggctgtcgcctcttgcctcatataagccgtgatatataaaacgtgacgtatgcttttggttgaatttacttcggtatgtatccatgacaattgatgaataccgtgcaaacatgtttctggtcttctggagtcgaggtctgcaatggatcttcaggtgtttttgcgactctctgagatcagaatgcaaaaacatccacgtcttgcaaatgaaatcgtgtacaaatttgtagcaggagggagagagggcaccaaagtttttac

SEQ ID NO: 26842 - protein, 116 aa, Panicum virgatum; identical to SEQ ID NO: 14270
  misc_feature: Ceres CLONE 1873265
  misc_feature (78)..(114): Pfam Name: PetM Pfam Description: PetM family of cytochrome b6f complex subunit 7

SEQ ID NO: 26843 - DNA, 431 bp, Panicum virgatum
  misc_feature: Ceres CLONE 1873281
  misc_feature: Encodes the peptide sequence at SEQ ID NO. 26844
cgacgcttgagaacctgttcagcgagcaagggcaggtgcttgatgctaaggtcatctacgatagggaaagcggcaggtcaaggggatttggttttgtcacctatcgtaccactgaggaggtcaacaatgccatatcaaacctcgatggcatcgacttggatggcagacagatccgagtcacggttgcggaatcaaagccgagacgccaattttgaaatttcatgatggtgatttagaggttaatagtgtgtttcgccaagtgttagttcctagcttctattattgccaccatattatgagtaaaatgaagattcggatgatgggggctggaagtgaaattgttgtataccgggagaatttcccagactgcaatgaacacaaacgctcttatgttcattgcgctttcaaaaagaagtagaaatattcttgtc

SEQ ID NO: 26844 - protein, 70 aa, Panicum virgatum
  misc_feature: Ceres CLONE 1873281
  misc_feature (1)..(59): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50210
  misc_feature: Useful for making plants with modulated biomass
TLENLFSEQGQVLDAKVIYDRESGRSRGFGFVTYRTTEEVNNAISNLDGIDLDGRQIRVTVAESKPRRQF

SEQ ID NO: 26845 - DNA, 704 bp, Panicum virgatum
  misc_feature: Ceres CLONE 1873282
  misc_feature: Encodes the peptide sequence at SEQ ID NO. 26846
aacaaccaaaggagagcacccgcgcatgtttagcttcgccgggcgcgcctccaccgcatcgagcatcgtcgccagcctcgccacccccgcgccgccgccgccaccatgggccgaagacctgcgaggtgctatcgccagatcaagaacaaaccatatcccaagtcaaggtattgtcgtggtgttcctgaccccaagatcaggatctatgatgttggaatgaagaagaagggagttgatgagttcccctactgtgtgcaccttgtctcttgggaaaaggagaatgtctctagtgaggctcttgaggctgcccgtatcgcgtgcaacaaatacatgaccaagtctgcaggaaaggatgccttccacctcagggtccgggttcaccccttccatgtgctccgtatcaacaagatgctttcgtgtgctggggctgataggctccagactggaatgaggggtgccttcggcaagccccagggtacctgtgctcgggtggacattggccaggttcttctttctgtgcgctgcaaggacaacaatgctgcccatgccagtgaggctctgcgtcgtgccaagttcaagttccctggtcgccaaaagatcattgagagcagaaagtggggcttcaccaagtggcgagacagagcacgaacagatctagagagagagagagagcgagcgagagggcattttcctttttgagatag

SEQ ID NO: 26846 - protein, 197 aa, Panicum virgatum
  misc_feature: Ceres CLONE 1873282
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKWRDRARTDLERERERARGHFPF

SEQ ID NO: 26847 - DNA, 830 bp, Panicum virgatum
  misc_feature: Ceres CLONE 1873289
  misc_feature: Encodes the peptide sequence at SEQ ID NO. 26848
aactccaactactcccagatttctccccttctcccgccgccttcacccaggaaccctctcgacaccgccatggcctcatcgaacggcgccgccgccaccgacgccgtccaggagcctccccagaagatatccaagctcgcgcccctgctcaaggtgaagaagctctccgacaaggccgtcctgccgtcccgcggctccgccctcgccgccggctatgacctctcgagcgcggcggagatggtggtgccggcgcgggggaaggcgctggtgccgacggacctcagcatcgccatcccggagggaacctacgcgcgcgtggcgccgaggtcggggctcgcgctgaagcactccatcgacgtgggcgccggcgtgatcgacgcggactaccgcggccccgtgggggtcatcctcttcaaccactcggacgcggacttcgccgtgaagcccggcgaccggatcgcccagatgatcatcgaggtgatcgcgacgccggaggtcgcggaggtggaggacctcgacgccacggtgcgcggcgagggagggttcggatccaccggcgtctgagccgtgtcggtctctccgctccaaggagggacggtagttcatcagtacccccactctctaggttagtatggcgatgcgagtaggcagcattggtgtgtcttttgttggctgtaagagctcgtgatgttaaggtggcactttcctgcaattgaacatgtcgagaagtttagggttgcgtcggtagctgaatgcaggaaatgctaagaacctgtttcttcagtgatgttactgtgcacctagtagtgttggggtcatttctgaatatc

SEQ ID NO: 26848 - protein, 164 aa, Panicum virgatum
  misc_feature: Ceres CLONE 1873289
  misc_feature (34)..(163): Pfam Name: dUTPase Pfam Description: dUTPase
  misc_feature: SWISSPROT Homolog: EC 3.6.1.23 dUTP diphosphatase
MASSNGAAATDAVQEPPQKISKLAPLLKVKKLSDKAVLPSRGSALAAGYDLSSAAEMVVPARGKALVPTDLSIAIPEGTYARVAPRSGLALKHSIDVGAGVIDADYRGPVGVILFNHSDADFAVKPGDRIAQMIIEVIATPEVAEVEDLDATVRGEGGFGSTGV

SEQ ID NO: 26849 - DNA, 734 bp, Panicum virgatum
  misc_feature: Ceres CLONE 1873340
  misc_feature: Encodes the peptide sequence at SEQ ID NO. 26850
gtggcagttcattccctcccctcgaaagacaaagccgaatcggataagcccctcttccccctcgcgcaggcgaggcgagagatcggagtaagcaatggagtctaccgcgctaatcgcaccattaccgctactaacctctcgctcccgttccaaacccctctcccctgcccccaccagagctcgccgccccgcctccattcccttctcctacggcagaggccgcgtcgtcctattttcccgccgcggccgcgtgtacgccggcgttggctccttggtccccgccgccgcagcgactggggaggcagcagatggcggatctgaggccatcctgctcagtgtccagggtatgatgtgcgacgggtgcgcggcgagcgtgaagcggattctggagagtcaaccagaggttacatctgctaccatggattttaaggaagcaaatgcagttgtgtggacaacagctgaagctcgggcatcagataattggcagaagcagtgtggagagaaacttgctaaacacctcggcacttgtggatttgagtctcggctgcaaggtaattagctatggaaattaccatttcaaagactgattgcaatgcagatatttccttggaaatttgaagttctaggatctatagaccatgtttcagactcattgtactgagtagatcagacaagagtcagcttgctatactttggttaggagtatatcaatctattagatgagtatcctaatt

SEQ ID NO: 26850 - protein, 154 aa, Panicum virgatum
  misc_feature: Ceres CLONE 1873340
  misc_feature (79)..(151): Pfam Name: HMA Pfam Description: Heavy-metal-associated domain
MESTALIAPLPLLTSRSRSKPLSPAPTRARRPASIPFSYGRGRVVLFSRRGRVYAGVGSLVPAAAATGEAADGGSEAILLSVQGMMCDGCAASVKRILESQPEVTSATMDFKEANAVVWTTAEARASDNWQKQCGEKLAKHLGTCGFESRLQGN

SEQ ID NO: 26851 - DNA, 1073 bp, Panicum virgatum
  misc_feature: Ceres CLONE 1873344
  misc_feature: Encodes the peptide sequence at SEQ ID NO. 26852
atctcgaatccacatctcctctgcgttctggctcttcttgctccacttccctctccgtatccgcggtcgcccgtgggcggaggctacctgccagccctcggctgccatcggccccgggcattccaaaggcttctattgtagacgcacgagctactataaaggctcctaatgtcagcaaagtatctctggcaatgaaggaaaactcgcaattatgccaactttgtgagcagttcaccacagaagccctcttctatcttaatgaaaatgagaccaagaccgaaatcattgatacactgcaccaagcttgttcaaagtttccttcttttaagctggagtgcacaaggttggtggattattatgcccctcttttcttcacaaaaattgcttctttaagccctgaagacttttgcgtatcaataagtttttgtgcggaagcaaaattcattcgtctcccaatacatgaggatgcttgcaccctttgccatgaggttgtcgatgagattgttactaatcttgaagatccagacatggagcttaagataatcgagatacttctgaaaggatgcaacaatgcagagaatttcgtacaaaagtgcaagaggttaatcatccaaaatgcaccaatcatcatggaacatatcaagaagttcctcgagaagagggatttctgcgattctattcatgtctgtggaagtaaaactgttcatgctggagcacaagtcctcagaagcctttcttcagcctgaagtcctgagcttttctgaacggattggttcacgcagcaaatgagtggtctacatgtaaaaagatgttcgagcactgtaaatcctgggcaataaagacactacagaattggttttgtacatcagtacatgtaaaaagggaaaccaatcttctgtgtaaacatagaaacctccgcgtgatagttgtgccacatatttagtacatggatcatgagcaggattgtatatttatgttgcttatcattgtacgtaagcgatcatactgcttcaagccttgatgtacaataatgatagtggaactgtgattatcagagcacaattatacaccct

SEQ ID NO: 26852 - protein, 247 aa, Panicum virgatum
  misc_feature: Ceres CLONE 1873344
  misc_feature (68)..(106): Pfam Name: SapB_1 Pfam Description: Saposin-like type B, region 1
  misc_feature (154)..(192): Pfam Name: SapB_1 Pfam Description: Saposin-like type B, region 1
LESTSPLRSGSSCSTSLSVSAVARGRRLPASPRLPSAPGIPKASIVDARATIKAPNVSKVSLAMKENSQLCQLCEQFTTEALFYLNENETKTEIIDTLHQACSKFPSFKLECTRLVDYYAPLFFTKIASLSPEDFCVSISFCAEAKFIRLPIHEDACTLCHEVVDEIVTNLEDPDMELKIIEILLKGCNNAENFVQKCKRLIIQNAPIIMEHIKKFLEKRDFCDSIHVCGSKTVHAGAQVLRSLSSA

SEQ ID NO: 26853 - DNA, 542 bp, Panicum virgatum
  misc_feature: Ceres CLONE 1873345
  misc_feature: Encodes the peptide sequence at SEQ ID NO. 26854
acgccactgagaaatccgcttgcataacgagcacactgaaacagagtagagcgatctttgtgttcccatggcgaccgcgtctgaggaagttgcacccgccgtcgccgtttccgaggcgccggcgccggagaaggtggctgaggtgaaggaggcggccgctgtggagacgccggagaaggtggaggaggcgccgaaacctgcggaggacgaggcgaagaaggcagaggaggggaagaaggcgaggaagccgcggagcaggaagcccaggtccgccgggccgcaccacccaccctacttcgagatgatcaaggaggcgatcctgtcgcaggacagcaaggcgggggcgagcccgtacgcgatcgccaagcacatgggggagaagcaccgggacgtgctcccggccaattaccgcaaggtgctggccgtgcagctgcgcaacttcgccgccaagggccgcctcgtcaaggtcaaggcctccttcgggctcgccgcggccgaggagaagaaggccgcctccgtcgcgaaggcgaaggcgaaggggc

SEQ ID NO: 26854 - protein, 158 aa, Panicum virgatum
  misc_feature: Ceres CLONE 1873345
  misc_feature (72)..(142): Pfam Name: Linker_histone Pfam Description: linker histone H1 and H5 family
MATASEEVAPAVAVSEAPAPEKVAEVKEAAAVETPEKVEEAPKPAEDEAKKAEEGKKARKPRSRKPRSAGPHHPPYFEMIKEAILSQDSKAGASPYAIAKHMGEKHRDVLPANYRKVLAVQLRNFAAKGRLVKVKASFGLAAAEEKKAASVAKAKAKG

SEQ ID NO: 26855 - DNA, 635 bp, Panicum virgatum
  misc_feature: Ceres CLONE 1873366
  misc_feature: Encodes the peptide sequence at SEQ ID NO. 26856
gagggcctcccttctgacctcgtccgcaggggagtggctgtggaggacgcttcgcagcctcacggcatcaggctcctcatcgaggactacccttacgccaacgacgggcttctgctgtggtcggccattcacagctgggtcgagtcgtacgtgcagctctactacccggacgccggcacggtgcactccgacgaagagctccaaggatggtaccacgagacggtccatgtcggccaccccgacatccagcacgcgccctggtggccgacgctctccacgccggacaacctcgcgtccatcctcacgacactcatctggctggcgtcggcgcagcacgcggcgctcaacttcgggcaggacccgctgggcgggtacgtccccaaccgccctccgctgatgcggcggctgctgccggacccggagcgcgacgcggccgagtacgcggcgttcctggcggacccgcaccggttcttcctgaacgcgatgccgggggtgctggaggccaccaagttcatggcggtggtggacacgctgtctacgcactcgcccgacgaggagtacctcggggaggggcgcgacgagcaatggacgggcgacgcggccgccgtggcggcgcacgccatgttcgcggccga

SEQ ID NO: 26856 - protein, 211 aa, Panicum virgatum
  misc_feature: Ceres CLONE 1873366
  misc_feature (1)..(211): Pfam Name: Lipoxygenase Pfam Description: Lipoxygenase
  misc_feature: SWISSPROT Homolog: EC 1.13.11.12 Lipoxygenase
EGLPSDLVRRGVAVEDASQPHGIRLLIEDYPYANDGLLLWSAIHSWVESYVQLYYPDAGTVHSDEELQGWYHETVHVGHPDIQHAPWWPTLSTPDNLASILTTLIWLASAQHAALNFGQDPLGGYVPNRPPLMRRLLPDPERDAAEYAAFLADPHRFFLNAMPGVLEATKFMAVVDTLSTHSPDEEYLGEGRDEQWTGDAAAVAAHAMFAA

SEQ ID NO: 26857 - DNA, 599 bp, Panicum virgatum
  misc_feature: Ceres CLONE 1873369
  misc_feature: Encodes the peptide sequence at SEQ ID NO. 26858
tcatgctttcatcatatgcccccgttatctctgccgagaaggcctaccatgagcagctctctgtgcccgaaatcaccaatgctgtcttccagccctcaagcatgatggccaagtgtgacccaaggcatgggaagtacatggcttgctgcttgatgtaccgtggtgatgttgttcctaaggatgtcaatgctgcagttgcaaccatcaagaccaagagaactgtccagtttgtggactggtgccccactggattcaagtgtggcatcaactaccatccaccctctgttgtccctggaggtgacctggcaaaggtccagcgtgctgtgtgcatgatcagcaacaacacacccgttgctgaggtgttctctcgcatcaaccacaagttcgacctgatgtacgccaagcgtgcgttcgtgcactggtacgtcggcgagggtatggaggaaggcgagttctcggaggcccgtgaggacttggctgcccttgacaaggactaccaggaggtcggcgcagagggtgcggacgacgaaggcgacgagggagaatactattgagtagttggttaataagtagttcgtgggtggttaatggtttgggtt

SEQ ID NO: 26858 - protein, 183 aa, Panicum virgatum
  misc_feature: Ceres CLONE 1873369
  misc_feature (1)..(126): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
MLSSYAPVISAEKAYHEQLSVPEITNAVFQPSSMMAKCDPRHGKYMACCLMYRGDVVPKDVNAAVATIKTKRTVQFVDWCPTGFKCGINYHPPSVVPGGDLAKVQRAVCMISNNTPVAEVFSRINHKFDLMYAKRAFVHWYVGEGMEEGEFSEAREDLAALDKDYQEVGAEGADDEGDEGEYY

SEQ ID NO: 26859 - DNA, 409 bp, Panicum virgatum
  misc_feature: Ceres CLONE 1873373
  misc_feature: Encodes the peptide sequence at SEQ ID NO. 26860
agccccttgcgccgcccaccacacaacccacccggcggaggagaggagagcctctcggcggcggagaagatggtgtcgctgaagctgcagaagcgcctcgccgccagcgtcctcaagtgcggcaagggcaaggtctggctcgaccccaatgaagtcagcgagatctccatggcgaactcccgccagaacattaggaagttggttaaggatggtttcatcatcaggaagcctcagaagatccactccaggtcccgtgcaaggagggcgcatgaggccaagcagaagggacgccacactggatatggtaagcgcaggggtaccagggaggctaggctccccaccaagattctctggatgcgtcgtatgcgcgttctgaggcgcctgctccccccgtgcacgggggggaaaa

SEQ ID NO: 26860 - protein, 113 aa, Panicum virgatum
  misc_feature: Ceres CLONE 1873373
  misc_feature (2)..(113): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKIHSRSRARRAHEAKQKGRHTGYGKRRGTREARLPTKILWMRRMRVLRRLLPPCTGGK

SEQ ID NO: 26861 - DNA, 166 bp, Panicum virgatum
  misc_feature: Ceres CLONE 1873377
  misc_feature: Encodes the peptide sequence at SEQ ID NO. 26862
ctacacgaaccccgaccccgtgcgccacgtccgccagacccttcttcgctacggcctcgccgacttcgagctctgcaccatcgggtatctctgctctgacacccgcggcgaggccaccgcgctcgtcccttccctcaacgtcctggggtacgttcgacggccacgc

SEQ ID NO: 26862 - protein, 54 aa, Panicum virgatum
  misc_feature: Ceres CLONE 1873377
  misc_feature: SWISSPROT Homolog: EC 2.7.7.6 DNA-directed RNA polymerase
  misc_feature: Functional homolog of the protein sequence given in SEQ ID NO 50814
  misc_feature: Useful for making plants with modulated drought sensitivity
YTNPDPVRHVRQTLLRYGLADFELCTIGYLCSDTRGEATALVPSLNVLGYVRRP

SEQ ID NO: 26863 - DNA, 619 bp, Panicum virgatum
  misc_feature: Ceres CLONE 1873391
  misc_feature: Encodes the peptide sequence at SEQ ID NO. 26864
atctcgcacaaaatccccaaatcttcctcctcccaaatccttcgaatcctccgcgcctccggcaagctccaggtcgtcgttgcagcagaagccatgtcgggccgcggcaagggaggcaagggcctgggcaagggcggcgccaagcgccaccgcaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcctggccgccccccgcccgcgccctgtgggtcgcgtgcaggcacctagctagggttcctgatgggttagaggagttgatgtgctgcgttctgtcctgtgcctagctgcgttgtggtgttgacttaatagtaggtgtttatggttgtaatggtgaattggaagcctatcaattgaatgaacgatgttctgaggcataattagagttcttcgtcc

SEQ ID NO: 26864 - protein, 103 aa, Panicum virgatum; identical to SEQ ID NO: 12044
  misc_feature: Ceres CLONE 1873391
  misc_feature (25)..(94): Pfam Name: Histone Pfam Description: Core histone H2A/H2B/H3/H4

SEQ ID NO: 26865 - DNA, 743 bp, Panicum virgatum
  misc_feature: Ceres CLONE 1873396
  misc_feature: Encodes the peptide sequence at SEQ ID NO. 26866
gcctggtgatgctgaaaatgaagagccggcatgtcgcggggacgatcaccaagaagaagaaaagtgtggtgatcgacgtgtgccgcgacgtcccggcgtggcccgggcggcacctgctggaggacggcgagcaccggcgctacttcggcctgcgcacggcggagcaccgggtgatcgagttcgagtgcaccagccagcgggagtacgagatgtggaccaagggcgtggcgcggctcctgagcctcgccggcgagcggaagcgcctcgcgtgacgacgccgacgacctagacctaccccgcgcgacccgtgccggctgtcgccgtcgtcgccaacctgccgacgcggtggcctgggcgcctccgatccaggggcctcccatcatcaccgccccgtttgttgtttgctaggctgtagatgccgcgaggccggcgaaggcagcagcgcgacatgggcgcacagggatcatgtagctaggtagggggatcctgttgctgtgttagggcacaggattgggtgagtgagtcgatcgatggcggtgtggtttctggggaatgcgacgccggtgcgtggggtgccatccctcagtgattcagcggcgaggttaagggcagcagcgcttgcagatctctctctgcctgtgctcttccctcttgctctgcctctcttgtaagttttgctgctgctgctgctgctttttttttcttcttccttctctgggtttggggtgtggccatactgggac

SEQ ID NO: 26866 - protein, 89 aa, Panicum virgatum
  misc_feature: Ceres CLONE 1873396
  misc_feature (2)..(86): Pfam Name: PH_2 Pfam Description: Plant pleckstrin homology-like region
  misc_feature: The sequence is a functional homolog of SEQ ID NO 224 in the 10/225,066 US patent application
  misc_feature: The sequence is a functional homolog of SEQ ID NO 2372 in the 10/374,780 US patent application
  misc_feature: The sequence is a functional homolog of SEQ ID NO 929 in the 11/479,226 US patent application
  misc_feature: The sequence is a functional homolog of SEQ ID NO 430 in the 10/666,642 US patent application
  misc_feature: The sequence is a functional homolog of SEQ ID NO 1215 in the 11/479,226 US patent application
  misc_feature: The sequence is a functional homolog of SEQ ID NO 548 in the 10/412,699 US patent application
LVMLKMKSRHVAGTITKKKKSVVIDVCRDVPAWPGRHLLEDGEHRRYFGLRTAEHRVIEFECTSQREYEMWTKGVARLLSLAGERKRLA

SEQ ID NO: 26867 - DNA, 693 bp, Panicum virgatum
  misc_feature: Ceres CLONE 1873401
  misc_feature: Encodes the peptide sequence at SEQ ID NO. 26868
actcgcccctttgctttcttcgtcttgccgcggaaggggaaggatggaggaggcacaaaagctttcatcagatctcgccgcccacacgcaccgcgaaggtcgcgtcccatgaactcgaggaggaacttccgcagccacagagctgctttatttgatggcattgaagaaggtgggataagagctccagtgtattcttctcgtgaaattcatgagcaggggaatgaccaagcaatggacagtttgcatgatagggtcagcattctcaaaagattaactggtgatatacacgaagaagtggagaatcataaccgaatgctggacagaatgggtaatgacatggatgcttcaagaggatttctttctggaacggtggacaagttcaagatggtcttcgagacgaaatcaagccgcaggatggctaccatggtggcatccttcattgctgtcttcatactcatttactacctcaccaagtaggagcatacccactctggcatcggcttatcagcagctgcatgtgatggtgtatattgcgtgattgtatgaccccattttccacacttaatgaccagagcattggttctcaaaagaaaagaagcattggcggattgcgaggtgatgttctgctgccatctcatctgccagtgtttgttattacatggatgggtgaccctggtgggaggatatgctgca

SEQ ID NO: 26868 - protein, 122 aa, Panicum virgatum
  misc_feature: Ceres CLONE 1873401
  misc_feature (37)..(99): Pfam Name: SNARE Pfam Description: SNARE domain
MNSRRNFRSHRAALFDGIEEGGIRAPVYSSREIHEQGNDQAMDSLHDRVSILKRLTGDIHEEVENHNRMLDRMGNDMDASRGFLSGTVDKFKMVFETKSSRRMATMVASFIAVFILIYYLTK

SEQ ID NO: 26869 - DNA, 500 bp, Panicum virgatum
  misc_feature: Ceres CLONE 1873402
  misc_feature: Encodes the peptide sequence at SEQ ID NO. 26870
aaaaattgaataagcaatcatccatcagcaatggcggtcgcgagccgtccgacgctccgctaccctcgctgggcctcacggcggccctcctctccctcctcgccagcccggccgcggcgagcgggaagacgggccacgcgaccgtgttctggggccggaaccaggcccagggctcgctccgagaggcctgcaacaccggcacctacaccttcgtcgtcctctccttcctcagcgtatccggccgcgccccgaccaccctcgacctcgccggccaccccctcggccccgtcggcgcccacctcaagcactgccaatacgacagcctcctcgtcttcctctccagcggcggccccggcagccagtactcgttccccagcgcccaggccgcgacggacctcgccgactacctctggtgcgcgtacctcgacggccgccgcggcggcatgcgccgaccgttcggcggggcggagctacgacggcatctacctcttcatcgacca

SEQ ID NO: 26870 - protein, 165 aa, Panicum virgatum
  misc_feature: Ceres CLONE 1873402
  misc_feature: SWISSPROT Homolog: EC 3.2.1.14 Chitinase
KLNKQSSISNGGREPSDAPLPSLGLTAALLSLLASPAAASGKTGHATVFWGRNQAQGSLREACNTGTYTFVVLSFLSVSGRAPTTLDLAGHPLGPVGAHLKHCQYDSLLVFLSSGGPGSQYSFPSAQAATDLADYLWCAYLDGRRGGMRRPFGGAELRRHLPLHR

SEQ ID NO: 26871 - DNA, 682 bp, Panicum virgatum
  misc_feature: Ceres CLONE 1873404
  misc_feature: Encodes the peptide sequence at SEQ ID NO. 26872
gcgcatcccattccccttccttccagaggagagagagagaagaaaagataagctcagctcaggctcaggctcagctcgcaagcaagtggagatgcggagcccacgaggaccagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcctgcagttcggcggcggcgagaaggtggtcgtcacgggggccctcgacggggagggcggccggcacgcgctctgggtgttcgacgtcaggaccaagagctggaccgtggtgcgcccgccgccggagttcgccggcttcgtcttctccgtcgcgtccgtccgcatctgaagatctggatctcggccgccccagccccgatccgcccccatcgaccaagaaacaaaagaagaaatcaaggctactacgactactagtgtgtgtccgtgcaccgtgcccgccattgctggatctgagatctgcgcgtcggccatggatctctgcatctgcttggatactagtatgcccgtcccataatcctac

SEQ ID NO: 26872 - protein, 132 aa, Panicum virgatum
  misc_feature: Ceres CLONE 1873404
  misc_feature (20)..(67): Pfam Name: F-box Pfam Description: F-box domain
MRSPRGPAAAGRCGAQEHVDLIPGIPDDVAVDCLARVPHASHRALRRVCRGWRSAAAKPAFASARAAAGATEDLVYLLQFGGGEKVVVTGALDGEGGRHALWVFDVRTKSWTVVRPPPEFAGFVFSVASVRI

SEQ ID NO: 26873 - DNA, 659 bp, Panicum virgatum
  misc_feature: Ceres CLONE 1873438
  misc_feature: Encodes the peptide sequence at SEQ ID NO. 26874
accgaccgcctcaacatctcgatagcgttaggccgttagggttttggcggcggcggcctgtatcctgacctccctccgccgcttttgaagccagactgctcgcttccgcttggcccctcccctgctgctagggtttcgtctcgaggagaaggccgggcgaagctcccacagatcccttcacctgtcccgcgtccgaggctaggtcgccgccatgagccgatctgggcagcctccggatctcaagaagtacatggacaagaagcttcagatcaagctgaatgcaaaccgtgttgttattggcacacttcgagggtttgaccagttcatgaatctggtggtggataacactgttgaggtcaatgggaacgacaagactgatattggaatggtggttatcaggggaaacagtgttgtcatgatcgaggcgctggagcctgttgccaagtctcagtgaatcatcattctgcttcagcagatgtagaggcaccaactgcatgaaaactgatgtaaatgatatcagtcaacctgctgtactttaacattatttgcacagcaatgtaactttgaatgcggagagccttgttttgttcatactccttgattgtgactatgtaatcaactgccgatgcttatgataatacttaatttaactcaagctt

SEQ ID NO: 26874 - protein, 80 aa, Panicum virgatum; identical to SEQ ID NO: 14688
  misc_feature: Ceres CLONE 1873438
  misc_feature (8)..(72): Pfam Name: LSM Pfam Description: LSM domain

SEQ ID NO: 26875 - DNA, 727 bp, Panicum virgatum
  misc_feature: Ceres CLONE 1873481
  misc_feature: Encodes the peptide sequence at SEQ ID NO. 26876
atccgtccgcccaccacgagcgcgcgcaccgcacgcagcgcagcgagcgatcgcgtcggtcgagccggcgccatggatttccaccaccaccaataccacagcgtccgcgcggcggggccgccggcgccggcggcgcggccgtggagcaaggcggaggacaaggtgttcgagggcgcgctggtgatgtggcccgagcacgcgcccgaccgctgggcgctcgtcgcggggcagctccccggccgcacgccgcgggaggcctgggagcactacgaggcgctcgtcgccgacgtcgacctcatcgagcgcggcgcggtcgacgtgcccgcctcctgggacgacgtcggcggcggctcctcctccggcggcggcggcgaggagcgcgcccccgcccgccgcgccggccccacccggccacgccccgagaaacggcgtacagggataccctggagcgaggaggaacacaggctgtttcttcgggggctgcagaagtacgggcgcggggactggcgcaacatctcgcggttcgcggtgcggacgcggacgccgacgcaggtggccagccacgcgcagaagtactacaaccggcagctcaaccccgccagccgcgactccaagcgcaagagcatccacgacatcaccaccccgtagacccgatcgccgcagccgacgccgacgccgacgccgacgcgctccactagtccatgaccatgtacatatacttaatgct

SEQ ID NO: 26876 - protein, 191 aa, Panicum virgatum
  misc_feature: Ceres CLONE 1873481
  misc_feature (122)..(169): Pfam Name: Myb_DNA-binding Pfam Description: Myb-like DNA-binding domain
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
MDFHHHQYHSVRAAGPPAPAARPWSKAEDKVFEGALVMWPEHAPDRWALVAGQLPGRTPREAWEHYEALVADVDLIERGAVDVPASWDDVGGGSSSGGGGEERAPARRAGPTRPRPEKRRTGIPWSEEEHRLFLRGLQKYGRGDWRNISRFAVRTRTPTQVASHAQKYYNRQLNPASRDSKRKSIHDITTP

SEQ ID NO: 26877 - DNA, 847 bp, Panicum virgatum
  misc_feature: Ceres CLONE 1873495
  misc_feature: Encodes the peptide sequence at SEQ ID NO. 26878
atccattcattaagtttatagcaagctctgcagcacgctagctagcttgctcttccacgaagctcggcgatctctctgcttaccaccccttccagcagctaatagctacctacctgactacttgtgccatggcaacaagatttatcgccgttgcggccgtgatggcagctgccctcgtcggcatggcgtcggcggcggtctacaacgtcggcgagccggccgggtcctgggacctgcggaccaactacggcgactgggccgcctccaagcggttccacccgggcgaccagatcgtcttcaggtactccccgcaggcgcacgacgtggtggaggtgagcaaggcggactacgactcctgctccaacgccaggcccgtcgccacccacacctccggcaacgacgccatcgccctgacctccaccggcacgcgctacttcatctgcggcatcaccggccactgcgatgggggcatgaagctccaggtcgacgtcgtgcccggcgccacctccctcgccccggccggcgctcccggcgccaacgccccggtctctccccagaccccttccacgcccgcttccgccgctaccaaggccaccgccaccggcctcgctctcgccgggttcttgctcgccgccagtctcctggtctaagtagttgctattgtgctgcagccagcgcacatatatgcacatacatacttacatttacttatcgttgattattgtattattctttcggatttggagagaggtcacacatgatacatgtatgtacgtatatacagagatgagagatacatgttagtatatatgtacatctacatacatatagtatatatagttttggt

SEQ ID NO: 26878 - protein, 173 aa, Panicum virgatum
  misc_feature: Ceres CLONE 1873495
  misc_feature (34)..(115): Pfam Name: Cu_bind_like Pfam Description: Plastocyanin-like domain
MATRFIAVAAVMAAALVGMASAAVYNVGEPAGSWDLRTNYGDWAASKRFHPGDQIVFRYSPQAHDVVEVSKADYDSCSNARPVATHTSGNDAIALTSTGTRYFICGITGHCDGGMKLQVDVVPGATSLAPAGAPGANAPVSPQTPSTPASAATKATATGLALAGFLLAASLLV

SEQ ID NO: 26879 - DNA, 746 bp, Panicum virgatum
  misc_feature: Ceres CLONE 1873509
  misc_feature: Encodes the peptide sequence at SEQ ID NO. 26880
ccgccgtcctcgcctccccttcgcactcgctccagctcggctgcttctactccggcactgcagcctgcctcgcgcccccgcctcgatctccgacgtcgccgctcgcgcgtccgtgaggccgtggcccgtgggcgagcggcgagccgcggggcctggcgcatgacgatgaaggggctgctccggtgcgtgtcgacgggggcctgcagggtgacgccgggcgccgtggccgagccggcgccggcgtggcacggggccgtggggaaggtgccggcggggcacgtgccggtggaggtcggcgccgagggggaggagacggagcggttcgtcgtccccgccgagctgctgggccgcccgcccatcgccgagctgctctgccgcgccgcgcaggagtacggctacgcgcgccgggggccgctgcgcatcccgtgccccgcggccgccttccgccgcctcctcggcgcactcgccggagcgggtgccggcgacggtgggctcgccgtcgcctacctcaccgtggtcgtctgaggtcggagatcctcctagcgtagcggactagcggttcgatttccttgaggcgtggctgtgcaggccacaggcgtgcgttgtcgctgttagtgtttcttgctccactagaggttccatttgcttcttctttttctttccttttttgtgtaataatatgtatgtaaatatgtaaatccggatcgacgatatgttcattcagtcattctatatacttgtagcat

SEQ ID NO: 26880 - protein, 121 aa, Panicum virgatum
  misc_feature: Ceres CLONE 1873509
  misc_feature (14)..(103): Pfam Name: Auxin_inducible Pfam Description: Auxin responsive protein
  misc_feature: Functional homolog of the protein sequence given in SEQ ID NO 51231
  misc_feature: Useful for making plants with modulated nitrogen use efficiency
MTMKGLLRCVSTGACRVTPGAVAEPAPAWHGAVGKVPAGHVPVEVGAEGEETERFVVPAELLGRPPIAELLCRAAQEYGYARRGPLRIPCPAAAFRRLLGALAGAGAGDGGLAVAYLTVVV

SEQ ID NO: 26881 - DNA, 793 bp, Panicum virgatum
  misc_feature: Ceres CLONE 1873515
  misc_feature: Encodes the peptide sequence at SEQ ID NO. 26882
tagaatcggcaatactccaaaggaatcatcagttgatagcatttccagcgcgctcagtgggataagcttcgaagatgccagtagttctgattgtgctgatgcagcatcctctcagaggagcaagctgagtattgccaggaggaggaaaacatctcaagtggagggtagacagcaaatgcgtcctttcaaacccaagcccccaaattatcttccagcagcaactggtccagaggcagagaaggttgatctcaggcatcagatggtggacgatcggaggaccgccgaggagtggatggttgattacgctcttcggaaggcagtgaagaaattagctcgtgctcagaagaggaaagtggagatgcttgtgcaggcctttgaaactgttctacccacagttgccaatgagaagaagcagctacaccaagacggtgacaagacaagctacactcttactagaccatctcaagcctgcagctgagcatttcagagtttgtggggttagctggactaatcattatccgaaggttctcaacggtcactgcagtattagtgccagagacctgctcaacaaatagggagcagagagctgcttactgtcactgttttctcatcgggtagttgagctgctaggaggtcactgagttgggttagtgcaagacctagtgcgtgtacatacgtctcttatgctctagtttagtgatgagaaatgatcgtaggagacttgcaaattggaaagaatgtgagatgtactattcctcgatagatcaattcaataaagctcttattggctgac

SEQ ID NO: 26882 - protein, 158 aa, Panicum virgatum
  misc_feature: Ceres CLONE 1873515
  misc_feature (13)..(130): Pfam Name: CaM_binding Pfam Description: Plant calmodulin-binding domain
RIGNTPKESSVDSISSALSGISFEDASSSDCADAASSQRSKLSIARRRKTSQVEGRQQMRPFKPKPPNYLPAATGPEAEKVDLRHQMVDDRRTAEEWMVDYALRKAVKKLARAQKRKVEMLVQAFETVLPTVANEKKQLHQDGDKTSYTLTRPSQACS

SEQ ID NO: 26883 - DNA, 558 bp, Panicum virgatum
  misc_feature: Ceres CLONE 1873548
  misc_feature: Encodes the peptide sequence at SEQ ID NO. 26884
acatcccacccgccgattcactccgctcgcgccttccaccccgcgcccccaatcccctcgcgccgcagggaggaggaggaggcgggggtcgcggcggcgaaggttccatccggttcctctccccccaggcctgccgatccgtgttcacgatggctctgcagcagcagcagcagcacgcggggtcggcgtccgggtcggcgtcggcgtcgagctccagctcggggctgcacccgctcgcgtcgccctcgtccttcgaggacctagctgtggtgctttcctgagagcttcctccgtttcgtcactcgtctgtaccaaatttctagtgttgtatgtcccaggtcagaaggtgtggtttagttatgtactgctctctgctctgtgctgggtggtgccgagtgtagagccctcttccaaaataaaatcaccggatgagaatcccatgatgttagcggaactaatgcgtgctacactgttaatgtgcgccagtgttttgtggaacactcctgttctttttggaccaagcagtggtaatataatgcaacagggtccgtgaaagac

SEQ ID NO: 26884 - protein, 43 aa, Panicum virgatum
  misc_feature: Ceres CLONE 1873548
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
MALQQQQQHAGSASGSASASSSSSGLHPLASPSSFEDLAVVLS

SEQ ID NO: 26885 - DNA, 767 bp, Panicum virgatum
  misc_feature: Ceres CLONE 1873600
  misc_feature: Encodes the peptide sequence at SEQ ID NO. 26886
aaaaaaaaaaaaactagtcagccggatcgctgcgtcgctccgcctcctcctcggcggcctcccaccctcgcgcggcgccttcctcggttcttcggtccagcttgggagatgtcggactccgaggagcaccatttcgagtcgaaggccgacgccggagcgtccaagacttacccgcagcaggccggcaccatccgcaagaacggctacatcgtcatcaagggccgcccgtgcaaggtggttgaggtctccacttccaagacagggaagcacggtcacgcgaaatgccacttcgtggccattgatattttcaacggaaagaagcttgaggatattgtaccctcttcccataactgtgacgtgccccatgtcaaccgtactgactaccagctgattgacatatctgaagatggatttgtcagccttttgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagcttcattgccactggtggttatttatctggccgtctatctgggaggtggtgtgttgatgatataagcgtgtttggttatgagtaacatgcttgtggactgccgttttgtcttgccgtttatgcagagtgatttggatgtacctttgctatctgtaatgttcttttgaaccaagt

SEQ ID NO: 26886 - protein, 160 aa, Panicum virgatum; identical to SEQ ID NO: 10137
  misc_feature: Ceres CLONE 1873600
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 26887 - DNA, 608 bp, Panicum virgatum
  misc_feature: Ceres CLONE 1873610
  misc_feature: Encodes the peptide sequence at SEQ ID NO. 26888
  misc_feature (69)..(69): n is a, c, t, g, unknown, or other
  misc_feature (97)..(97): n is a, c, t, g, unknown, or other
aaccgcaagcccggacggctataaagcccttcctatcccccaagccggcggcgaagaagaagacaagcnccccgcgcccccaaccgcggagcccccnccggatcccccacgaccggacagcagcagccagggcggccgagccggagcagaacgcggcccccgcggcggcggcgcaggaggcggccgcgcacagcgaggacgcggaccgccccgagggcgccgacccggaggagcgccacccccgcacccccacccccggccacggcagcgagcagaaggccaaggacgcggagccccaccacaacaagcacgccgccagcgggaacgccgcgtttttcaccccccagcaagtcgaggagctaaagaagcaaccatgtgttcttcaggttgtgccgagccagacctaccatctccatggacctgaatctggcactcaccagggcacgacgcgcaccatgggccttatgtgaaggcataaccgagaggactctgttctagtacggcagcggcctcactagtgaatgtacaatatataaataagagatgtatcgaatgtacctacttctacacaggttcaggcctgttttgaagtgtgtaatgctgtgttg

SEQ ID NO: 26888 - protein, 155 aa, Panicum virgatum
  misc_feature: Ceres CLONE 1873610
  misc_feature (77)..(138): Pfam Name: Subtilisin_N Pfam Description: Subtilisin N-terminal Region
  misc_feature (23)..(23): Xaa is any aa, unknown, or other
  misc_feature (32)..(32): Xaa is any aa, unknown, or other
PQARTAIKPFLSPKPAAKKKTSXPRPQPRSPXRIPHDRTAAARAAEPEQNAAPAAAAQEAAAHSEDADRPEGADPEERHPRTPTPGHGSEQKAKDAEPHHNKHAASGNAAFFTPQQVEELKKQPCVLQVVPSQTYHLHGPESGTHQGTTRTMGLM

SEQ ID NO: 26889 - DNA, 701 bp, Panicum virgatum
  misc_feature: Ceres CLONE 1873643
  misc_feature: Encodes the peptide sequence at SEQ ID NO. 26890
tcatcagcagaacaaaagacaaccagacatctgatccacaacaccacactagctaggtacctgccgagaggaaccaccgaccggtgcaacatggagtacggccacggaaccaccggccgcgtcgaccagtacggcaacccggtcggcggcgtcgggcacggcaccgggaccgggaccggcggcatggggtacggtggtaccaccggaaccggcggcatgggccagctgggggagcacggcggcgccggcatgggtggcggccagttccagcctacgagggaggagcacaagaccggcggcgtcctgcaccgctccggcagctccagctccagctcgtccgaggacgacggcatgggcgggaggaggaagaagggcattaaggagaagatcaaggagaaattacccggaggacacaagaaggacgaccagcacaccacggccaccggcggtgcctacgggcagcagggacacaccggcatgaccggcacgggaaccggcggcgccgcctacaccgagggcaccggcgagaagaagggcatcatggacaagatcaaggaggagctgcccggacagcactaattaagcgcggccgcgcggtacgcgcgagaagccgtgtgcttgtctgtcacggcgttccgagataataagatgaacccagcagggatggagtgtcccttgaacgcgtccgctcgcggggggcg

SEQ ID NO: 26890 - protein, 162 aa, Panicum virgatum
  misc_feature: Ceres CLONE 1873643
  misc_feature (8)..(162): Pfam Name: Dehydrin Pfam Description: Dehydrin
MEYGHGTTGRVDQYGNPVGGVGHGTGTGTGGMGYGGTTGTGGMGQLGEHGGAGMGGGQFQPTREEHKTGGVLHRSGSSSSSSSEDDGMGGRRKKGIKEKIKEKLPGGHKKDDQHTTATGGAYGQQGHTGMTGTGTGGAAYTEGTGEKKGIMDKIKEELPGQH

SEQ ID NO: 26891 - DNA, 792 bp, Panicum virgatum
  misc_feature: Ceres CLONE 1873659
  misc_feature: Encodes the peptide sequence at SEQ ID NO. 26892
accactttgttagcgtctccgccctccccgtcccgggccgctccctgcgccgccgcacgctcctccccttgccttcttccaccgtcgccgcggcgccttccctcgccgccactcccaggttgttgcggcgcggaggtccgtaccgtctacccggagtcggatcggctcctcgagtagtcgccgtgaccacttcaaccagggaatggcaatgtcttggacaagaggattaaagtatgttgttgctccaaggcatgcggctcaactggtagagagtagaggtcttgccattgcaagcaaggcaaaaaagggtggaaaaggtggcgcagctgatgccgctaaaactcctgcactcagcaaagagcttaagagtacaacagtgtttggggcaaacattctcaaggagggttctgatccaaaaattcaaccagactctgagtatcccgagtggctgtggcacctgctcgacaagcgtcctgtgctaagtgagctgcggaggaaagatcccaagacgcttccttacgaagacctgaagcgttttgtcaagttggataaccgatctcggatcaaggaaaacaatgctctcactgctaagaactgacctggagagtctcatgaagaaacaggggctgttattttgtccactttaatctaaatatttactataatgaactgtttttggcaataacacagtgattcagaacattaaagtttgtggagttgcttggtttggtaatattataagtcagccaggatggttctgtttcattttgcgaggatgtagtttctgcttcg

SEQ ID NO: 26892 - protein, 131 aa, Panicum virgatum
  misc_feature: Ceres CLONE 1873659
  misc_feature (22)..(130): Pfam Name: Ribosomal_L37 Pfam Description: Mitochondrial ribosomal protein L37
MAMSWTRGLKYVVAPRHAAQLVESRGLAIASKAKKGGKGGAADAAKTPALSKELKSTTVFGANILKEGSDPKIQPDSEYPEWLWHLLDKRPVLSELRRKDPKTLPYEDLKRFVKLDNRSRIKENNALTAKN

SEQ ID NO: 26893 - DNA, 937 bp, Panicum virgatum
  misc_feature: Ceres CLONE 1873667
  misc_feature: Encodes the peptide sequence at SEQ ID NO. 26894
gtagcccgaccgactcgcgattccaaacccccaaaccctcctcctccctgaacccgatccaacccaatccccggcggcggcgatggcggccgtgaccaacgccgacgtggaggtggtcgacttcgacctcgacgacgacgacctcatggacgaggacgccggggcggagcccgcgccgccccccgcccccgcgtcccgactccgctccaccatcgcgggcgacgacgcgccgcgtaagaccaagggccgcggcttccgcgacgacccaaactcctcatccgccccccgcgacacgcgcttcggcgctggggggcgcgccgacttcgactcgctcggctccggcggcggcccggcacccatccgatcaattgaaggatggattgtgctggtcactggagttcacgaagaagcacaagaagatgaccttcacaatgctttccgagaatttgggcaggtccgaaacctgcatttgaatttggatcgtcgtactggatttgtcaaggggtacgctttgattgaatacgagaactttgaagaagctcaggctgcaataaaagaactggatggaactgagctttatggacaaataataagcgttgattgggcatttagcagtggccctgctaagcgcagaaattctcaaaagagacctccatcaagagctcgttctaggaccccacccaagagaaggtactgatgtttccccagcatgtcctgaactcactaggattgatgaagtagtgcaagaattctggggattgcagattgcttggtgtatcactggagtctgatggttgctaccctgctgttttcatttcgtgaccatggtagttgtatgatactttcgcttctggtcgatggagttgtgtttaacactatgttttacatgccagtttgagacaattgtaaccgtggatcctttaaatctttgaccttg

SEQ ID NO: 26894 - protein, 204 aa, Panicum virgatum
  misc_feature: Ceres CLONE 1873667
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAVTNADVEVVDFDLDDDDLMDEDAGAEPAPPPAPASRLRSTIAGDDAPRKTKGRGFRDDPNSSSAPRDTRFGAGGRADFDSLGSGGGPAPIRSIEGWIVLVTGVHEEAQEDDLHNAFREFGQVRNLHLNLDRRTGFVKGYALIEYENFEEAQAAIKELDGTELYGQIISVDWAFSSGPAKRRNSQKRPPSRARSRTPPKRRY

SEQ ID NO: 26895 - DNA, 604 bp, Panicum virgatum
  misc_feature: Ceres CLONE 1873695
  misc_feature: Encodes the peptide sequence at SEQ ID NO. 26896
agaaaatcgttacacccccgctcgctcgtcccgtctctattggggttgcgggggagccaagcaagccgcatgcgagcgctgcctcgcgtcggcaagcacgtgcgctggatgatggcctcgcgcgcgcggccgcggcgggcgatggggtcggcggcggccggcggcgggagggatcccgcccagaacccgaaggtggggaggctgcgggagctcttcgtcggcgacgccgacgcggcagatgggtgggagaagtcctgggagtttggtgtgacgccgtgggatttggggaagccaacacctgtcatcgaacatcttgttagatcaggaacactgccgaatggaagagctttggttcctggatgtggaatgggatatgatgtggtggctctggcatgccctgaacgatttgttattggattggatgtttctgatatggctgttaaaaaggctaagcagtggtcatcctctttgcccaatgcaaattattttacttttctggctgatgatttcttcaagtggataccaaacggacaatttgaccttatatttgattacgcgttcttttgtgcgcttgacccaagtttgagggtggcttgggcagaga

SEQ ID NO: 26896 - protein, 178 aa, Panicum virgatum
  misc_feature: Ceres CLONE 1873695
  misc_feature (54)..(178): Pfam Name: TPMT Pfam Description: Thiopurine S-methyltransferase (TPMT)
  misc_feature: SWISSPROT Homolog: EC 2.1.1.67 Thiopurine S-methyltransferase
MRALPRVGKHVRWMMASRARPRRAMGSAAAGGGRDPAQNPKVGRLRELFVGDADAADGWEKSWEFGVTPWDLGKPTPVIEHLVRSGTLPNGRALVPGCGMGYDVVALACPERFVIGLDVSDMAVKKAKQWSSSLPNANYFTFLADDFFKWIPNGQFDLIFDYAFFCALDPSLRVAWAE

SEQ ID NO: 26897 - DNA, 716 bp, Panicum virgatum
  misc_feature: Ceres CLONE 1873700
  misc_feature: Encodes the peptide sequence at SEQ ID NO. 26898
ggaagactcagtccccccccccccacccgaacccaaacaaacccttgcgagggagcgaggagagctgctcgccgccaccgccgccgccgccgccgccgccgccatgtcgggagggatcgcgcgcggccgcctcgccgaggagcgcaaggcctggcgcaagaaccacccccacgggttcgtggcgaggccggagacgctggccgacgggtcggcgaacctcatgatctggaactgcaccatccccggcaagcaggggactgattgggaaggtggttactaccctcttacccttcatttcagtgaggactaccctagcaaacctccaaagtgcaagtttccacagggttttttccacccaaatgtctatccttcagggacagtctgcctctcaattcttaatgaggatagtggttggagacctgctattactgttaagcagattctagttggaatacaggacttgctcgatcagcctaatccagctgatcctgctcaaactgacggatatcaccttttcatccaggatcaagtggaatataagagacgtgttcgtctgcaggccaagcagtatcctgctctggtgtgaggatgttggatgcttgagatccatgacccatcctgcacatccgcatagtagctgcgacatcttcagttatgcatctgaatatggatttgacaagatataagttctctggagtattgccagtgtaatcttg

SEQ ID NO: 26898 - protein, 160 aa, Panicum virgatum
  misc_feature: Ceres CLONE 1873700
  misc_feature (9)..(153): Pfam Name: UQ_con Pfam Description: Ubiquitin-conjugating enzyme
  misc_feature: SWISSPROT Homolog: EC 6.3.2.19 Ubiquitin--protein ligase
MSGGIARGRLAEERKAWRKNHPHGFVARPETLADGSANLMIWNCTIPGKQGTDWEGGYYPLTLHFSEDYPSKPPKCKFPQGFFHPNVYPSGTVCLSILNEDSGWRPAITVKQILVGIQDLLDQPNPADPAQTDGYHLFIQDQVEYKRRVRLQAKQYPALV

SEQ ID NO: 26899 - DNA, 389 bp, Panicum virgatum
  misc_feature: Ceres CLONE 1873708
  misc_feature: Encodes the peptide sequence at SEQ ID NO. 26900
  misc_feature (308)..(308): n is a, c, t, g, unknown, or other
gcctcctccaaaccctagcgccggcgcctccacttcgcttcctcaccccatctcctcgcgctcaggtatctacctctacgcctccggatccaccgccggtctcgcgtcttctgattgctatctccgctcttgtgcctgttgctgatccgcgtcgtgctgctcgaatctcctggcggcagggttcggcgcccaagggaggcaagatgtacaccgcgaggaagaagatccagaaggagaagggcctcgagccctccgagttcgaggactccgtcgctcaagctttctttgacctggagaatgccaaccangagctcaagagcgacctcaaggacctctacatcaacaatgctatccagatggacgttgccggggaacaggaaggctgttgt

SEQ ID NO: 26900 - protein, 61 aa, Panicum virgatum
  misc_feature: Ceres CLONE 1873708
  misc_feature: Functional homolog of the protein sequence given in SEQ ID NO 50192
  misc_feature: Useful for making plants with modulated biomass
  misc_feature (35)..(35): Xaa is any aa, unknown, or other
MYTARKKIQKEKGLEPSEFEDSVAQAFFDLENANXELKSDLKDLYINNAIQMDVAGEQEGC

SEQ ID NO: 26901 - DNA, 900 bp, Panicum virgatum
  misc_feature: Ceres CLONE 1873733
  misc_feature: Encodes the peptide sequence at SEQ ID NO. 26902
cttccacctccaacgcccacctgcctgcctctgcctgtttgggaggaggaatcggcgccaggccgcgcgctcatggttgccgcccgtgtgcgtcaccggcgccggcggcttcatcgcgtcgtggatcgtcaacctcctcctcgacatagggttgctgctagggtttcgatggcatccggtgagggcaagaagaagatgatcactctcaggagctccgacaacgtggagttcgaggtggaggcggcggtggcgatggagtcacagaccatccgccgcatgattgaggataactgcgccgataacagcatcccgatccccaacatcaactccaagctcctctccatagtcatcgagtactgcaccaagcatgtccacaccaccaagcttgaggatgccgccgctcccgcccccgccaacaccgctatcagcggcgaggacctcaagaaatgggacgctgagttggtcaagatcgatcatgccactctcatcgacctcatcgaggctgccaacttcctggagatcaagggtttgctggacctgacctgccaggcgatggctgacatgatcaagggcaagagtccagaggagatccacaagacgttcaacatcatgaacgacttgtcccctgaggaggaagaggagatcatctgggacatccagtgggctctcgagtgatggctgcttaattcattccgtgcttggaagaaacaagtgggtactgcaaatgctgctagtacttatcagtgctagttctgctactatctggtcgtatggttgtgataaattgcgtttggtgaacctacctagtagctaggtggtattagatggaagttaaactgagtggcactgccatgtatgttcgaatcggttatatatttgcagcatcttgttgttgttttt

SEQ ID NO: 26902 - protein, 168 aa, Panicum virgatum
  misc_feature: Ceres CLONE 1873733
  misc_feature (91)..(168): Pfam Name: Skp1 Pfam Description: Skp1 family, dimerisation domain
  misc_feature (9)..(69): Pfam Name: Skp1_POZ Pfam Description: Skp1 family, tetramerisation domain
MASGEGKKKMITLRSSDNVEFEVEAAVAMESQTIRRMIEDNCADNSIPIPNINSKLLSIVIEYCTKHVHTTKLEDAAAPAPANTAISGEDLKKWDAELVKIDHATLIDLIEAANFLEIKGLLDLTCQAMADMIKGKSPEEIHKTFNIMNDLSPEEEEEIIWDIQWALE

SEQ ID NO: 26903 - DNA, 718 bp, Panicum virgatum
  misc_feature: Ceres CLONE 1873736
  misc_feature: Encodes the peptide sequence at SEQ ID NO. 26904
aagctaccagcgtggtcgtcggggggatagaggctcgcaaacggcacaccgtcctcgcgtgtgggttcctcccaaaccccaaccaccacctccacctacacggcgccgctcttcgtcgtcccccgggcctataaatacgaggcgaggcgaggcggaagggggcgcagatgggaatcacctcctcttcgtcctcgaacccggaatccagagctatggcgctcgtcaaggccaaggagatcgtcgcctccgcgcccgtcgtcgtcttcagcaagtcttcctgccctttctgcgtccgtgtgaagcagctgttcgagaagctgggagcaagcttcaaggccattgagatggatgtggaaagtgatggagctgagctccaggatgctctcaaggagtggactggacagaggaccgttccaaatgtcttcatcaatgggaagcatattggtggctgcgatgataccatggcactgaacaatgatgggaagctggtgtctctgctaactgaggctggagcgataaagggttctacttccaagaaaaccgccactgcttagctcgatctgagagttgtcctggttgacatgtttatactgttcccatggtatggtatgaaataagggggctatggttcgcaggtcctgacctttgtgctgtcaaagtgtcaagtactatcatgactgtctagtccccctgttgaaccgctcagacatcagtcgag

SEQ ID NO: 26904 - protein, 128 aa, Panicum virgatum
  misc_feature: Ceres CLONE 1873736
  misc_feature (30)..(92): Pfam Name: Glutaredoxin Pfam Description: Glutaredoxin
  misc_feature: SWISSPROT Homolog: EC 1.11.1.15 Peroxiredoxin
  misc_feature: Functional homolog of the protein sequence given in SEQ ID NO 50111
  misc_feature: Useful for biocontainment applications
MGITSSSSSNPESRAMALVKAKEIVASAPVVVFSKSSCPFCVRVKQLFEKLGASFKAIEMDVESDGAELQDALKEWTGQRTVPNVFINGKHIGGCDDTMALNNDGKLVSLLTEAGAIKGSTSKKTATA

SEQ ID NO: 26905 - DNA, 287 bp, Panicum virgatum
  misc_feature: Ceres CLONE 1873758
  misc_feature: Encodes the peptide sequence at SEQ ID NO. 26906
ttttttagtcctctctccaggcggcgcctccacatctcgtctctcggatcgggaggcgaaaccaaggaggaagcggagcagaagcagccaggccagcccaccgccgccaccatgggtatctcgcgtgactcgatgcacaagcgccgggccaccggtgggaagcagaaggcctggaggaagaagcgaaagtacgagcttggccgtcagccagccaacaccaagttgtcaagcaacaagacggtgaggagggtccgtgtcagagggggtaatgtgaagtggagggctct

SEQ ID NO: 26906 - protein, 58 aa, Panicum virgatum
  misc_feature: Ceres CLONE 1873758
  misc_feature (1)..(58): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRA

SEQ ID NO: 26907 - DNA, 660 bp, Panicum virgatum
  misc_feature: Ceres CLONE 1873762
  misc_feature: Encodes the peptide sequence at SEQ ID NO. 26908
gaaccagcagtacaagaagcacaagaaaaaacacttgtagccatcaacttcttcttcttcttcttcaccgtcatcaactcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaaaggtgaataaagcatcgattgtgtgtagccttacaagaaccgccttcttgtttcttactctcatcaagctagcttcgttttcttcaccttggtgtgtaatggtacgtagagatgcacaaatcattcggacatgaatgtgtctaatttctaaaatggaacatataccataactatgatgagcagggcgctcacattac

SEQ ID NO: 26908 - protein, 74 aa, Panicum virgatum; identical to SEQ ID NO: 18697
  misc_feature: Ceres CLONE 1873762
  misc_feature (15)..(74): Pfam Name: potato_inhibit Pfam Description: Potato inhibitor I family

SEQ ID NO: 26909 - DNA, 678 bp, Panicum virgatum
  misc_feature: Ceres CLONE 1873767
  misc_feature: Encodes the peptide sequence at SEQ ID NO. 26910
gcaaggcaagatcgagcaggatcactcaagccaagcagcagcagcagcagcaagcctcttgcagagtgctgagcagagcagcagctccctgcgcgcgcatgggatccttgttgggccctaccgtgaccgtgaacgtgagcatgaccaagcccgacgctgcggctgccggcggcgggcagcagccgccggagaggaaggagggcggcggcaggtgcggcgtgctcggctgcggcttccggatgcccctgcactacccgcggtacaagaaggaggactacgagggcatgccggagtggcgcgtcgacagcctgctccgcgagtacggcctccctgccgacggcgacctcgacagcaagcgccgcttcgccatgggcgccttcctctggcccgaccagtactgaactgcgggaggaagctcgccgtggcccgccgtgatcgatctgatctcaccatgctcggaggacgagctgcacttccacgcagcttcagtgattacgttacatatagcgataacaacctgattgagtcagtcatcacactcactatttagaaagagatcgtcctaacttatcatcatctgcttgtaatggccggacatgacacagaggcggtgaatgcgtatgtttcttgcgccctgtatagctatggcggaataataagatgtgctcattctctatc

SEQ ID NO: 26910 - protein, 100 aa, Panicum virgatum
  misc_feature: Ceres CLONE 1873767
  misc_feature: Functional homolog of the protein sequence given in SEQ ID NO 50167
  misc_feature: Useful for making plants with modulated nitrogen use efficiency
MGSLLGPTVTVNVSMTKPDAAAAGGGQQPPERKEGGGRCGVLGCGFRMPLHYPRYKKEDYEGMPEWRVDSLLREYGLPADGDLDSKRRFAMGAFLWPDQY

SEQ ID NO: 26911 - DNA, 721 bp, Panicum virgatum
  misc_feature: Ceres CLONE 1873769
  misc_feature: Encodes the peptide sequence at SEQ ID NO. 26912
ctccagacacaagggaaaaacttttttgggcttgaaggctctgatactgatgttgcgctaaacacaataattttcaactcattcgtcttctgccaggtgtttaatgagataagctcgagggagatggaaaagatcaacgtgctcaagggcatgacgaggaactatgtcttcatggctgtcctcaccagcacggtcatcttccaattcatcatggtgcagttcctgggcgagttcgccaacacgacacccctcaacttgcaccagtggctcgccagcgtgctcctgggcctggttgggatgccaattgctgccgccgtcaagctgattcccgtcggctcatcatgatcattgaagatccttacctgcaaagcacagatatattcagattgaccaaattgcatgatattctgtgtagctgaactccctgtgcatgaacttttggaatgcacggagagagctggcttgggaacagctgctgcactttgaaaagttttgtagcctgcaaatgtgtctagattgcatcgtgttgtatgaagcattgtgtttgacactggggttcaggctcagctctgttagtgtagcagaattgtaagattggtgcttagcctttgaaatggaatttagactgcaggatatttatgtggatcaatgaatggaaacatggttaattcagattagggttatttatatggcaattcagatgtagatttagggggttatt

SEQ ID NO: 26912 - protein, 114 aa, Panicum virgatum
  misc_feature: Ceres CLONE 1873769
  misc_feature (2)..(113): Pfam Name: Cation_ATPase_C Pfam Description: Cation transporting ATPase, C-terminus
  misc_feature: SWISSPROT Homolog: EC 3.6.3.8 Calcium-transporting ATPase
LQTQGKNFFGLEGSDTDVALNTIIFNSFVFCQVFNEISSREMEKINVLKGMTRNYVFMAVLTSTVIFQFIMVQFLGEFANTTPLNLHQWLASVLLGLVGMPIAAAVKLIPVGSS

SEQ ID NO: 26913 - DNA, 697 bp, Panicum virgatum
  misc_feature: Ceres CLONE 1873795
  misc_feature: Encodes the peptide sequence at SEQ ID NO. 26914
actgccaccacactgatcgttgcgtggcaagccagtcacgactcgcaaggagtagccatgcagggggccatgcggagactcgtgcgcgtcctcgtggcgctcggcgtggtcgccgcggcggcggcgcagcaggccccgacgcccacgccggcgacccccgcggcgccggcgccggcggccgcgtcgagcaacatcacgggcgtgctggccaagggcgggcagttcaacaccttcatccggctgctcaagtccacgggcgtggcgtcgcagatcgacaaccaggtctccaacggcggcaacgggatcacggtgttcgcgcccacggacaacgccttcacgtcgctgccctccggcacgctcaactcgctctccgaccaggacaagaacgcgctcgtccagtaccacgtcgtctccaccgccatcccccagtcgcagttcgacaccgtcagcaacccgctccggacgcaggccggcagcagctcgccgggggagtacccgctcaacgtcaccgccgtgggcggccagcaggtgaacatctccacgggggtcgtcaacgccaccgtcgacaacaccctctacaccggcgacagcctcgtcgtctaccaggtcaacaaggtgctgctgccggcgaagctcttcggcacggctgaggcccccgcgcccgcgccgctcgcgccggccaaaaagaagggcaaga

SEQ ID NO: 26914 - protein, 213 aa, Panicum virgatum
  misc_feature: Ceres CLONE 1873795
  misc_feature (55)..(190): Pfam Name: Fasciclin Pfam Description: Fasciclin domain
  misc_feature: Functional homolog of the protein sequence given in SEQ ID NO 50208
  misc_feature: Useful for making plants with altered carbohydrate content
  misc_feature: Functional homolog of the protein sequence given in SEQ ID NO 50209
  misc_feature: Useful for making plants with altered cell wall content and/or composition
MQGAMRRLVRVLVALGVVAAAAAQQAPTPTPATPAAPAPAAASSNITGVLAKGGQFNTFIRLLKSTGVASQIDNQVSNGGNGITVFAPTDNAFTSLPSGTLNSLSDQDKNALVQYHVVSTAIPQSQFDTVSNPLRTQAGSSSPGEYPLNVTAVGGQQVNISTGVVNATVDNTLYTGDSLVVYQVNKVLLPAKLFGTAEAPAPAPLAPAKKKGK

SEQ ID NO: 26915 - DNA, 650 bp, Panicum virgatum
  misc_feature: Ceres CLONE 1873806
  misc_feature: Encodes the peptide sequence at SEQ ID NO. 26916
ctctccagccgcaccccgcctcgccgtcccgctcgctcccgcttcgccgctgccgccaaaatgccgttcaagaggttcgtggagatcgggcgggtggccctggtgaactacggcaaggactacggccgcctcgtcgtcatcgtcgacgtcgtcgaccagaacagggcacttgtggatgcccccgacatggtccgctgccagatgaacttcaagcggctttccctgactgacatcaagattgacattaaacgtgtcccaaagaagactacattgattaaggccatggaggaagctgatgtgaaaaacaagtgggagaagagctcatggggcaagaagctgattgtccagaagaggagagcatcactcaatgacttcgacaggttcaaggtcatgttggcaaagatcaagaggggtggtgctatcagacaggagcttgctaagcttaaaaaggaggttgctgctgcttagattgctttggtggtttagattttgtttgtctatgtttcgatatctgaaaaaggaacatgtacaatgtgcgaattacttcgacggtttatcagagcttgtcaaaatggtaatttcaaacatggcttgtttagaaattttgcccagattacttttttctgaatataagatagtttgaacatatg

SEQ ID NO: 26916 - protein, 135 aa, Panicum virgatum
  misc_feature: Ceres CLONE 1873806
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQMNFKRLSLTDIKIDIKRVPKKTTLIKAMEEADVKNKWEKSSWGKKLIVQKRRASLNDFDRFKVMLAKIKRGGAIRQELAKLKKEVAAA

SEQ ID NO: 26917 - DNA, 701 bp, Panicum virgatum
  misc_feature: Ceres CLONE 1873810
  misc_feature: Encodes the peptide sequence at SEQ ID NO. 26918
gaaccgcacgcaaacaccacaaaccgcagggcaccccgggtcggcagcgaaccaaaaccagcaagcgatccagggcggcccaggttctcctctccgggcggcacctgctcggccgccccgggcagccggccgcctcccggccctcgtcggccagaaaggcccccttcgccgtcagggccacctccaccccgccggccaagcaaggccccaaccggcagttgtggttcgcgtccaaccattccctctcctacctcaatggcacgctgcccggcaactacggtttcaacccgttggggctgtcgaacccgaagggcaccggggggttcatcaagcccaagtggttggcctacggcaaggtgatcaacggccggttcgccttgctgggcgcggcaggccccatccccccgaaaatcttcggcaagctgggcatcatcccggcgaaaacggccctgccgtggttcaaaacgggggtcatcccgcccgcgggcacctacaactactgggccaactcgtacaccctcttcttcttcaacatggcgctcatgggcttcgccaaccaccgccccctccagaactggtacaacccgggctccatggccaagcattacttcctcgggcttgagaagttcttcggcggctccggcaacccctcttacccggggggcccgttcttcaacccgttcgggttcggcaagacggag

SEQ ID NO: 26918 - protein, 232 aa, Panicum virgatum
  misc_feature: Ceres CLONE 1873810
  misc_feature (79)..(232): Pfam Name: Chloroa_b-bind Pfam Description: Chlorophyll A-B binding protein
TARKHHKPQGTPGRQRTKTSKRSRAAQVLLSGRHLLGRPGQPAASRPSSARKAPFAVRATSTPPAKQGPNRQLWFASNHSLSYLNGTLPGNYGFNPLGLSNPKGTGGFIKPKWLAYGKVINGRFALLGAAGPIPPKIFGKLGIIPAKTALPWFKTGVIPPAGTYNYWANSYTLFFFNMALMGFANHRPLQNWYNPGSMAKHYFLGLEKFFGGSGNPSYPGGPFFNPFGFGKT

SEQ ID NO: 26919 - DNA, 733 bp, Panicum virgatum
  misc_feature: Ceres CLONE 1873816
  misc_feature: Encodes the peptide sequence at SEQ ID NO. 26920
agtcacccacccaacccccagcacccaagaccctcccaaagtcccgaaggccgccgccgccgccgccgccgccatggccgctcagaccttcctcctcgcgccgcccgccgccctcttcgccgccccctcttcctccgcacgccctttccactcgctacgcctcgtcgccgggcccgggggtcccgccgccgccgccagggcgctcgtcctcgccgatgccaccaagaaggccgtcgccgtcctcaagggcacatccgaggtcgagggcgtcgtcacgctcacgcaggaggacgacggaccaaccattgtcaacgtccgtgtcactggacttactcctggacttcatggcttccaccttcacgagtttggcgataccaccaatggatgcatatcgacaggaccacatttcaacccaaacaatctgacacacggtgcgccggaagatgaagtccgccatgcgggtgacctgggaaacattgttgccaatgctgagggagttgctgaggcaaccattgttgataatcagattcctttgagcggcacaaattcagttgttgggagagcatttgtggttcatgagctcgaagatgatttggggaaaggcggccatgagcttagcctcagtactggaaatgctggtggaagactggcatgtggtgttgttggccagactccattgtaggttgctcgctcggcggattgcagttgagacttcagtgtcacatccatggtg

SEQ ID NO: 26920 - protein, 202 aa, Panicum virgatum
  misc_feature: Ceres CLONE 1873816
  misc_feature (50)..(201): Pfam Name: Sod_Cu Pfam Description: Copper/zinc superoxide dismutase (SODC)
  misc_feature: SWISSPROT Homolog: EC 1.15.1.1 Superoxide dismutase
MAAQTFLLAPPAALFAAPSSSARPFHSLRLVAGPGGPAAAARALVLADATKKAVAVLKGTSEVEGVVTLTQEDDGPTIVNVRVTGLTPGLHGFHLHEFGDTTNGCISTGPHFNPNNLTHGAPEDEVRHAGDLGNIVANAEGVAEATIVDNQIPLSGTNSVVGRAFVVHELEDDLGKGGHELSLSTGNAGGRLACGVVGQTPL

SEQ ID NO: 26921 - DNA, 725 bp, Panicum virgatum
  misc_feature: Ceres CLONE 1873838
  misc_feature: Encodes the peptide sequence at SEQ ID NO. 26922
atcgctccctctccctctcccccacagcaggctagctagggttttctggggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggcggcggcgcgctcgccggcggggagcgcccggacaacggctacggcggacgcggtggcggcggctacggcggcggaggcgaccgcggctacgggggaggcggcgaccgcggctacgggggaggcggcgaccgcggctacgggggaggcggcgaccgcggttacggcggaggcggcgaccgcggctacggtggaggaggtgaccgcggctacggcggaggcggcggcgaccgcggctacgggggaggaggtggcttcggaggaggcggcgaccgtggctacggcggcggcggcggaggcggccgcggctccgggtgctacaagtgcggcgaggagggccacatcgcacgggactgctcccacggcggcggcggctacggcggaggcggctacggcggaggccgcggctctgggtgcta

SEQ ID NO: 26922 - protein, 211 aa, Panicum virgatum
  misc_feature: Ceres CLONE 1873838
  misc_feature (5)..(72): Pfam Name: CSD Pfam Description: 'Cold-shock' DNA-binding domain
  misc_feature (176)..(193): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGTKGFGFISPDDGGQDLFVHHSSVKADGFPNLKDGDAVEFTVGADNDGRAKAIDVSAPGGGALAGGERPDNGYGGRGGGGYGGGGDRGYGGGGDRGYGGGGDRGYGGGGDRGYGGGGDRGYGGGGDRGYGGGGGDRGYGGGGGFGGGGDRGYGGGGGGGRGSGCYKCGEEGHIARDCSHGGGGYGGGGYGGGRGSGC

SEQ ID NO: 26923 - DNA, 257 bp, Panicum virgatum
  misc_feature: Ceres CLONE 1873850
  misc_feature: Encodes the peptide sequence at SEQ ID NO. 26924
ggacggcgggaggacgcgagggggtgagggagcggggcggcgacgatggtggacgtctcgcgcgtgcagaaggaactcccccaatggaacccccaccgggggggtctcgggcgtctccttcgcgctgcacgacggctctaacatctcccacctcaccggcaccatcgccgggcccgccgacagcccctacgagggcggcaccttcgtcatcgacatccgcctccccggtggatatccctttgaacctccaaagatgc

SEQ ID NO: 26924 - protein, 85 aa, Panicum virgatum
  misc_feature: Ceres CLONE 1873850
  misc_feature: SWISSPROT Homolog: EC 6.3.2.19 Ubiquitin--protein ligase
DGGRTRGGEGAGRRRWWTSRACRRNSPNGTPTGGVSGVSFALHDGSNISHLTGTIAGPADSPYEGGTFVIDIRLPGGYPFEPPKM

SEQ ID NO: 26925 - DNA, 612 bp, Panicum virgatum
  misc_feature: Ceres CLONE 1873859
  misc_feature: Encodes the peptide sequence at SEQ ID NO. 26926
gtcgtcagtcttctttgctgccttcggcccttcacagttcacacttcgccagatcaccaccccgaccgcgactgccgacgcaagccacgaggccggcgacccccgcacctcctcgcctccggcgaccgtcccgagctaacggtgatccagggagaaacatgggcagcgtctggagtggcggtgcaggaggtggtggctctgcctcctcgggaggtcatggtggctcggccaaccctggtggaggcggcggcaagatgatgaaggcgcccggcggcggcggcgcgtacatctcccgccctggcttcgagtccaaccctcagggctacttccaggacctccgcaagggaggcaagtagatgtaggcttgcccggagagcgcctcccggtgcctgcgagtatatggaccgtgagagtccatagcttctaaataatgcacaggtcgctgcaccaggaggcggcagcagtctattttataaataatgtacagctgctgcaccagtagccggcagcagcctagctagccttctgctgctccacgtcctgtttcggtttgctcgcttgtttcaaagtacctgctccctcctttaataaagaaaacgcaatattcgatct

SEQ ID NO: 26926 - protein, 65 aa, Panicum virgatum
  misc_feature: Ceres CLONE 1873859
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
MGSVWSGGAGGGGSASSGGHGGSANPGGGGGKMMKAPGGGGAYISRPGFESNPQGYFQDLRKGGK

SEQ ID NO: 26927 - DNA, 673 bp, Panicum virgatum
  misc_feature: Ceres CLONE 1873905
  misc_feature: Encodes the peptide sequence at SEQ ID NO. 26928
atggccagatcggcgccggggctgccgccgcagtactacgcggccgcgcgctccggccaccgctcgtcctcccccgcggcgtcctgcgtcgtggccctcctcttcctcctcctggccgccggcggcgccgcggccgcgctgttcctgctctaccgcccgcgcgcgccggccatcgccgtcacggccgtgcagctgcccgccttcgccgcggccaacggcaccgtcgccttcaccttccagcagctcgcctccgtgcgcaaccccaaccgcgccccgctcgcgcactacgacagctccctccacgttgcctgcgccggcggcgaggtcggctccatgtacatccccgcgggccagatcgacggcggccgcacgcagtacatggccaccagcttcgacgtccccgccttcgccgtcgcgggccccgccgccgcgcagcctgccaccatctccgttcccgcgtccgggccgtcaccgcacgtcacggacgcgctggtggcgcaacatcagcagcagcagccggtgatggaggtggactcgctgctggtggtcaagggcaaggtcaccgtgctcaaggtcttcacccaccacgtcgaggccgccaaggtctgccgcatcggcgtctcgccggccgacggccgcgtgctcggcttccggtgctgacactactgctcgg

SEQ ID NO: 26928 - protein, 219 aa, Panicum virgatum
  misc_feature: Ceres CLONE 1873905
  misc_feature (48)..(203): Pfam Name: Hin1 Pfam Description: Harpin-induced protein 1 (Hin1)
MARSAPGLPPQYYAAARSGHRSSSPAASCVVALLFLLLAAGGAAAALFLLYRPRAPAIAVTAVQLPAFAAANGTVAFTFQQLASVRNPNRAPLAHYDSSLHVACAGGEVGSMYIPAGQIDGGRTQYMATSFDVPAFAVAGPAAAQPATISVPASGPSPHVTDALVAQHQQQQPVMEVDSLLVVKGKVTVLKVFTHHVEAAKVCRIGVSPADGRVLGFRC

SEQ ID NO: 26929 - DNA, 693 bp, Panicum virgatum
  misc_feature: Ceres CLONE 1873936
  misc_feature: Encodes the peptide sequence at SEQ ID NO. 26930
accaagccagaccaagccaagctcagtagctcccactcacacgaagagcacgtcccaggaagagagcagagagagaggcggatcgaagatgagcgtggagatccttgacgggagcacggtccggagcttcgtggaggacgagggcgccttcaactcctccgtcgacggccgcttcgccgcgctggacgccgaccgcgacggcctgctcacgtacgcggagatggccggcgagctcatgagcctccgggtcctcgagaagcacttcggcgtggacgaggcggcggtgccggccgacgagctcgccgcgctctaccgcggcctgttcgcgcggttcgacagggacggcagcggcaaggtggaccgccaggagttccgcgcggagatgagggaggtgctgctcgccgtggccaccgggctcggcttcctccccgtgcagatggtcgtcgaggaggggagcttcctcaagatcgccgtcgacagggagctcggccagatcgccaaggctgcgtaaagctcacatgcatggatcactacttgcgcgatcggagtagtatagattattactgaatttcaagtgtcatgattgcaattttaacatcgagttacagagtgtcacgacgaacttatttagtagtatgtttcttgttctttcattacctgaaagctaaataaagacatcacacatgtaattgg

SEQ ID NO: 26930 - protein, 140 aa, Panicum virgatum
  misc_feature: Ceres CLONE 1873936
  misc_feature (74)..(102): Pfam Name: efhand Pfam Description: EF hand
MSVEILDGSTVRSFVEDEGAFNSSVDGRFAALDADRDGLLTYAEMAGELMSLRVLEKHFGVDEAAVPADELAALYRGLFARFDRDGSGKVDRQEFRAEMREVLLAVATGLGFLPVQMVVEEGSFLKIAVDRELGQIAKAA

SEQ ID NO: 26931 - DNA, 706 bp, Panicum virgatum
  misc_feature: Ceres CLONE 1873944
  misc_feature: Encodes the peptide sequence at SEQ ID NO. 26932
ataggaacccccgtcccgttccttctccccgccgccgccgccgccgccgcctttgcagttgcagcaggctcgtcctccgccaccgcgcgcgccggcaggcaccgccacttgatccgcgatccacacgcaggtggcttctggcaagcaaaatggctttctcatcggttttcaggagagtgaatgtcaaagaactgatctcgaatgcttcggtgtatgctagcgcaacagaatcttctggaggaatgagcttggtgtttagacgctgggccaccaagaagactgctggatcgacaaaaaatggccgtgactccaatcccaagtacctaggtgtcaagaagttcggtggagagaaagtagaaccgggaaacattattgttcgccaaagaggaacgcgcttccaccctgggaactatgttggcattggcaaggatcacactctcttctgcctgaaggaaggccatgttcggttcgagcgcaacaaactgaccggcaggaaatgggttcatgttgaccctgtggctggtcatgtgctccaccctgtctatgccagtggctcgactactgcagttgacctggatgcacagttgtagcgactatgcagttgcttatgctcttccaacggatttgccgctcctatgcttgtcatcagaaccaccaagtgcctctcattacacaatgcaacttgttccagcaaagatgcttgtaa

SEQ ID NO: 26932 - protein, 146 aa, Panicum virgatum
  misc_feature: Ceres CLONE 1873944
  misc_feature (40)..(121): Pfam Name: Ribosomal_L27 Pfam Description: Ribosomal L27 protein
MAFSSVFRRVNVKELISNASVYASATESSGGMSLVFRRWATKKTAGSTKNGRDSNPKYLGVKKFGGEKVEPGNIIVRQRGTRFHPGNYVGIGKDHTLFCLKEGHVRFERNKLTGRKWVHVDPVAGHVLHPVYASGSTTAVDLDAQL

SEQ ID NO: 26933 - DNA, 691 bp, Panicum virgatum
  misc_feature: Ceres CLONE 1873974
  misc_feature: Encodes the peptide sequence at SEQ ID NO. 26934
cccgccgctgcgctgcgctccccctcccctcgcacccgcaggctagggttctcctcgagaggcggcgccatgttggtctaccaggatctgctcaccggcgacgagctcctctccgactcgttcccgtacaaggagatcgagaacggcgtgctctgggaggtcgagggcaagtgggtcgtccaaggtgctgttgacgtggacactggtgccaacccttctgctgagggtggcgaggatgagggcgttgacgatcaagcagtaaaggttgtcgacattgtcgacacatttcgtcttcaggaacaacctgcctttgacaagaagcagtttgtcacatttatcaaacgctacatcaagaaccttaccgccaagctggatccggagaaggctgatgaattcaagaagggcattgagggtgccaccaagtatcttcttagcaagctcaaggaccttcagttctttgttggtgagagcatgcatgatgatgggagcttggtgttcgcatactacaaggatggagccaccgacccgaccttcctttactttgcgcacgggttgaaggagattaagtgctaggcgggcgtgtgccttcgaccctgtgctgttataatctatgtagtactatccttaattttgttgctgtctgtttgcttgagaatattgttttgggaaactactgaactatgtctgggaa

SEQ ID NO: 26934 - protein, 167 aa, Panicum virgatum; identical to SEQ ID NO: 25989
  misc_feature: Ceres CLONE 1873974
  misc_feature (1)..(164): Pfam Name: TCTP Pfam Description: Translationally controlled tumour protein

SEQ ID NO: 26935 - DNA, 550 bp, Panicum virgatum
  misc_feature: Ceres CLONE 1873993
  misc_feature: Encodes the peptide sequence at SEQ ID NO. 26936
attgcatcgcatctcctctcgctctctgttgtgtgactgattgccaagaaagctctctgcttgcttgtggtcccaccctctgaatctcgtgaggatgtcgtgctgcggaggcaactgcgggtggcgctcccgctgccaatgcccgcccccggtggcgggggggtccaaaatgccccgggacgtgagtgaccggggccccccccccaccagccaaactgtcatcgtgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgaagctagtatagcggcgttgtgtgtgcgtcgttcgtttgtctgagagtgtgtgtggcatgcttaataacggtgttgcgcgtgctgctagtagatggtactgatggggaacaataataatgatggtgctgagatgtcgtcggcgtcgccgccgccgtcgtgtccttcctccc

SEQ ID NO: 26936 - protein, 82 aa, Panicum virgatum
  misc_feature: Ceres CLONE 1873993
  misc_feature (1)..(81): Pfam Name: Metallothio_2 Pfam Description: Metallothionein
MSCCGGNCGWRSRCQCPPPVAGGSKMPRDVSDRGPPPTSQTVIVGVAPTNKGHAEGGFEAGAGAENGCKCGANCTCNPCTCK

SEQ ID NO: 26937 - DNA, 544 bp, Panicum virgatum
  misc_feature: Ceres CLONE 1873995
  misc_feature: Encodes the peptide sequence at SEQ ID NO. 26938
ttgggaggcgtccagtgtggatgactatttatagctgatgggaagagcttgctacaagccagttattgagtattgtggaggcacagagattggtggtggatttgttactggatctttgctgcaacctcaagcattgtctgcattcagcacacctgccatgggttgcaacttgttcattcttgacagcagcgggaatcccttgccacaagattcagtgggtattggtgaacttgcgcttgatccgattttatttggatcatcaacaactctgctaaacgctgatcatcaggaagtttatttcaacggaatgccagaatggaatgggaaagtcctccgcagacatggagatgaatttgagcatacttgtgatggatattatagggctcatgggcgcgcagatgacacaatgaatcttggtggcattaaggttagttccatcgagattgagaggatctgcaacagagcaaacgacgccatcctcgaaacagcagctattggggttccgccaataggtggtggccctgaacagctaacgatagccgtt

SEQ ID NO: 26938 - protein, 168 aa, Panicum virgatum
  misc_feature: Ceres CLONE 1873995
  misc_feature: SWISSPROT Homolog: EC 6.2.1.1 Acetate--CoA ligase
MGRACYKPVIEYCGGTEIGGGFVTGSLLQPQALSAFSTPAMGCNLFILDSSGNPLPQDSVGIGELALDPILFGSSTTLLNADHQEVYFNGMPEWNGKVLRRHGDEFEHTCDGYYRAHGRADDTMNLGGIKVSSIEIERICNRANDAILETAAIGVPPIGGGPEQLTIA

SEQ ID NO: 26939 - DNA, 681 bp, Panicum virgatum
  misc_feature: Ceres CLONE 1873996
  misc_feature: Encodes the peptide sequence at SEQ ID NO. 26940
cacacaggagcccgcggagtgatcaaaaaagcaagtaacaagagaagatgaccgacgttgtgatgaccatcagtactaccacggatttggaaagagaactgaataaatccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgatgtacgttctactgaagaatgacgatgtgatcgacatggtcgttggcgtcaggaggcacgagctcgagaacgccataaaaaacaatatctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagatccccatgttatgtatactctggtttgaaacagtttgcaataaatcaatgtctggctagtgtatttctt

SEQ ID NO: 26940 - protein, 108 aa, Panicum virgatum; identical to SEQ ID NO: 17896
  misc_feature: Ceres CLONE 1873996
  misc_feature (4)..(107): Pfam Name: Thioredoxin Pfam Description: Thioredoxin
  misc_feature: SWISSPROT Homolog: EC 1.8.1.8 Protein-disulfide reductase

SEQ ID NO: 26941 - DNA, 641 bp, Panicum virgatum
  misc_feature: Ceres CLONE 1874013
  misc_feature: Encodes the peptide sequence at SEQ ID NO. 26942
aacgacacctgcgcactaggctcgcacctacaaagctcaacagatcaagcagcagcaatggacggctcggttgacaacactagtagtagcgagcgcccccgcctcgtcctgctcctcgccgccgccgtggctctgacgatcctggcgccgccgccgggggcggcacaacggcgccgcgctgtgcatctgacagtgtacctccaggatatcctggacgggccggggcagacggacaatctgctgatcaagggccccggcccggcaaacccgtccctgtggcccccgcacaactacttccgagacaaaatcgtgatggacgacctcgtcaccgaggcagtccccaacaactcccagcccatcggccgcgtgtacggaatctacatgacggcctccatgacacgcccggtgtacacggtgagcttcacgctgcatctcatcgcgcggccctacaacgggagcacgatcgtgatggccggcatccaccacaacaacatgggggtcaggcagcacgccgtggtgggcggcaccagcgcgctccagggcgccgagggctacgtgtttggcatcatctagccgtttacgtcctcatacgtagtgatggagctggacatttacatgagcgtgccggtgtcggtgccgaa

SEQ ID NO: 26942 - protein, 171 aa, Panicum virgatum
  misc_feature: Ceres CLONE 1874013
  misc_feature (17)..(169): Pfam Name: Dirigent Pfam Description: Dirigent-like protein
MDGSVDNTSSSERPRLVLLLAAAVALTILAPPPGAAQRRRAVHLTVYLQDILDGPGQTDNLLIKGPGPANPSLWPPHNYFRDKIVMDDLVTEAVPNNSQPIGRVYGIYMTASMTRPVYTVSFTLHLIARPYNGSTIVMAGIHHNNMGVRQHAVVGGTSALQGAEGYVFGII

SEQ ID NO: 26943 - DNA, 610 bp, Panicum virgatum
  misc_feature: Ceres CLONE 1874017
  misc_feature: Encodes the peptide sequence at SEQ ID NO. 26944
accccaccactgccggccgccccgaaccccggagaagaatcgaggcggcgtcaacctctctaccctccccatcgccatggaggcactggatacctaactgcttgctttgcactgatggttggaccggaagggcgagcagttggtgttgaacatattccagagctggttgctacttctattgaaaatataaagaaaagtgcagcagctccacagctaaatgacggatctcttagtatacacattgctgatggcagggaaggttggccagagctggcaccctatgatgccatccatgtaggagctgcagcgccgcagatcccagaggcgctggtcgagcagttgaagcctggtggcaggatggtgatcccggttgggacaatgttccaggagctcaaggtggtggacaagaagttggatggcacagtcagcattagagatgagacgtctgtgcgctatgtgccgcttaccagcaaggaagctcaattgcgcgcaaactgattgcgcttaatgcaccaccttgccagctcaggccttggatgattcgactgatcgaatcattattgttgtacataaattgatcctactgtgtctagtgcatgcactttttaaa

SEQ ID NO: 26944 - protein, 165 aa, Panicum virgatum
  misc_feature: Ceres CLONE 1874017
  misc_feature (7)..(160): Pfam Name: PCMT Pfam Description: Protein-L-isoaspartate(D-aspartate) O-methyltransferase (PCMT)
  misc_feature: SWISSPROT Homolog: EC 2.1.1.77 Protein-L-isoaspartate(D-aspartate) O-methyltransferase
TPPLPAAPNPGEESRRRQPLYPPHRHGGTGYLTACFALMVGPEGRAVGVEHIPELVATSIENIKKSAAAPQLNDGSLSIHIADGREGWPELAPYDAIHVGAAAPQIPEALVEQLKPGGRMVIPVGTMFQELKVVDKKLDGTVSIRDETSVRYVPLTSKEAQLRAN

SEQ ID NO: 26945 - DNA, 721 bp, Panicum virgatum
  misc_feature: Ceres CLONE 1874036
  misc_feature: Encodes the peptide sequence at SEQ ID NO. 26946
gtctcccagccggccgcgcgcaccggggcgttgcggctcctctcagctagggttcgcctctcctccgccgccctcgtcttcgcttgcagccgagaccaggtcgaggtcgctccaagtcgagtgtttcgaccagatacgtttcggggaagccggtagggcggcgccatgaggttggagaagtgctggttctgctcctccaccatctaccccggccatggcatccagttcgtccgcaacgacgccaagatctttcgcttttgccggtcaaagtgtcataaaaatttcaagatgaagaggaatcctcgtaaggttaagtggacaaaagcatacagggccttgcatggcaaggacatgacccaggattcgacctttgagtttgagaggaagaggaacaggcctgagcgctatgatcggaatatgaccgagcaaactctaaaggccatccctgttattataaaggctaggcatgaacgtctgaagaagcacattacagacagacaaaatcctggtaaaaggaaggcgctggagagagataacaaggagctggagcaggacatcaacatgcttccgaagaagcttttcagtaatgtggagaaaacaaaggtcccggtcaaggtcaaagtcaaagttgttcagcagcagacagaagatcggatggaagagtagccggatgggattgtgttgcttgtgttcatgtggtatgcagacgttttcttttgag

SEQ ID NO: 26946 - protein, 166 aa, Panicum virgatum
  misc_feature: Ceres CLONE 1874036
  misc_feature (1)..(75): Pfam Name: Ribosomal_L24e Pfam Description: Ribosomal protein L24e
MRLEKCWFCSSTIYPGHGIQFVRNDAKIFRFCRSKCHKNFKMKRNPRKVKWTKAYRALHGKDMTQDSTFEFERKRNRPERYDRNMTEQTLKAIPVIIKARHERLKKHITDRQNPGKRKALERDNKELEQDINMLPKKLFSNVEKTKVPVKVKVKVVQQQTEDRMEE

SEQ ID NO: 26947 - DNA, 1688 bp, Panicum virgatum
  misc_feature: Ceres CLONE 1874074
  misc_feature: Encodes the peptide sequence at SEQ ID NO. 26948
aaggcgtagcgaggccaccgccaccgacatcgcctggtaacccgtcgtccccgaatccacccacccacattccccgaaccccacgccgcattctccccgatccaaccgcgccgccgcaccaggaggggaaggaagaagaaaggagacggaccatgtcgtcgccgcccgcccgcatggatctggacggcaaccccgtcgcgcccctcaccatctgcatgatcggcgcaggtggcttcatcggctcccacctctgcgagaagctcatggccgagaccgcacacgtcgtcctcgccgtcgacgtctactgcgacaagatccgccacctcgtcgaccccgcgccgccgcacctcgctggacgaatctccttccaccgcctcaacatcaagaacgactccaggctcgaggggctcatcaagatggccgatctggttgcttgcttgcccgccccgatctgatgctgctgctgctgctgcttcttcttcttcttctagattgattttttgttgtcgttgttgatttcgctcctctgctgagctgactgttctgctgctctttggatggatctcatcaagacgataaacctggcggccatctgcacgcccgccgactacaacacgcggcccctcgacaccatctacagcaacttcatcgacgccctcccagtggtcaagtactgctccgagaacaacaagcgtctcatccacttctccacgtgcgaggtctacggcaagaccatcggcagcttcctccccaaagaccaccctctccgcaaggaacctgaattttatgttctaaaagaagatgagtcgccctgcatttttggtccaatcgtgaaacagcgatggtcctatgcatgtgcaaagcaacttattgagaggcttatttttgctgaaggcgcggaaaatggacttgagttcacaattgtgagacctttcaattggattggaccaaggatggacttcattcctggtgttgatggccctagtgagggtgtacctcgggttttggcctgcttcagtaacaatctgctccgccgagagcccttgaagcttgttgatgggggccagtcccaaagaacttttgtctacattaaggatgccatcgaagctgttgttttgatgattgaaaatcctgctcgagctaatggtcacatcttcaatgttgggaatcctaacaatgaagttactgttagggagttggcccaaatgatgacagaggtctatgcaaacgtctcaggagaggcaccactagatgaacccatgattgacgtgagttcgagtcagttctacggtgaaggatatgatgatagtgacaagagaatccctgacatgactataatcaacaagcagctaggttggaatccaaagacgcctctcaaggatttgctggagacaacattgacatatcagcacaagacatacaaggaagctatcaaaaggcaaatgtcacaggcttcagcgtcgagttagatagggaaaggtggcggcgggctctcatttagagcgcagtcacaggtgctatggtgttttggaagtcaggatacatatatgctagtaatcgtttttgatgctctagtcgctccctagatgacatcttgttatcagggaagggatgctatccgattccgtgctgctatcaagggaagggatgttatccgtatggcagagttgatgtattctatccattgt

SEQ ID NO: 26948 - protein, 303 aa, Panicum virgatum
  misc_feature: Ceres CLONE 1874074
  misc_feature (1)..(203): Pfam Name: Epimerase Pfam Description: NAD dependent epimerase/dehydratase family
  misc_feature: SWISSPROT Homolog: EC 4.1.1.35 UDP-glucuronate decarboxylase
  misc_feature: Functional homolog of the protein sequence given in SEQ ID NO 51232
  misc_feature: Useful for making plants with altered carbohydrate content
  misc_feature: Functional homolog of the protein sequence given in SEQ ID NO 50670
  misc_feature: Useful for making plants with altered cell wall content and/or composition
  misc_feature: Useful for making plants with altered lignin content
MDLIKTINLAAICTPADYNTRPLDTIYSNFIDALPVVKYCSENNKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDMTIINKQLGWNPKTPLKDLLETTLTYQHKTYKEAIKRQMSQASASS

SEQ ID NO: 26949 - DNA, 611 bp, Panicum virgatum
  misc_feature: Ceres CLONE 1874089
  misc_feature: Encodes the peptide sequence at SEQ ID NO. 26950
acaactcgcatctggagccatcggagttcatcagcactctctagtcacacagcacatcttcttctcctcctgctacagagctcaggcaaaagcttcgccgccacaacatcccaatggctcgcttcgccgtggtcgccgccatcgtcgccctcctcgccgccgctccccggccaccgccccggcaccggccgcgaagccgcccaccgcctcggcgccgtccccgctggcctctcccccggccccgcccgccgccgagggccccgccgcggccgcgccctccgcgctgacaccgaccagctccgtctccgcccccgccggcgcccccaccgccacgcccaccgggaacggcgccgcctcctccgccgtcagcttcgtcgccgtcgccgctgttgccgccgccgccgtcgtgttctagatgggggacgcgtgatgggatctcgagctgtttatactgccatattcttttttgccattcttttttattagataccgatgatgagagagcagagagagagaggacatttgagggggggattcaccgagtgctgtacacatcatgcatggttcatgatgatatgattattaatggaattctttcatttgttactacg

SEQ ID NO: 26950 - protein, 137 aa, Panicum virgatum
  misc_feature: Ceres CLONE 1874089
  misc_feature: Functional homolog of the protein sequence given in SEQ ID NO 50188
  misc_feature: Useful for making plants with altered carbohydrate content
QLASGAIGVHQHSLVTQHIFFSSCYRAQAKASPPQHPNGSLRRGRRHRRPPRRRSPATAPAPAAKPPTASAPSPLASPPAPPAAEGPAAAAPSALTPTSSVSAPAGAPTATPTGNGAASSAVSFVAVAAVAAAAVVF

SEQ ID NO: 26951 - DNA, 769 bp, Panicum virgatum
  misc_feature: Ceres CLONE 1874093
  misc_feature: Encodes the peptide sequence at SEQ ID NO. 26952
atcagcgagtcgcggcctgttgcctcccgagcaccgacgccgaaacggctggcgcaattcgcacgggcagcttcgcatcctccggttcctcgcttcctcttcctctccagcctccgcctgaccgccacttgcccgaagttcccaaaccctagcttgttccagcgctgccttccgccggtccgcccatctgccgcggactgccgtggatcccgcgccgccggctcgctttcacgtcccggctcccgccaccccacaggtgcgcttctgattccggtgttccaagctctcgcgtgaggtgccggatcaaagcaatcggccaccatgcaggctagcgataggttcaacataaactctcagcttgagcatcttcaagccaaatatgtcggtacagggcatgctgacttgaccagatttgaatgggctgtgaacatccagagggacagctatgcctcttatattgggcactatccaatgttggcgtactttgccattgctgagaatgaatcgattggaagagaacgttacaatttcatgcagaaaatgctgcttccttgtggtctccctcctgagagagacgaagactgaggggaggagctggtgcataatttcagtctttaccaagagagcaacctatgtttagccccagcatgatttggaaggagactagattagccaccgtggtactatatgcaactcaattttaagtgtactcttatcacatatgcttgacttgtcttctatcaatctattatgatgcacaaatatttcg

SEQ ID NO: 26952 - protein, 87 aa, Panicum virgatum; identical to SEQ ID NO: 15474
  misc_feature: Ceres CLONE 1874093
  misc_feature (5)..(87): Pfam Name: SF3b10 Pfam Description: Splicing factor 3B subunit 10 (SF3b10)

SEQ ID NO: 26953 - DNA, 522 bp, Panicum virgatum
  misc_feature: Ceres CLONE 1874108
  misc_feature: Encodes the peptide sequence at SEQ ID NO. 26954
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcggcggcggctaccgcggccgcggcggcggctacgggcgccgcgagggcggcggcggctacagcaaccgccgctgctacggtgggcttggaggctacggcg

SEQ ID NO: 26954 - protein, 142 aa, Panicum virgatum
  misc_feature: Ceres CLONE 1874108
  misc_feature (10)..(81): Pfam Name: RRM_1 Pfam Description: RNA recognition motif. (a.k.a. RRM, RBD, or RNP domain)
  misc_feature (48)..(133): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYGGGGYRGRGGGYGRREGGGGYSNRRCYGGLGGYG

SEQ ID NO: 26955 - DNA, 689 bp, Panicum virgatum
  misc_feature: Ceres CLONE 1874118
  misc_feature: Encodes the peptide sequence at SEQ ID NO. 26956
ttcccccggttctcccgccgttcccctcccctcgcggctttctctctctgcgctcggtcatggcggattaccacttcgtgtacaaggacgtggaggggacgaccacggagtgggacgacatccagcgccgcctcgggaacctgccaccgaagccggagcccttcaagccgccgcccttcgcccccaaggtcgacgccgacgagctgcccaagtccaaggaatggctcgacgcgcgcgagcccgaggagctcgaggaactcgaggacgacctggacgacgaccgcttcctcgagcagtacaggaagatgaggcttgcagagctcagggaggcggcaaaagccgcgcgatttggcagtatagtgcccatcaccggctcggacttcgtacgtgaggtgtctcaggcgccatcagatatctgggttgtggtcttcctctacaaggacgggataccagaatgtgggttgcttcagaattgtttggaggaattggctacaagatacccagcgacaaaatttgttaaaattatctcaacagactgcattcccaactacccagatagaaatgttcctacaatactggtgtataacaacagtgctgtcaaagggacttatgttggtttgcagaagtttggtgggaagagatgcacacctgaatctgttgctttatccctttgcccatcagaccctgta

SEQ ID NO: 26956 - protein, 209 aa, Panicum virgatum
  misc_feature: Ceres CLONE 1874118
  misc_feature (1)..(203): Pfam Name: Phosducin Pfam Description: Phosducin
MADYHFVYKDVEGTTTEWDDIQRRLGNLPPKPEPFKPPPFAPKVDADELPKSKEWLDAREPEELEELEDDLDDDRFLEQYRKMRLAELREAAKAARFGSIVPITGSDFVREVSQAPSDIWVVVFLYKDGIPECGLLQNCLEELATRYPATKFVKIISTDCIPNYPDRNVPTILVYNNSAVKGTYVGLQKFGGKRCTPESVALSLCPSDP

SEQ ID NO: 26957 - DNA, 736 bp, Panicum virgatum
  misc_feature: Ceres CLONE 1874121
  misc_feature: Encodes the peptide sequence at SEQ ID NO. 26958
atggccagcgcgggactccaccactcccccccatcttcctcgccctcccgaatcttccgccgatcccacgagaggccggcgtccagatcctctcccccgcggttcagatccccggatcgagccggcgcctcgtgaaaatccgcagcggcgacgaggttcatttggattcgcaggtgctttccgctaaaggatggctcaattatccttcttttcttgctgattgaggctctggttagcttggatcttctgcccgctgtttttgagctggtttctttcttggtgattaagctcaaagtgtttggctagttccttcagacttagctaaagcacactgtttcaagcaataattgagttccttccttgcacgggttgcttggggctgtggatctgctgaggtggcgacatgggcctggatttgggagctgttctcaaacccggcactttcggggtctcggaccacgacgcgatcgtttcgatcaacatcttcattgcgctgctctgcagctgcattgtaatcgggcacctgctcgaagggaaccgatgggtgaatgagtccatcactgcgcttgttatgggtctgatcaccggaggtgtgattctgctcgctactaatgggacaaattcacgcatcctcgtgtttagcgaggacctgtttttcatctatttgcttccgccaataatcttcaatgctggatttgttgtgctgatcctttctcttatgagttttggtctaatc

SEQ ID NO: 26958 - protein, 110 aa, Panicum virgatum
  misc_feature: Ceres CLONE 1874121
  misc_feature: The sequence is a functional homolog of SEQ ID NO 2 in US patent 7250560
  misc_feature: The sequence is a functional homolog of SEQ ID NO 4 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7256326
MGLDLGAVLKPGTFGVSDHDAIVSINIFIALLCSCIVIGHLLEGNRWVNESITALVMGLITGGVILLATNGTNSRILVFSEDLFFIYLLPPIIFNAGFVVLILSLMSFGL

SEQ ID NO: 26959 - DNA, 727 bp, Panicum virgatum
  misc_feature: Ceres CLONE 1874129
  misc_feature: Encodes the peptide sequence at SEQ ID NO. 26960
cgcgagttcacggccatggtctccgccggggcgaccatgcagaccggccccaactccaacggcagcgccggcggaggcggctacgacaacggcgtcgaccagctgaccagcatcggcgaggacgagctggaggagaccaacccgctggccatcgtgccggacagccaccccatcgcgacgccggccaggtccagggcgtccgggctggaggtggtgcccgcggggcccccgcccccgccggcgcatgtggaggccagccaggtgaagaaggaggaggtggagaccaaggtcacggcgtggcagacggcggagatggccaagatcaacaaccgcttcaagcgggaggaagtagtcatcaacggatgggagaccgagcaggtggagaaggcatccggatggctcaagaagatcgagaggaagctggacgagcagcgcgccaaggcggtggagaagacgcagaacgacatcgccaaggcgcggcgcaaggcggaggagaagcgggcgtcggcggaggccaagcgggggctcaagctggccaaggttctggagctcgccaacttcatgaaggccgtcgggagggtgcccaccaagcgctccttcttctagccggcgacccggcaggccttcgccgtccctgctccaccaccgcctgttctagccggccctgcgcctgtttgtcctgaacctgttgctgctgctgctccatcacgcctagctagtagcacgt

SEQ ID NO: 26960 - protein, 201 aa, Panicum virgatum
  misc_feature: Ceres CLONE 1874129
  misc_feature (88)..(199): Pfam Name: Remorin_C Pfam Description: Remorin, C-terminal region
REFTAMVSAGATMQTGPNSNGSAGGGGYDNGVDQLTSIGEDELEETNPLAIVPDSHPIATPARSRASGLEVVPAGPPPPPAHVEASQVKKEEVETKVTAWQTAEMAKINNRFKREEVVINGWETEQVEKASGWLKKIERKLDEQRAKAVEKTQNDIAKARRKAEEKRASAEAKRGLKLAKVLELANFMKAVGRVPTKRSFF

SEQ ID NO: 26961 - DNA, 698 bp, Panicum virgatum
  misc_feature: Ceres CLONE 1874168
  misc_feature: Encodes the peptide sequence at SEQ ID NO. 26962
agccagccagagcccccagccgcggccgcctccacccctcgacgcgccgccagcgaccgacgagccggcgaccaggcgcgccccgtcctcggctcggctgcctgggtcgatccgcgcgcgatgggcagcctcggcggcgaggagcggacggcggaggggcggcggcgcccgcggttcctgtgcctgcacggcttccgcaccagcgccgagatcatgcgcaagcaggtgctggggaggtggcccgccgacgtcaccgcgcgcctcgacctcgtcttcgccgacgcgccgttccccgccgagggcaagtccgacgtcgagggcatcttcgacccgccgtactacgagtggttccagttcgacaagggtttcacggagtacaggaatttcgacgagtgcctggcctacatcgaggagctgatgatcaaagatggccccttcgacgggctgatgggtttctcccagggtgccattctatccgcggcgcttcccgggctgcaagaacgagggctggccttgacaagagttcccaagatcaagtacctgataatcatcggcggcgccaagttccggtctccgaccctggtcgagaaggcgtacgccagcaagatcacttgcccctcgcttcacttcaccggtgacaacgacttcctcaaagctcatggtgagaagctcatagaatcatgcgtggatccgttcgt

SEQ ID NO: 26962 - protein, 192 aa, Panicum virgatum
  misc_feature: Ceres CLONE 1874168
  misc_feature (13)..(191): Pfam Name: FSH1 Pfam Description: Serine hydrolase (FSH1)
  misc_feature: SWISSPROT Homolog: EC 1.5.1.3 Dihydrofolate reductase
MGSLGGEERTAEGRRRPRFLCLHGFRTSAEIMRKQVLGRWPADVTARLDLVFADAPFPAEGKSDVEGIFDPPYYEWFQFDKGFTEYRNFDECLAYIEELMIKDGPFDGLMGFSQGAILSAALPGLQERGLALTRVPKIKYLIIIGGAKFRSPTLVEKAYASKITCPSLHFTGDNDFLKAHGEKLIESCVDPF

SEQ ID NO: 26963 - DNA, 340 bp, Panicum virgatum
  misc_feature: Ceres CLONE 1874189
  misc_feature: Encodes the peptide sequence at SEQ ID NO. 26964
cgtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcctcctcgatcgggagacccagaggtcccgcggcttcggcttcttcaccttctcgagcgagcaggcgatgcgcgacgccatcgaggggatgaacggcaaggagctggacggccgcaacttcac

SEQ ID NO: 26964 - protein, 79 aa, Panicum virgatum
  misc_feature: Ceres CLONE 1874189
  misc_feature (10)..(78): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKILLDRETQRSRGFGFFTFSSEQAMRDAIEGMNGKELDGRNF

SEQ ID NO: 26965 - DNA, 438 bp, Panicum virgatum
  misc_feature: Ceres CLONE 1874190
  misc_feature: Encodes the peptide sequence at SEQ ID NO. 26966
acaggccacagcaccaccaccggagcacagagagagcagagcgccacaggccgtccgatcctccgcgcgaagcagatcagatggctctcgctctctccggctcctccgcgctccgcgccgcgctggcctcgctggcccccgccaggggctacgcggcgtcggcggcgtccggggccatgcggcgcgcggcggccgcggaggagagcgccgccgcgggggaggccgaggaggccgggcgcggcgccccctccgagatctcctgcgtccccgaccccgtcccgggccactaccgccccgccggctgggccgccgccgccgaccccgccgacctccgcgccgcgcacctcggccgggcgtgagccccgcgcccgcgcccccccacccgtctgagataacataccaacgcagggaaaggtggggtggaggtccgtctggcgt

SEQ ID NO: 26966 - protein, 92 aa, Panicum virgatum
  misc_feature: Ceres CLONE 1874190
  misc_feature (1)..(90): Pfam Name: LEA_3 Pfam Description: Late embryogenesis abundant protein
MALALSGSSALRAALASLAPARGYAASAASGAMRRAAAAEESAAAGEAEEAGRGAPSEISCVPDPVPGHYRPAGWAAAADPADLRAAHLGRA

SEQ ID NO: 26967 - DNA, 608 bp, Panicum virgatum
  misc_feature: Ceres CLONE 1874211
  misc_feature: Encodes the peptide sequence at SEQ ID NO. 26968
attcgccaccatcgagacaccccgctcggccacagcgaccggcctagccgacggccgggccgccgccgacgcaccgcgcgcttgggaccgagaccgagagactccgagagggagggaggggaactagcctgcccggcgcggggccggccgcggccctccgccgtcccatggggggaagcctggtgtccatgctccggtggccaccggacctgggcctgcccagcctggcggcgctgctcccctcgccgcccgcgcacctccggctccgggtacaggagtggtggcagtggtcgagccccgagcagctgagcgcggcggcggcgcggcggtggcccgagatggtgcgggacgtgccgctgctggtggacgccgcgctctggggcgtcgtcacggccgtcgagtccgtcgcgctcgtctccatgatgtgctgcttcttcctctgctgcggctgcacgctctgaggcgcggggctccgacgagctccgcgctgccggcagtatgaacgattcccccgcgcgatttcttcgttttgccgagtgtgattgtggtgaattagctgcgtccgtcgggtatgaatgaattagctgtgttactgccatggtaatgat

SEQ ID NO: 26968 - protein, 97 aa, Panicum virgatum
  misc_feature: Ceres CLONE 1874211
  misc_feature: SWISSPROT Homolog: EC 6.3.4.5 Argininosuccinate synthase
  misc_feature: Functional homolog of the protein sequence given in SEQ ID NO 51233
  misc_feature: Useful for making plants with modulated nitrogen use efficiency
MGGSLVSMLRWPPDLGLPSLAALLPSPPAHLRLRVQEWWQWSSPEQLSAAAARRWPEMVRDVPLLVDAALWGVVTAVESVALVSMMCCFFLCCGCTL

SEQ ID NO: 26969 - DNA, 740 bp, Panicum virgatum
  misc_feature: Ceres CLONE 1874229
  misc_feature: Encodes the peptide sequence at SEQ ID NO. 26970
tgaatcacttccgttataactggccggtgaatcacacatctgtgagtccggataggaaacttctggcggtggttggagatgatcgggacgcacttcttgtggattcacgaaacgggaaggtaacctctaccctagtcggccatctggactactcattcgcaacggcatggcacccagatgggcgcaccttcgcaacagggaaccaggataaaacctgccgcgtctgggacatgcgcaacctgtcgacctcccttgcagtccttcggggcaacattggtgcgatccggtgcatccgctactcctccgatgggaggttcctggtgttctcggagcctgccgacttcgtgcacgtgtatagcgctgccgcggactacaagaagcggcaggagatcgacttctttggtgaggtgtctgggatcacgctcagccccgacgatgagtctctgttcgttggggtgtgcgaccgcgtctacgccagcttgatgcagtacaggatggcccatgctaaaggcacaatagcaagcaaaatttagatgccaggttattacaattcagctccattgcggcatgctcctgatctaatatctcacgatacgagatggtggtctttcggaaccatggccctgtgaaaaaattagttaggtaagtgcaaggttagttgttcagtaagtcttatttcataaatatttcttcagtaagaggctccattttaataattttagtcaagctactaaagctac

SEQ ID NO: 26970 - protein, 176 aa, Panicum virgatum
  misc_feature: Ceres CLONE 1874229
  misc_feature (38)..(76): Pfam Name: WD40 Pfam Description: WD domain, G-beta repeat
  misc_feature: SWISSPROT Homolog: EC 2.3.1.48 Histone acetyltransferase
NHFRYNWPVNHTSVSPDRKLLAVVGDDRDALLVDSRNGKVTSTLVGHLDYSFATAWHPDGRTFATGNQDKTCRVWDMRNLSTSLAVLRGNIGAIRCIRYSSDGRFLVFSEPADFVHVYSAAADYKKRQEIDFFGEVSGITLSPDDESLFVGVCDRVYASLMQYRMAHAKGTIASKI

SEQ ID NO: 26971 - DNA, 802 bp, Panicum virgatum
  misc_feature: Ceres CLONE 1874239
  misc_feature: Encodes the peptide sequence at SEQ ID NO. 26972
atccccacaatcccaggcgcccgaatccaccaatcaatctatccatctcaatggcctcctcctctgccgccggtaacggcaccggcggcatcctccccacgcacaccgccgcccccgcctggccttcaacttccaagcccccgcccaccaaggaccctcgccggcggcggcgctgcctctgcgtgtgcctcctcgtcaccctggccgtcctgctcgcgctcgccatcaccctgctcgtcctattcctcaccgtcctcaaggtccgggaccccaccacgcgcctcgtctccacgcgcctggcgggcgtcgccccgcgcctcaccttcccggccgtctccctccagctcaacgtcacgctgctgctcaccgtggccgtgcacaacccgaacccggcctccttcgcctacgacgccgggggccacaccgacctcacctaccgcggctcgcacgtcggcgacgcggccatcgacccgggccgcatccccagcaagggcgacggcgaggtcaagttggcgctcacggtgcaggcggaccggctcgcggccgacctggcgcagctggtggcggacgtggagagcgggtcggtggccatggaggccagcaccaggatccccggcagggtcaccatcctgggcatcttcaagcgccacgccgtcgcctactccgactgcagcttcgtcttcggcgtcgcggagatggcggtgcgcagccagcagtgccatgatcgcacaaagctctgatgattgatgaatctgaattgatgatccatcatccatccaaggaagcatctggttgccgtgcc

SEQ ID NO: 26972 - protein, 229 aa, Panicum virgatum
  misc_feature: Ceres CLONE 1874239
  misc_feature (65)..(207): Pfam Name: Hin1 Pfam Description: Harpin-induced protein 1 (Hin1)
MASSSAAGNGTGGILPTHTAAPAWPSTSKPPPTKDPRRRRRCLCVCLLVTLAVLLALAITLLVLFLTVLKVRDPTTRLVSTRLAGVAPRLTFPAVSLQLNVTLLLTVAVHNPNPASFAYDAGGHTDLTYRGSHVGDAAIDPGRIPSKGDGEVKLALTVQADRLAADLAQLVADVESGSVAMEASTRIPGRVTILGIFKRHAVAYSDCSFVFGVAEMAVRSQQCHDRTKL

SEQ ID NO: 26973 - DNA, 646 bp, Panicum virgatum
  misc_feature: Ceres CLONE 1874241
  misc_feature: Encodes the peptide sequence at SEQ ID NO. 26974
tatgcattcttcgctcccggcagcacagcctctccgagcctcccctccaccggcagctccggcccgagcggcggcggccaggtggccagcgagctgccggcctactggtcctcgtgcgcgccgatctaccggcatggccgccgccggccttcccccggggtaccgcttctacccgacggaggaggagctgatatgcttctacctgcgcaacaagctcgacagcctccgcgacgacatcgagcgcgtcatccccgtcgtcgacgtctactccgtcgacccgtggcagctcccagatattcacgagatgctgtgcggcggcgccggggcgggggagccgtggttctacttctgcccgcggaaggagcgggaggcgcggggcgggcggcccagccggacgacgccgtcggggtactggaaggccgcgggcacgcccggggtcgtctactcctccgccgaccgccgcgccatcggggtgaagaagaccatggtgttctaccgcggccgagcgccgtcgggggccaagacaaagtataagatgaacgagtacagggcgctccagcactacgacgccgcccccgacgccgccgccgccgacggggacgatgggtcgtcttctagcgcccgcgccgccgcacctcctccgcag

SEQ ID NO: 26974 - protein, 170 aa, Panicum virgatum
  misc_feature: Ceres CLONE 1874241
  misc_feature (6)..(141): Pfam Name: NAM Pfam Description: No apical meristem (NAM) protein
  misc_feature: The sequence is a functional homolog of SEQ ID NO 1170 in the 10/666,642 US patent application
  misc_feature: The sequence is a functional homolog of SEQ ID NO 1171 in the 10/666,642 US patent application
  misc_feature: The sequence is a functional homolog of SEQ ID NO 1400 in the 10/666,642 US patent application
  misc_feature: The sequence is a functional homolog of SEQ ID NO 320 in the 10/412,699 US patent application
  misc_feature: The sequence is a functional homolog of SEQ ID NO 752 in the 11/479,226 US patent application
  misc_feature: The sequence is a functional homolog of SEQ ID NO 432 in the 10/666,642 US patent application
  misc_feature: The sequence is a functional homolog of SEQ ID NO 745 in the 11/479,226 US patent application
MAAAGLPPGYRFYPTEEELICFYLRNKLDSLRDDIERVIPVVDVYSVDPWQLPDIHEMLCGGAGAGEPWFYFCPRKEREARGGRPSRTTPSGYWKAAGTPGVVYSSADRRAIGVKKTMVFYRGRAPSGAKTKYKMNEYRALQHYDAAPDAAAADGDDGSSSSARAAAPPP

SEQ ID NO: 26975 - DNA, 733 bp, Panicum virgatum
  misc_feature: Ceres CLONE 1874253
  misc_feature: Encodes the peptide sequence at SEQ ID NO. 26976
gcatcagttgagcttccgatccaatcgacggctccactgctctcgtcttctcgcttccgtctccggcgtcgagccgcctccggccacctgggcaaactctactcctttgcaaggaagagcgccacctggaaggaattcttcaggattagaggtgccgccggtgtccgcgcctctgctgggccgtcgtcaagcggagatcgaatcgggaaccgaactgacctcgtctttcgtcgaacttccatcaggagaagcaatgtcaggagtgatcacaaagttcgcggttacatccatggtgatgtggatggccccagtcgccatcatgtatgggttctactaccaggtgtttccaggttcggctgctgtttctgttttcattactgcttggtgtgttccatctattatgttcacatgaaatacgtaaattcttatttgttaattatatgttagaaattcttatttggtaatgatatgtcaaatctccttgttcaggtgtgagtcagatgtcatcctcagcgcagacactggccagtgggttccttgccgtcatatcagttaatctggtgatcggcttctacatatgcatggcgatgaaggagactccacaccaggagccacagcctgatcccaccttcttggcaaatgctaaagcgagtgtcaaccagccaacatcctctcgagtgaatgatgattccaagggaaaggggaagggtgagtaagctgtagcattttgact

SEQ ID NO: 26976 - protein, 71 aa, Panicum virgatum
  misc_feature: Ceres CLONE 1874253
  misc_feature: Functional homolog of the protein sequence given in SEQ ID NO 51234
  misc_feature: Useful for biocontainment applications
MSSSAQTLASGFLAVISVNLVIGFYICMAMKETPHQEPQPDPTFLANAKASVNQPTSSRVNDDSKGKGKGE

SEQ ID NO: 26977 - DNA, 868 bp, Panicum virgatum
  misc_feature: Ceres CLONE 1874255
  misc_feature: Encodes the peptide sequence at SEQ ID NO. 26978
gccgcattccccgcaggccgcagcatcagccatcaggcgcagccggcagccgtccgtcaccgccgcatcgtctcctcctcctcctcctcagctcctcgcgtcgtgtactcgtgtgcagatgggcgtggaaccggctcaaccaacccccgtctccgccgcggcaaccgccgcggagcaggctcaggatctcatcgacgccgctaggtacgatgacttgaaggacgtagttgccctgttctcagctggtgtttcactggactcaacagattcgcaaggccggacagctcttcatatggcttctgccaatggccatcttgctgtggtggaatacttgattcaaaatggagcgaatgttaatgccaccaacttacagaagaacacacccctccactgtgcatgcctcaatggacatatagaggtaatcaaggctttgatatctgctggcgctagtgtgagtgctctgaacagccatgagaaaaccccaatggatgaagcagtgaccaagggcaagatggatgtgatcgatgcaatcggtgcagcagtagctcaagccgagcttgatggtgttactgtctcctaaaaggacacgatgtatacctagagctatggatgacttgcaaccttgttcttatctctcagtgatcctgtccctgttattagtgatcctgatgggctagtatctgggcaatatggtaacttagcctttgccatgagttggaattatcatctgtgtcgtcaatcaatcgcctgttagtgtcagtgacatgagaccgtggaaggcgaatctgttgctataaaccagatgtgcagatgtcaaagatatggattttttgtcctataatgttgtgagagcgttgcttgttctgct

SEQ ID NO: 26978 - protein, 153 aa, Panicum virgatum
  misc_feature: Ceres CLONE 1874255
  misc_feature (52)..(84): Pfam Name: Ank Pfam Description: Ankyrin repeat
  misc_feature (85)..(117): Pfam Name: Ank Pfam Description: Ankyrin repeat
  misc_feature: SWISSPROT Homolog: EC 2.4.2.30 NAD(+) ADP-ribosyltransferase
MGVEPAQPTPVSAAATAAEQAQDLIDAARYDDLKDVVALFSAGVSLDSTDSQGRTALHMASANGHLAVVEYLIQNGANVNATNLQKNTPLHCACLNGHIEVIKALISAGASVSALNSHEKTPMDEAVTKGKMDVIDAIGAAVAQAELDGVTVS

SEQ ID NO: 26979 - DNA, 913 bp, Panicum virgatum
  misc_feature: Ceres CLONE 1874260
  misc_feature: Encodes the peptide sequence at SEQ ID NO. 26980
tctttctcccgttcacctgccggtgcccatcccccctctcgtggtctcctttcctggcgtcggcttagcgagcggccctgctcctccccaggtcttagtcgagcccttcgccggcgacaagcattcaccaggttggaattggggaggacgatacaccatggcggatttctccaaggagtcttgcccttctgtaaagaatattttgcttctggattctgaagggaagcgtgttgctgtgaagtatttctcagatgattggccaactaatgcatcaaagttggcctatgaaaaatctgtcttcactaaaactctgaagacaaatgcacgtgcagaagccgagataacattgtttgatggttatattgtcgtctacaagtttgtacatgaccttcactttttcgtcaccgctggagatgatgagaatgaactcatcttagcaagtgtactaaatggtttttcggattctgttggtcttctactcaggggtgatgttgagaagcgaactgcacttgagaacttggacttgatacttctctgcattgatgaaattatagatggcggcatcatcttggaaacagatgcgaataccattgccgggaaggtcgcaaccaatgctgttgacggttctgtccccttttctgagcagacgatatctcaggccctagctacagctagggagcaccttgcaagatctctgctgaaatgaacaacctacaaccggcattcttttactacttattatgactcatcctaaagtgctacagtgacataacctggtcgaatgtcccatctttggtaccgcgagctgtgtcatgcaatgcttgtaacttctttgaacaagtgattttgtacctattttgaagaaaacataaaataaaaagttgtgtaattgagtgcaagatacttttcatac

SEQ ID NO: 26980 - protein, 182 aa, Panicum virgatum
  misc_feature: Ceres CLONE 1874260
  misc_feature (11)..(154): Pfam Name: Clat_adaptor_s Pfam Description: Clathrin adaptor complex small chain
MADFSKESCPSVKNILLLDSEGKRVAVKYFSDDWPTNASKLAYEKSVFTKTLKTNARAEAEITLFDGYIVVYKFVHDLHFFVTAGDDENELILASVLNGFSDSVGLLLRGDVEKRTALENLDLILLCIDEIIDGGIILETDANTIAGKVATNAVDGSVPFSEQTISQALATAREHLARSLLK

SEQ ID NO: 26981 - DNA, 554 bp, Panicum virgatum
  misc_feature: Ceres CLONE 1874284
  misc_feature: Encodes the peptide sequence at SEQ ID NO. 26982
atccctcgccgggtccaagagcggctcccccgacgccgagtcctcggccgcgtccccgccggactcgcccaagtgctcggcgtccacggagggggaggacgagtcggtctccgccggctccacgccttccccgacgcaggtgccgcccgtccctgagatggcgaagctggacttcacggaggcgccgtgggacgagacggaggccttccacctgcgcaagtacccgtcctgggagatcgactgggactccatcctctcgtgaagaatcaactactactactatagtagtagtagtcagtcagctctgtgtaattttcatttgggttttgcagctgcggtggctcgatggcattttagacatcggccatggcggctgcaagtagcaatgagtaactagcagctagtaagtcgcccagtgttgtgatgatgtagcagtcagtacgtgttaatctcctggttgagctgccggttgttttttctcacggcacggccagtcgagaaggttaagtgtaatcccttgttatctgttgcagcttaatccatgtagcttatgc

SEQ ID NO: 26982 - protein, 86 aa, Panicum virgatum
  misc_feature: Ceres CLONE 1874284
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
SLAGSKSGSPDAESSAASPPDSPKCSASTEGEDESVSAGSTPSPTQVPPVPEMAKLDFTEAPWDETEAFHLRKYPSWEIDWDSILS

SEQ ID NO: 26983 - DNA, 663 bp, Panicum virgatum
  misc_feature: Ceres CLONE 1874292
  misc_feature: Encodes the peptide sequence at SEQ ID NO. 26984
cggaaagccaatcaatcatacaagttgaagtagaagtaaccaaccaaggcaagaggcagctagcactctccactgtgtgagactccgtgaggccaccggcttgcgctcctgctctgcaccctccgcaccagctcagcaatcatgcctcgcccggccctcctcctcctcctcctggtcgccgcggcgctcctggccatggcggccgcgtcgccggcgaagagcgaggccgcggccagcgacttcatccgcaagtcgtgccgcgacacgcagtacccgtcggtgtgcgtgcagagcctggcgtcgtacggcgggtccccgccgccgcggagcccgcgggagctggcgcgcgcggcgctgtcggtgagcgcggaccgcgcgcgcgcggcgtcggcgtacgtggggcggctgtgcggcggcggcggcgcggcggcgaggaagggcgcgcggaagggcacggcgggcgcggtgcgcgactgcctggagaacctggcggacagcgtggggcacctccgcgacgcggcgcaggagatgggcggcgccgggatgggggggcgcgcggggtcggcggcgttcaagtggcacctgagcaacgtgcggacctggtgcagcgcggcgctcaccgacgacaacacctgcctggaccggctcgccggccgcggcgtg

SEQ ID NO: 26984 - protein, 155 aa, Panicum virgatum
  misc_feature: Ceres CLONE 1874292
  misc_feature (11)..(155): Pfam Name: PMEI Pfam Description: Plant invertase/pectin methylesterase inhibitor
  misc_feature: SWISSPROT Homolog: EC 3.1.1.11 Pectinesterase
MAAASPAKSEAAASDFIRKSCRDTQYPSVCVQSLASYGGSPPPRSPRELARAALSVSADRARAASAYVGRLCGGGGAAARKGARKGTAGAVRDCLENLADSVGHLRDAAQEMGGAGMGGRAGSAAFKWHLSNVRTWCSAALTDDNTCLDRLAGRG

SEQ ID NO: 26985 - DNA, 684 bp, Panicum virgatum
  misc_feature: Ceres CLONE 1874310
  misc_feature: Encodes the peptide sequence at SEQ ID NO. 26986
ttggcttcgcacttccgctccgccccgcctcgccgtctcgctcgctgccgccgcctcgcgccgccgctcgcctctccgcccgccgcgaggatgccgttcaagaggttcgtggagatcgggcgcgtggccctggtgaactacggcacggactatggccgcctcgtcgtcatcgtcgacgtggtcgaccagaacagggcacttgtggatgcccctgacatggtcaggtgccagatgaacttcaagcggctctcacttaccgacatcaagattgacatcaaacgtgtacccaagaagacaaccctgatcaaggcgatggaggaagctgatgtgaagaccaagtgggagaacagctcatggggcaagaagctgattgtccaaaagaggagagcagcgctcaatgactttgataggttcaaggtcatgttggcgaagatcaagaggggtggggcggtcaggcaagagctggccaagctcaagaaggcgtccacagcttagagtatcttttggtgaatggcatgttgagtttttggtaccttgttggatcagtcattcgtttgagtgttgttaaagccagaattagcactactgtttcctatgaactcttttcaaaccttaatcaagaatggctgtgctctggagatttttgtcatggatgttatgaaatatctaaggtagtttgcgccc

SEQ ID NO: 26986 - protein, 134 aa, Panicum virgatum
  misc_feature: Ceres CLONE 1874310
  misc_feature (44)..(120): Pfam Name: Ribosomal_L14e Pfam Description: Ribosomal protein L14
MPFKRFVEIGRVALVNYGTDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAVRQELAKLKKASTA

SEQ ID NO: 26987 - DNA, 722 bp, Panicum virgatum
  misc_feature: Ceres CLONE 1874329
  misc_feature: Encodes the peptide sequence at SEQ ID NO. 26988
aagtagcatcacgccaagcaccatcagacagtagctagacagtaatgggtttcagcgaggctcaggaagagctcgttctgcgctcatggaaagccatgaagaaggacgccgaatccattgctctcaagttcttcttcaggatctttgagatcgcgccgggcgccaagcagatgttccccttcctgcgcgacgccggcgacgcgcccctggagaaccaccccaagctcaagacgcacgccgtcgccgtcttcgtcatggcttgcgagtccgcgacgcagctgcggagcaccggcgacgtgaaggtgagggaggcggcgctgaagcggctgggcgcgacgcacgtcagggccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacgccgccgccgccgcctgagttcatcgtgaagaccttaacactcagacacacacatccctgctgctgcctgctgctgctgcgaagaacgcgcgttgcttgggagagcttggagctgccactgctgctgctactactctacgaagctgtcgctactgctactgtgtcctgttttgtcaagtgccagccacgtcattgaggaataaaacttaatttatacac

SEQ ID NO: 26988 - protein, 158 aa, Panicum virgatum
  misc_feature: Ceres CLONE 1874329
  misc_feature (7)..(117): Pfam Name: Globin Pfam Description: Globin
  misc_feature: SWISSPROT Homolog: EC 1.14.12.17 Nitric oxide dioxygenase
  misc_feature: Functional homolog of the protein sequence given in SEQ ID NO 50202
  misc_feature: Useful for making plants with modulated cold sensitivity
  misc_feature: Useful for making plants with modulated salt sensitivity
MGFSEAQEELVLRSWKAMKKDAESIALKFFFRIFEIAPGAKQMFPFLRDAGDAPLENHPKLKTHAVAVFVMACESATQLRSTGDVKVREAALKRLGATHVRAGVADAHFEVVKTALLDTIRDAVPDMWTPEMKAAWEEAYDQLAAAIKEEMKNAAAAA

SEQ ID NO: 26989 - DNA, 685 bp, Panicum virgatum
  misc_feature: Ceres CLONE 1874333
  misc_feature: Encodes the peptide sequence at SEQ ID NO. 26990
acgccgcttcctctcacggtctcaccagtcaccaacgcgcctccattcccgttcctctcttgcctagggttctagccctctcgtcgccgccctccggcgccgaccatgacggccgagaccacgacgccggaggagcagctccgcgccttgctcgaggagcagaagatccacgagggagatgacccgattgttgaggatgacgatgatgaggaagatgacgatgatgaggatgacaaggatgacgatgatgctgagggagttgatgctagtgggagatctaagcagagccgcagtgagaaaaagagcaggaaggccatgctgaagcttggcatgaaggcgatcactggtgtaagccgtgtaactgtcaagaagagcaagaatatgctctttgtcatctccaaaccagatgtcttcaagagccctgcatcagacacctacgtgatctttggggaggccaagattgaggacctgagcgcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgatggggata

SEQ ID NO: 26990 - protein, 193 aa, Panicum virgatum
  misc_feature: Ceres CLONE 1874333
  misc_feature (62)..(121): Pfam Name: NAC Pfam Description: NAC domain
MTAETTTPEEQLRALLEEQKIHEGDDPIVEDDDDEEDDDDEDDKDDDDAEGVDASGRSKQSRSEKKSRKAMLKLGMKAITGVSRVTVKKSKNMLFVISKPDVFKSPASDTYVIFGEAKIEDLSAQLQTQAAEQFKAPDMSSVLSKPEVSTAAQDDDEAVDETGVEEKDIELVMTQATVSRARAVKALKAADGD

SEQ ID NO: 26991 - DNA, 753 bp, Panicum virgatum
  misc_feature: Ceres CLONE 1874335
  misc_feature: Encodes the peptide sequence at SEQ ID NO. 26992
acacgcctttcgccgtctccccgcaaaccctacccaggctaccgggcagccgccatccatggcctccgcccgcgccgccctcctcctgcggcgccagtgcctcggcgccgccgcggccaacccgtacctcttctccgggcatggcctccgctaccgcaagctcgaggtcatcctcaccacgacgattgataagctggggaaagcaggggaggtggtgaaggtggctcctggccacttccgcaaccaccttatgcccaagatgctcgctgtcccaaacatggacaaattcgccatactcatccgagagcaacgcaagctctatcaacgtgaagaggaagtggtgaaagaagtcacaaaggaagatgatgctgctcggctcctggaagagagactgaagcagtaccaaacagcagcaaagcggctagataatgcacttttggtgttgaggcggtttatctcgactggaaacgaactgcgcactcctataacaaaagatgaaattgtctccgaggtggcaaggcaactcaacatcaacatccacccggacaatctgcatctgccgtcacctttgacatcccttggtgaatttgaactgccccttcgcttaccgcaggatataccacgcccagaaggcaagctacaatggactctgaatgtcaagatcaggaggaaatagcacagtaattggggaaattaattcaccacccgatccattgtagctttcagatctagggacctatggaataggttttc

SEQ ID NO: 26992 - protein, 205 aa, Panicum virgatum
  misc_feature: Ceres CLONE 1874335
  misc_feature (35)..(83): Pfam Name: Ribosomal_L9_N Pfam Description: Ribosomal protein L9, N-terminal domain
MASARAALLLRRQCLGAAAANPYLFSGHGLRYRKLEVILTTTIDKLGKAGEVVKVAPGHFRNHLMPKMLAVPNMDKFAILIREQRKLYQREEEVVKEVTKEDDAARLLEERLKQYQTAAKRLDNALLVLRRFISTGNELRTPITKDEIVSEVARQLNINIHPDNLHLPSPLTSLGEFELPLRLPQDIPRPEGKLQWTLNVKIRRK

SEQ ID NO: 26993 - DNA, 462 bp, Panicum virgatum
  misc_feature: Ceres CLONE 1874358
  misc_feature: Encodes the peptide sequence at SEQ ID NO. 26994
cccttcccctgatctggtgaggactcgcgatctcgcgctggagcggagatggggctcacgtgcacgaaactgttccgccgcctcctccccaagaaggagatgaggatcttcgtgggtggtctcgacgcggctggtaagaccaccgtgctgtacgaggtccagctcggcaagatcgtcaccaccatccccaccataggatttaatgtggaaactgttgagtacaacaacattatcttcactgtttggtatgttggcggacaggaccagatccgtcccctgtggaggcactacttccagaacaccctgggcctcatttttgttgtggacagcaacgacagagagcgtgttgttgaggccagagatgagctccatcgtatgctgaatgaagacaagctccgtgatgctgcgcttctggagttagcatacaaacaagatcttcctaatgccatgaacgctgctgaa

SEQ ID NO: 26994 - protein, 137 aa, Panicum virgatum
  misc_feature: Ceres CLONE 1874358
  misc_feature (5)..(137): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTCTKLFRRLLPKKEMRIFVGGLDAAGKTTVLYEVQLGKIVTTIPTIGFNVETVEYNNIIFTVWYVGGQDQIRPLWRHYFQNTLGLIFVVDSNDRERVVEARDELHRMLNEDKLRDAALLELAYKQDLPNAMNAA

SEQ ID NO: 26995 - DNA, 563 bp, Panicum virgatum
  misc_feature: Ceres CLONE 1874380
  misc_feature: Encodes the peptide sequence at SEQ ID NO. 26996
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggtgggtaccggtgccgtgagggcggacgcccctaccgctctcgccagctaagaacactcttcatgcccagtccatgcacgcacttgcggttcatgtaacatcagcttgggggtgtctgtctgtaatctagcctgcagcttcgatgtccgatataatgcttggttcatgtaacaatgcaa

SEQ ID NO: 26996 - protein, 128 aa, Panicum virgatum
  misc_feature: Ceres CLONE 1874380
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYRCREGGRPYRSRQLRTLFMPSPCTHLRFM

SEQ ID NO: 26997 - DNA, 418 bp, Panicum virgatum
  misc_feature: Ceres CLONE 1874416
  misc_feature: Encodes the peptide sequence at SEQ ID NO. 26998
accatccggggttggacccttgtctcgcgcacttcaccgcgggggaaagggagagggagggggtcactttcttcacccaccagggggccaggagggagggagtgaggaggcatggggaggccgccgtgctgcgagaaggcccgggtgaagaaggggccgtggacgccggaggaggacctcgcgctcgtctcctacctgcaggagcacggccccgggaactggcgcgccgtgcccaccaacgccgggctgatgcgctgcagcaagagctgtcggctccgctggacccactaccaccgcccgggcctcaagcacggccacttcaacgtccaggaggaaaagctcctcatccacctccaggcgctgctcgggctccggcgggcgacgattgcctcgtacctcccggaccggaaggacgccg

SEQ ID NO: 26998 - protein, 102 aa, Panicum virgatum
  misc_feature: Ceres CLONE 1874416
  misc_feature (14)..(61): Pfam Name: Myb_DNA-binding Pfam Description: Myb-like DNA-binding domain
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 796 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 743 in the 10/666,642 US patent application
  misc_feature: The sequence is a functional homolog of SEQ ID NO 790 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 569 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 824 in the 10/412,699 US patent application
  misc_feature: The sequence is a functional homolog of SEQ ID NO 58 in the 10/666,642 US patent application
  misc_feature: Functional homolog of the protein sequence given in SEQ ID NO 50784
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1002 in the 11/435,388 US patent application
  misc_feature: The sequence is a functional homolog of SEQ ID NO 822 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: Functional homolog of the protein sequence given in SEQ ID NO 50238
  misc_feature: Useful for making plants with altered terpenoid content
  misc_feature: Useful for making plants with modulated biomass
  misc_feature: The sequence is a functional homolog of SEQ ID NO 1073 in the 10/374,780 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1010 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 271 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1917 in the 10/374,780 US patent application
  misc_feature: Functional homolog of the protein sequence given in SEQ ID NO 50235
  misc_feature: Useful for biocontainment applications
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 442 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1681 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1863 in the 10/374,780 US patent application
  misc_feature: The sequence is a functional homolog of SEQ ID NO 186 in the 10/412,699 US patent application
  misc_feature: The sequence is a functional homolog of SEQ ID NO 836 in the 10/412,699 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1692 in the 11/479,226 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1572 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 126 in the 10/412,699 US patent application
MGRPPCCEKARVKKGPWTPEEDLALVSYLQEHGPGNWRAVPTNAGLMRCSKSCRLRWTHYHRPGLKHGHFNVQEEKLLIHLQALLGLRRATIASYLPDRKDA

SEQ ID NO: 26999 - DNA, 562 bp, Panicum virgatum
  misc_feature: Ceres CLONE 1874420
  misc_feature: Encodes the peptide sequence at SEQ ID NO. 27000
atccaattcacaagctcccccaccagaaaacaacaatccccaatttccttcgtgctcgcggcggcggcgatgtcggggcgcggcaagggcggcaaggggctgggcaagggcggcgccaagcgccaccgcaaggtgctccgcgacaacatccaggggatcaccaagccggcgatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccagggacgcaccctctacggcttcggcggctaggccctggctccggtgcgcccccgtctgaggcgcggttcctggattggtgccgtgtgtggttagggatgagggttcgttgtcaagggattggctgtgttggctttctgaatgtagtctgtctttgtgccgtgaagaaatgcggactgcctatattgtacgaggattgaacatgcctgcagcg

SEQ ID NO: 27000 - protein, 103 aa, Panicum virgatum; identical to SEQ ID NO: 12044
  misc_feature: Ceres CLONE 1874420
  misc_feature (25)..(94): Pfam Name: Histone Pfam Description: Core histone H2A/H2B/H3/H4

SEQ ID NO: 27001 - DNA, 622 bp, Panicum virgatum
  misc_feature: Ceres CLONE 1874422
  misc_feature: Encodes the peptide sequence at SEQ ID NO. 27002
aagttctcctcggcggcggcggcggcggcaagcgaagaaggcgtcggcgaaatgggcaagggtacggggagcttcggcaagcgccggaacaagacgcacacgctgtgcgtgcgctgcggccgccgtagctttcacctgcagaagagcacctgctcctcatgcggctaccccgcggcccgcatccgcaagtacaactggagcataaaggctattaggaggaagactactggcacagggaggatgaggtaccttcgccatgtgccccggaggttcaagagcaacttcagagagggaactgaggccgtgtcaaggaagaagggagctgcttctagcgccaactaagcatgttcaccacctatgctaggcaggaccgtgggtcatgaaactatgtttttgttgctttatttctatgttcctaaattgagaggcaaacgatgcttgtctgtgttatttcatatcctggatgttaaacgtactgttttgaatgtcgaatcaagccaggttgttagttgtcaccctatttacagaattaactctatatctgcctgtgatgatgtgttacgtttactgctatgatttctgtgactcaagacggtgaatactgaatggtggtgcttgattc

SEQ ID NO: 27002 - protein, 96 aa, Panicum virgatum
  misc_feature: Ceres CLONE 1874422
  misc_feature (2)..(55): Pfam Name: Ribosomal_L37e Pfam Description: Ribosomal protein L37e
MGKGTGSFGKRRNKTHTLCVRCGRRSFHLQKSTCSSCGYPAARIRKYNWSIKAIRRKTTGTGRMRYLRHVPRRFKSNFREGTEAVSRKKGAASSAN

SEQ ID NO: 27003 - DNA, 760 bp, Panicum virgatum
  misc_feature: Ceres CLONE 1874423
  misc_feature: Encodes the peptide sequence at SEQ ID NO. 27004
atccctctccgcctccgaccgagagccctccctccctccatcttcctccccacctggcgattgagaaaggtgtccccggctagtaggtagaatgctgctgagctcccccttggtgtccccggcgctgcgggtccctccgcggccggggaatggctgtcgcctccggatcgaggcggcgaggcagctgacggggcgggtggtgacgaccaaggcggacaagacggtgggcgtggaggtggtgcgcctggcaccgcatcccaagtacaagcgccgagagcgtatcaagaagaagtaccaggcgcacgaccccgacaaccagttcaaggtcggcgacgtcgtcgagctccgaagctcccgccccatctccaagaccaagcacttcatcgccgttccgctcccgccccgcgacacccgccgcaagtcgcagctcctcccgccgctccagtcgcagcaggccgccgaagacgacgaccagcagccgccgccctccacggcacagtgaccgacccgccgacccgaccgccattattcctattcccttgcctcggcggaaccaaccactcttcaagttgtgtaatttggccaaaatttcccctacctactttacttattattattgcgtctgcgtatggtttgccgtttcctttaatctcgcaaccaccaccatcatcgtcatcatatagagcttgtgtttgattggtttttattcttcttacggcagcgtgtacgaaaacaaacttgttttatttatttatttttg

SEQ ID NO: 27004 - protein, 136 aa, Panicum virgatum
  misc_feature: Ceres CLONE 1874423
  misc_feature (34)..(102): Pfam Name: Ribosomal_S17 Pfam Description: Ribosomal protein S17
MLLSSPLVSPALRVPPRPGNGCRLRIEAARQLTGRVVTTKADKTVGVEVVRLAPHPKYKRRERIKKKYQAHDPDNQFKVGDVVELRSSRPISKTKHFIAVPLPPRDTRRKSQLLPPLQSQQAAEDDDQQPPPSTAQ

SEQ ID NO: 27005 - DNA, 650 bp, Panicum virgatum
  misc_feature: Ceres CLONE 1874449
  misc_feature: Encodes the peptide sequence at SEQ ID NO. 27006
agttgttttccggcctcttcctcgcccggcccctccccccccacccccccgggttcaaaccgggcaaaggaaccaaaccaccccgaaaaaatggcccgtaccaaccaaactgctcccaagtccacggaaggaaaggctcccagaaaccaccttgcacctaaggctgcccttaatccacccccaaccccggaagaagtgaaaaacccccttccctcccgccctggccctgttgccctccgtgaaatccccaagtaccaaaaaacccctgacttgttgatcaggaacctccccttccaaaggcttgtcaggaaaattgcccagaatttcaaaattgttctgcttttccaaacccttgctttgcttgccctccagaaggctgctaaggcttaccttgttggtctgtttaagaaccccaccctgtgccccttccttgctaaccttgtaaccttcttgcctaaggacttccacttggccagaaggatccggggcaaaagggtttattcttctcattcataacaatcaaagtcaattgtcaaattattgggttaaggtgttgccctgtccagaacatctaattagggcttgttttgtgaatcaaattaatttcctctcctgcaccactatatgttcctcctacctttgttgtggtg

SEQ ID NO: 27006 - protein, 141 aa, Panicum virgatum
  misc_feature: Ceres CLONE 1874449
  misc_feature (58)..(132): Pfam Name: Histone Pfam Description: Core histone H2A/H2B/H3/H4
MARTNQTAPKSTEGKAPRNHLAPKAALNPPPTPEEVKNPLPSRPGPVALREIPKYQKTPDLLIRNLPFQRLVRKIAQNFKIVLLFQTLALLALQKAAKAYLVGLFKNPTLCPFLANLVTFLPKDFHLARRIRGKRVYSSHS

SEQ ID NO: 27007 - DNA, 687 bp, Panicum virgatum
  misc_feature: Ceres CLONE 1874488
  misc_feature: Encodes the peptide sequence at SEQ ID NO. 27008
atccagcggacacgacacgaacagcgagcgcctcctctcccgctctccctccgcgccctcggcttccctccaatgccgccacccatggcgctgcccctccccacctccgcctccgcctccgcctccaccacgcacccgcactttcgcccctgccctcccgcaccgctgcgcctcacctccgcccgcgcccgcacggtctccgccggctacgcggcgtccttctacggcggctcggcgtccgcgaccggcggcgccgaggacgaggagggctccgcctcggggttcggctccgggctggggctcggcggcggcgggctcgggatgtcggccgcggaggcggcgctggcgctggaggagcgggagatgccgccctgcccgccgggcctgcgccagtacgagaccatggtcgtgctgcggcccgacatgtccgaggaggagcgcctcgcgctcatccagcgctacgaggagctgctcgtcgccggcggcgccatgtacgtggaggtcttcaaccggggcgtcatcccactggcatacagcatcaggaagaggaacagcaggaccgggctgccgtccacctactacgacggcatatacctcctcgtcacctacttcaccaagcccgactccctgtccaccctgcagcggaggctcaacgccgacgatgacgtcatccggtcgaccagcttc

SEQ ID NO: 27008 - protein, 204 aa, Panicum virgatum
  misc_feature: Ceres CLONE 1874488
  misc_feature (106)..(203): Pfam Name: Ribosomal_S6 Pfam Description: Ribosomal protein S6
MPPPMALPLPTSASASASTTHPHFRPCPPAPLRLTSARARTVSAGYAASFYGGSASATGGAEDEEGSASGFGSGLGLGGGGLGMSAAEAALALEEREMPPCPPGLRQYETMVVLRPDMSEEERLALIQRYEELLVAGGAMYVEVFNRGVIPLAYSIRKRNSRTGLPSTYYDGIYLLVTYFTKPDSLSTLQRRLNADDDVIRSTS

SEQ ID NO: 27009 - DNA, 745 bp, Panicum virgatum
  misc_feature: Ceres CLONE 1874500
  misc_feature: Encodes the peptide sequence at SEQ ID NO. 27010
cattgatgaagatggttggttacacactggagacataggtttgtggctgcctggagggcgcttaaaaattatagataggaaaaagaacattttcaagttagcgcaaggggagtacatagctccggagaagatcgagaatgtctatgctaagtgcaagttcattgctcaatgctttgtatatggtgatagtttcaactcttccctagttgccattgtagctgttgaacctgaggtattgaaggcttgggctgcatcagaaggaattcagtacgaggacttaagacagctctgcgctgatcctagagcaagagccgctgtcctggctgacatggattccattggaaaggaagctcagctaagaggttttgaatttgctaaagctgttacccttgttgctgaaccattcacattggaaaatggtctcctcaccccaacgttcaaggcaagcccactggcttctgtttcaggaggtttcaatactaaaattctgacgcactccatctcaatgcttttttaggtcaaaaggccgcaagccaaggcatacttcgcaaaagagatctcagatatgtacgcgcaattgcgagaggccgagtcagctaagccaaagctatagtcgctagtgtaattatccgcaaatagccattgttagataattaggcaaattcatgtttaatttattctataaaaatgatgcaagaaagattaacatgatatcatatatgtgcttgtcccaaatatacatcat

SEQ ID NO: 27010 - protein, 171 aa, Panicum virgatum
  misc_feature: Ceres CLONE 1874500
  misc_feature: SWISSPROT Homolog: EC 6.2.1.3 Long-chain-fatty-acid--CoA ligase
IDEDGWLHTGDIGLWLPGGRLKIIDRKKNIFKLAQGEYIAPEKIENVYAKCKFIAQCFVYGDSFNSSLVAIVAVEPEVLKAWAASEGIQYEDLRQLCADPRARAAVLADMDSIGKEAQLRGFEFAKAVTLVAEPFTLENGLLTPTFKASPLASVSGGFNTKILTHSISMLF

SEQ ID NO: 27011 - DNA, 697 bp, Panicum virgatum
  misc_feature: Ceres CLONE 1874516
  misc_feature: Encodes the peptide sequence at SEQ ID NO. 27012
gctacctgcatctatcgaccttgcattggcgagctcacagttcaatcaggtccggttcagcttcaggccgagctcgtcctcaccgaggagatggcgctctctcaccgcatggccgcgcccgtcgtcttcctgctgctcctcgtagccacagagatggggccggcgacggtggcggaggcgaggcactgcctgtcgcagagccaccacttcaagggcctgtgcgtgagcagcagcaactgcgccaacgtctgcaagaccgagaacttccccggcggcgagtgcaagacggagggcgccacccgcaagtgcttctgcaagaggatctgctagccgccgccgccgccgccccggcactgcacggtcctccccgccgttgttcgtgtgttcttccttctgttcgtcggttcctcatgcgcgcacgctgcgccgtgaacgctgtagcgggctgtgttcctctcgatcgtcttgttctcttttcctggaataaatttgaactcggtggcggtgctggtgatgccgaggtgtgcgatgcctgtgcgtgtggatcatctcgctgttgttctgcatccgtatgcactccattattagtgtactcgtagtcgtaggcaaggtgatgtaaggtcctcctttcaacattgatgtaataatgcaatgcagtttcgtgctagacagcttaattaagtgccaggttttcttc

SEQ ID NO: 27012 - protein, 79 aa, Panicum virgatum
  misc_feature: Ceres CLONE 1874516
  misc_feature (31)..(79): Pfam Name: Gamma-thionin Pfam Description: Gamma-thionin family
MALSHRMAAPVVFLLLLVATEMGPATVAEARHCLSQSHHFKGLCVSSSNCANVCKTENFPGGECKTEGATRKCFCKRIC

SEQ ID NO: 27013 - DNA, 475 bp, Panicum virgatum
  misc_feature: Ceres CLONE 1874518
  misc_feature: Encodes the peptide sequence at SEQ ID NO. 27014
atctgtgtgctcggcgcttgctgcccgattctccgttcggatccaaggggactgcccggcggccgtctaatccaccgcgctgtgtgaaatcgctgctggagatgaagacgccgggactggaagtatcgtgggtacaggtcttcaagtgcatcaccatcggcgacgcaggcgtggggaagtcgtgcctgctgctgcagttcacggagcagaggttccgatctgagctcgatcccaccctcggttgcgattgtagcacgcgtatcgtcgatatctatggcaagcccaccaggctccagatttgggacacggctggtcaggaattatacagctctattaataaatcatattacagaggagctgaagtggcgatcttggtttatgacatcaccaggagggcgacttttgatcatgttgcgaggtggctgaaagaggcaatggaggttgcatcagccaatctgaccacaattctagttgg

SEQ ID NO: 27014 - protein, 124 aa, Panicum virgatum
  misc_feature: Ceres CLONE 1874518
  misc_feature (15)..(124): Pfam Name: Ras Pfam Description: Ras family
  misc_feature: SWISSPROT Homolog: EC 2.7.11.1 Non-specific serine/threonine protein kinase
MKTPGLEVSWVQVFKCITIGDAGVGKSCLLLQFTEQRFRSELDPTLGCDCSTRIVDIYGKPTRLQIWDTAGQELYSSINKSYYRGAEVAILVYDITRRATFDHVARWLKEAMEVASANLTTILV

SEQ ID NO: 27015 - DNA, 734 bp, Panicum virgatum
  misc_feature: Ceres CLONE 1874520
  misc_feature: Encodes the peptide sequence at SEQ ID NO. 27016
aaaaaccccaatccactcaccgagaagggagagagaaaaaaaatcgatggcggcgggcggcggcgacaacggcggcgccgcgggcgacggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtgctccgcgaggccaggaggatcatccaggagtccgatattatgaaggaggacgacagcaactggccggagcccgaccgcatcggccggcaggagctcgagatcgtcatgggcaacgagcacatctccttcaccacctccaagatcggctccctcgtcgatgtccagtccagcaaggacccggagggcctccggatcttctactacctcgtccaggatctgaagtgttttgtgttttcgctcatcaacctccacttcaagatcaaaccaattcagtcctgagctccattccatgctgtttcttaactgtgttacgaaactgcgagtgtttaatttgtgacgatgtacccatgtaccatgtaagttcctagttagtttgtgacgatgcgctcgggttgtggagcactgggtggaagtggagcatagagtttgcctgggattgctatttgggttgtgcaaactgcgagtgatgatatttatgtttctt

SEQ ID NO: 27016 - protein, 160 aa, Panicum virgatum
  misc_feature: Ceres CLONE 1874520
  misc_feature (16)..(158): Pfam Name: Mago_nashi Pfam Description: Mago nashi protein
MAAGGGDNGGAAGDGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 27017 - DNA, 528 bp, Panicum virgatum
  misc_feature: Ceres CLONE 1874522
  misc_feature: Encodes the peptide sequence at SEQ ID NO. 27018
gagttccacaacccataaaccacacactcccactctccgtccgtctccccacgaccccaccaaggcaaacagactcccaggctcccggcctcccagcaagcaagctagatcgatggcggactggggccctgtggtggtgggcgttgtgctgttcgtgctgctgtcgccgggcctgctgtgcgagctcccgggcacccaccgccacgtcgacttcggcggcttccacaccaacggcaaggccatcttcgtccacaccctcatcttcttcgccgccttcaccatcctcacgctcgcgctccacgtccacatctacgccggctagtagtctgctccaggcctgcctgcctcgtcgatctggacgcgggatccagatcgggacaaggcacgagtgaagtgcgtgtatgctactgctatctatatgcaagacatcgtcgtctgtaattcgattctgtaggcggacccttccaccttgctgcgtgcttgcccttcaatccatccaatcgaggagctattcaaacaaatctagcc

SEQ ID NO: 27018 - protein, 69 aa, Panicum virgatum
  misc_feature: Ceres CLONE 1874522
  misc_feature: Functional homolog of the protein sequence given in SEQ ID NO 51235
  misc_feature: Useful for making plants with altered cell wall content and/or composition
MADWGPVVVGVVLFVLLSPGLLCELPGTHRHVDFGGFHTNGKAIFVHTLIFFAAFTILTLALHVHIYAG

SEQ ID NO: 27019 - DNA, 739 bp, Panicum virgatum
  misc_feature: Ceres CLONE 1874553
  misc_feature: Encodes the peptide sequence at SEQ ID NO. 27020
aagtcagccggatcgctgcgtcgctccgcctcggccttccaccctcgcgcggcgccttcctcgcttgggagatgtcggactccgaggagcaccatttcgagtcgaaggccgacgccggagcctccaagacttacccgcagcaggccggcaccatccgcaagaacggatacatcgtcatcaagggccgcccgtgcaaggttgttgaggtctccacatcaaagacagggaagcacggtcatgcgaaatgccacttcgtggccattgacattttcaatggaaagaagcttgaggatattgtgccatcttcccataactgtgatgtgccccatgtcaaccgtactgactatcagctgattgacatatctgaagatggatttgtaagccttctgactgaaaatggaggcaccaaggatgatctgaggctccctactgatgaaacaatgctttcccagattaaagctggattcgatgatgggaaggacctgattgttagtgtgatgtctgccatgggtgaggagcagatctgcggtctgaaggatatcggcaagaactagagctgcattgccactgttggttgtttgtccggtcgcctatctgggaggtggtgtgttgatgatataagcatgtttggttacgagtaacatgcttgtggactgccgttttgtcttgtcgtttatgcagagtgatttggatgtacctttgctatctgtaatgttcttttgacccagtagcttggcta

SEQ ID NO: 27020 - protein, 160 aa, Panicum virgatum
  misc_feature: Ceres CLONE 1874553
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGYIVIKGRPCKVVEVSTSKTGKHGHAKCHFVAIDIFNGKKLEDIVPSSHNCDVPHVNRTDYQLIDISEDGFVSLLTENGGTKDDLRLPTDETMLSQIKAGFDDGKDLIVSVMSAMGEEQICGLKDIGKN

SEQ ID NO: 27021 - DNA, 622 bp, Panicum virgatum
  misc_feature: Ceres CLONE 1874566
  misc_feature: Encodes the peptide sequence at SEQ ID NO. 27022
cctcccgtctcagcctcctccgttgcagcgccgccgccgcctccatctagggcgcattccccactcctcgtcgccgccgccgagcttgagcgagccctgcaagatggtgctccagaacgacatcgacctgctcaaccccccggcggagctcgagaagctcaagcacaagaagaagcgcctcgtccagtcccccaactctttcttcatggacgtcaagtgccagggatgcttcagcataaccactgttttcagccactcccagactgttgtggtgtgcccgggctgccaaactgtcctctgccagcccactggaggaaaggctaggctcacggagggctgctccttccgccggaagggagactagaatgtagtctggaagatgatgtttgttctgagccaagtttttcacttgagtatgtagccgtcaaattttgtgctatgtgaaatgttagggccctgaactgctgcttactataaggctttcaatatctattcctatgttatgtactggatactactactcaatgttctgtttggcacctgctttatctaattagctggggttgttttggattatgatgaaccaagtggtgaaattgttgaatactctcggttggcttgc

SEQ ID NO: 27022 - protein, 86 aa, Panicum virgatum; identical to SEQ ID NO: 9875
  misc_feature: Ceres CLONE 1874566
  misc_feature (30)..(84): Pfam Name: Ribosomal_S27e Pfam Description: Ribosomal protein S27

SEQ ID NO: 27023 - DNA, 742 bp, Panicum virgatum
  misc_feature: Ceres CLONE 1874570
  misc_feature: Encodes the peptide sequence at SEQ ID NO. 27024
actccctcccccgcctccactactcccatcccaggcgctgcccaggtaagtcggcggcgagcggcggcggcggcggcgatgacgacccgcttcaagaagaaccgcaagaagcgcggtcacgtgtccgccgggcacggccgtatcgggaagcacaggaagcaccccggtggccgcggtaacgccggtggcatgcaccaccaccgaatcctcttcgacaagtaccatccggggtacttcggcaaagtgggtatgcgctacttccacaagctccgcaacaagttctactgcccggctgtcaacgtcgagcgcctctggtcgatggtgcccgccgagaaggaggcggaggccggcgccgataaggccccgcagatcgacgtcacccagttcggctacttcaaggtgctcgggaaggggaagctgccgtccaagcccatcgtcgtcaaggccaagctcatctccaaggtcgccgagaagaagatcaaggccgccggcggcgccgtcgtgctcaccgcttaggtttcagtccttgcttgcctctgttttgagatctatgtctgaactagtactgccttcctgtctcagctatttgtgttaagaagacttgctagctttttaaattgccgtggctcctgcctggtggaacagtacttatgaggatttttgcacttagtgatgccagttcatatcaaatatctcagatatatcaacgctatcttttactgccagttatcacaatttcata

SEQ ID NO: 27024 - protein, 145 aa, Panicum virgatum
  misc_feature: Ceres CLONE 1874570
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNVERLWSMVPAEKEAEAGADKAPQIDVTQFGYFKVLGKGKLPSKPIVVKAKLISKVAEKKIKAAGGAVVLTA

SEQ ID NO: 27025 - DNA, 745 bp, Panicum virgatum
  misc_feature: Ceres CLONE 1874574
  misc_feature: Encodes the peptide sequence at SEQ ID NO. 27026
cagccagctcccagctctcctctcacactgctccactccctcacctagaagagaccacagaaccggatccagagcagagcgtgttgcgccggcctagctcttgggtcgtcaagtctccgttcgttctttctttctccaaccggcagctgatctcctgtgttaatcccgaccggagctgcctgcgatgggcatcgtcgactgcgaggggtgcgagcgcaaggtgagcaaggcgctggagggcatggagggcgtgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggagtagctagtagccggggaggagtagtagatagagtagcaagttgctgctggtgtttgttgctgttggatcattttttttcctactttatattctctgctacgcttgtgtgcgctctagttggatgttgatttggaaatccttagtggtagtaagtaaggcttgtaaaggctagctagtagt

SEQ ID NO: 27026 - protein, 125 aa, Panicum virgatum
  misc_feature: Ceres CLONE 1874574
  misc_feature (4)..(60): Pfam Name: HMA Pfam Description: Heavy-metal-associated domain
  misc_feature: Functional homolog of the protein sequence given in SEQ ID NO 50155
  misc_feature: Useful for biocontainment applications
MGIVDCEGCERKVSKALEGMEGVSSVEVAPRQHKVTVAGYVDAGKVMRRLARRTGKRVEPWPYVPYDVVAHPYAPGAYDKKAPPGYVRNVVADPAAAPLARASSTEVRYTAAFSDENPNAACAVM

SEQ ID NO: 27027 - DNA, 554 bp, Panicum virgatum
  misc_feature: Ceres CLONE 1874577
  misc_feature: Encodes the peptide sequence at SEQ ID NO. 27028
aaaaccataagcgccccttgtttacccgacgcgatctccatttacaagagcaagatcccaacgacgcagccatggcggtgtccatcgacctcacctaggagtacgggtacatcttgctcggtgctggtggcctccgccttcgtcaggttctggatgggcttccaggtcggcaaggcccccagaaagtaccacgtgttctaccccagcatgtacgccgtcgagtcggagaaaatcgacgccaatctcttcaactgcgcgatgagggggcatcaaaactcgctggacatgatgcccatgttcttcgtcatgctgctgctcggcggtctgcaccacccgaccatcgccgccggactgggcgccttctacacggtcgcgaggttcttctacttcaagggatactctaccgagcgtcccagacaaccgtctaaagattggcgggttcaacttcctcgctgtgtctgggctaataatacgcacggcatctttcctaatcaacctgctcatcatggagacgctctgaagatcatatttacacctgatctgcagactggatt

SEQ ID NO: 27028 - protein, 184 aa, Panicum virgatum
  misc_feature: Ceres CLONE 1874577
  misc_feature (33)..(149): Pfam Name: MAPEG Pfam Description: MAPEG family
  misc_feature: SWISSPROT Homolog: EC 2.5.1.18 Glutathione transferase
KTISAPCLPDAISIYKSKIPTTQPWRCPSTSPRSTGTSCSVLVASAFVRFWMGFQVGKAPRKYHVFYPSMYAVESEKIDANLFNCAMRGHQNSLDMMPMFFVMLLLGGLHHPTIAAGLGAFYTVARFFYFKGYSTERPRQPSKDWRVQLPRCVWANNTHGIFPNQPAHHGDALKIIFTPDLQTG

SEQ ID NO: 27029 - DNA, 782 bp, Panicum virgatum
  misc_feature: Ceres CLONE 1874578
  misc_feature: Encodes the peptide sequence at SEQ ID NO. 27030
agcgcagttgttggttgttgccgtcgtcgtcgtcgtcgtcttcaactggccatccccttgtctttgactagagaacccgtggaagcagaatcaaggaggtggagcgccatggcgggctccgatcacctcctcgcgcgtccaggattagccatcgtgatcatgggagtcagcggctgcggcaaatcaaccgtcgcggcactgcttgctgaagccctgggttgcagcttcatagaagccgatgactaccattcccaggaaaacaaagctaagatgagcaagggcatcccgctctccgacgccgaccgcacgccatggctggagtccctcctgtacgccatccgtgatcggctggaccacggcgaggacgtggccgtcagctgctcggcgctgcagctcaagtacagggaggtcctccgggcagctgaccggagctacaagccgggggactacgccacgtgcagggtgaagttcgtgtgcctgagggcgtcggccgaggtgatcaccgagaggatgcagaggaggtcaagcgaagggaaacacttcatgccggcgagtttgctgcaaagccagctcgacctgctgcagatcgacgcggcggaggggatcaccgaggtagatgcggcggtgcatgccagcaacattgtccgcgacaccgttgctcagttcagggaggagctggcatccacagttcctccttgtttctgaatatacaacgaaatttcattcagtggacaagggaacctctgcatttgcaaacaagctcgttcaacattacccagttc

SEQ ID NO: 27030 - protein, 198 aa, Panicum virgatum
  misc_feature: Ceres CLONE 1874578
  misc_feature (21)..(174): Pfam Name: SKI Pfam Description: Shikimate kinase
  misc_feature: SWISSPROT Homolog: EC 2.7.1.12 Gluconokinase
MAGSDHLLARPGLAIVIMGVSGCGKSTVAALLAEALGCSFIEADDYHSQENKAKMSKGIPLSDADRTPWLESLLYAIRDRLDHGEDVAVSCSALQLKYREVLRAADRSYKPGDYATCRVKFVCLRASAEVITERMQRRSSEGKHFMPASLLQSQLDLLQIDAAEGITEVDAAVHASNIVRDTVAQFREELASTVPPCF

SEQ ID NO: 27031 - DNA, 759 bp, Panicum virgatum
  misc_feature: Ceres CLONE 1874579
  misc_feature: Encodes the peptide sequence at SEQ ID NO. 27032
aattttttttccgtcagttttcaaccttgctccaccaggccaccccgcccgcccgcctcccctcaactggccaccgccgctgccgaaatcaatggcgacgggcggcggcggcgctgcgggcgacggcgagttctaccttcggtactatgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatattatgaaggaggacgacagcaactggccggagcccgatcgcatcggcaggcaggagctcgagatcgtcatgggcaacgagcacatctccttcaccacctccaagatcggctccctcgtcgatgtccagtccagcaaggaccctgagggcctccggatcttctactacctcgtccaggatctgaagtgttttgtgttttcgctcatcaacctccacttcaagatcaaaccaattcagtcctaagctccattccatgctgttccgtaactgtgttatgaaactgcgagtgtttaagagagaaccctgtaccatgcaagatcctatttagtttgtgatgatgcactcgggttgtgtggagcattgggtggaagtggaactttgagtttgcctgagattgctgtttggatgtgccaactgcgactgcgagtaatgatatt

SEQ ID NO: 27032 - protein, 157 aa, Panicum virgatum
  misc_feature: Ceres CLONE 1874579
  misc_feature (13)..(155): Pfam Name: Mago_nashi Pfam Description: Mago nashi protein
MATGGGGAAGDGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 27033 - DNA, 643 bp, Panicum virgatum
  misc_feature: Ceres CLONE 1874597
  misc_feature: Encodes the peptide sequence at SEQ ID NO. 27034
aacaagccacagctcatcttcttcagcgaggccctcccacgccggcgccatcatccgtctccccaccagcggcggcgaccggccgtgggagtgctgcgacttcgtcgtgcgggacccggacttccggccgccgcggtggcagtgcaacgacgtgtcggccgagtgccccgcggcctgcagccggtgcgaggcggcgccgggcgacggcggcggctacgtgtgccgcgactgggtcgtgagcctgctcgagccgcccgtatgcacgccgaggccgtgggactgctgcgacgccgccgtctgcacccgggcgtacatccccgactgccgctgcgccgacgaggtggaggcgtgccccagcaactgcagcgagtgcgagctggcgggggcggacccgccccgctaccgctgcctcgacctgttccacggataccccgggcccaagtgcacgccgttccttgattcgatgggcaactagcccagaacacgtacgtccacaaataaataaaattagctagctagcgtacaagctactgtagcaagtgattgttcatccgacgtgtacaattagctaccctgctcgctagctgctagctgctactgtatttcgtgcaactcaataagcgacgtggccaagtagacctcg

SEQ ID NO: 27034 - protein, 157 aa, Panicum virgatum
  misc_feature: Ceres CLONE 1874597
  misc_feature (94)..(118): Pfam Name: Bowman-Birk_leg Pfam Description: Bowman-Birk serine protease inhibitor family
  misc_feature (120)..(144): Pfam Name: Bowman-Birk_leg Pfam Description: Bowman-Birk serine protease inhibitor family
TSHSSSSSARPSHAGAIIRLPTSGGDRPWECCDFVVRDPDFRPPRWQCNDVSAECPAACSRCEAAPGDGGGYVCRDWVVSLLEPPVCTPRPWDCCDAAVCTRAYIPDCRCADEVEACPSNCSECELAGADPPRYRCLDLFHGYPGPKCTPFLDSMGN

SEQ ID NO: 27035 - DNA, 526 bp, Panicum virgatum
  misc_feature: Ceres CLONE 1874620
  misc_feature: Encodes the peptide sequence at SEQ ID NO. 27036
aaggggggcgagctcacgagaaagacgcccaggtcccagggacccgtagcgcgtagaccgggcggggtgtttggctcacatcgcggtggccgcgcatggcggatcagttcccgcattcggcgaacaatgtgatcatcgaggaggcgaacaagggcctgaacccaggaatgatagtcctgcttgtagttgccctcttcctgctgctctttttcgtggggaactatgcgctgtatgtgtacgcccagaagacccttccgcctaacaagaagaagcctgtctccaagaagaagctgaagagggaaaaactgaagcagggcgtctccgctccaggagagtaaacagccatgctgctgatctcctcctgagctcctctttacatgataaaaaatatatatagaccagctcgagctgcactgtctgaagtgagtctgtctaatctttgtcttgaatggtacatttgtcttgtgtttcagcaactgatgaacctttagcctaaattgagctactccgttgtttcttgtcctcg

SEQ ID NO: 27036 - protein, 80 aa, Panicum virgatum
  misc_feature: Ceres CLONE 1874620
  misc_feature (10)..(80): Pfam Name: S1FA Pfam Description: DNA binding protein S1FA
  misc_feature: The sequence is a functional homolog of SEQ ID NO 1769 in the 11/479,226 US patent application
  misc_feature: The sequence is a functional homolog of SEQ ID NO 2604 in the 10/374,780 US patent application
  misc_feature: The sequence is a functional homolog of SEQ ID NO 960 in the 10/225,066 US patent application
  misc_feature: The sequence is a functional homolog of SEQ ID NO 1761 in the 11/479,226 US patent application
  misc_feature: Functional homolog of the protein sequence given in SEQ ID NO 50378
  misc_feature: Useful for making plants with modulated biomass
MADQFPHSANNVIIEEANKGLNPGMIVLLVVALFLLLFFVGNYALYVYAQKTLPPNKKKPVSKKKLKREKLKQGVSAPGE

SEQ ID NO: 27037 - DNA, 1064 bp, Panicum virgatum
  misc_feature: Ceres CLONE 1874639
  misc_feature: Encodes the peptide sequence at SEQ ID NO. 27038
acggatcccccgccttcccccgcaaccgcgtcggcgatggcatccgcggcggccgccggcgaaaagccccacgcgcacctcgcgagcccgctcctctcgccgccccagcccccgcagcagccctactacgcctacccggccgccgcctacgagcaccccgcggcccctcccccgacgctcgtcttcgtgccggcgccctgctccccggtgctcgtccgcctccgccgcctgcgcccgcgccgcgcgccgggcctctgccgcgcctgcgcccggatcctcccgctcctcctcgccctcgcgctcctcgcggccgccgccttcctgctctacccttcgccccccgccgcgcgcgtccgggggctccgcgtcgaccggttccgcgccgacccgccggcgctcgacctcggcctcgcgctgcggctccgcgtccgcaacacgggcttcgtcctcccgctccgctaccgcgcggtctccgccgccgtctcgtaccgcggccacctgctcgggtccgccaaggcgtggccagggtccggcgagctcgcgggcaggggcgaggtgtacgcggacgctgaggtgtgggtgaacgccgggagggtgctggatgatgtggtcgacctcatcgcggacctggccactggctccgtgccgctggagatcgtcacggaggtggtcggctcgatcagggtcttccgtttccacatccctgtgaaggggcttatatcatgctcggtgaatatcagcccagagactcagagaatcataagccaggattgctattaagtgacggtgatttgagcacttggtggaacataactgcacaattactctggatgatactatcaagttgcagagcctcctcgatggaactggagtgcctatctgtatataatttggatactgtgctgtgtaggctggaataagaagctatcatattgtgctgtgtatatgctgtcttgcaaacatgtcagaactgcttatgtctgtacatgtaatgtattgaatactaaagcatctagatgtaccatagcatagaaatgaatcatggtgtgtgattggatctgagc

SEQ ID NO: 27038 - protein, 247 aa, Panicum virgatum
  misc_feature: Ceres CLONE 1874639
  misc_feature (95)..(230): Pfam Name: Hin1 Pfam Description: Harpin-induced protein 1 (Hin1)
MASAAAAGEKPHAHLASPLLSPPQPPQQPYYAYPAAAYEHPAAPPPTLVFVPAPCSPVLVRLRRLRPRRAPGLCRACARILPLLLALALLAAAAFLLYPSPPAARVRGLRVDRFRADPPALDLGLALRLRVRNTGFVLPLRYRAVSAAVSYRGHLLGSAKAWPGSGELAGRGEVYADAEVWVNAGRVLDDVVDLIADLATGSVPLEIVTEVVGSIRVFRFHIPVKGLISCSVNISPETQRIISQDCY

SEQ ID NO: 27039 - DNA, 575 bp, Panicum virgatum
  misc_feature: Ceres CLONE 1874692
  misc_feature: Encodes the peptide sequence at SEQ ID NO. 27040
aaatacgccggcgctagctctagtcttgcgagccacgaaagaaagaagcaaacagatctgcctgcctgccgcttgttcttcctcccctccgggctccggcgatccgatccgaacgatggcgtccgccgccgcggggtcgtggtcgaagcggtggatccggccggaggtgtggccgctcttcttcgcgacgggcacggccgtcggcatctgcgggatgcagctcatccgcaacatcaccggcaacccggaagtcagggtgctcaaggagaagagggcggcgggcgtgctggagaaccacgacgaggggaagaggtactcgcagcacggcttcaggaagttcatcgacggcaggaagcccgagatcatggagaacctcaactcgtggatggccgacccgcccaagtactagatatccatacatatataccggccgacggctcatttggtcggccgcacaattttaattattcttgacattcagcagctgttaccgtgattgtctgcggtacgtttatttttgtatcaccgtaaacatactcctcctatattcttaacaacaagaacaaacatgtgac

SEQ ID NO: 27040 - protein, 97 aa, Panicum virgatum
  misc_feature: Ceres CLONE 1874692
  misc_feature (10)..(96): Pfam Name: B12D Pfam Description: B12D protein
MASAAAGSWSKRWIRPEVWPLFFATGTAVGICGMQLIRNITGNPEVRVLKEKRAAGVLENHDEGKRYSQHGFRKFIDGRKPEIMENLNSWMADPPKY

SEQ ID NO: 27041 - DNA, 730 bp, Panicum virgatum
  misc_feature: Ceres CLONE 1874699
  misc_feature: Encodes the peptide sequence at SEQ ID NO. 27042
aactcatgaaaccctagccttacccctaattcctcgtccgtcgcagccctagtcgtcgcctccctcgccctgcactcgcccgtccctggccaccagccccgatcctgcacgcgccgacctgtcccctccactccccagccgctcggcccgtgcgcaccaccagctcctcgcaggcgcgcagccctagtccctacgcgccgccggccagcgccctcaccaagacttgctgcgctgctctgcgtgacgacgcctacagctccgggcgacggggccccctctccccgcgaccaggaagaccctgttggctggtggctgtggccttgctagctctggcagctggttttctggttgcgggcgcagtcggaggctagggttttgcggcgagatgtcggcgtacgacgaggtggagatcgaggacatggagtggaacgcggagctgaaggcgtacacgtacccgtgcccctgcggcgacctcttccagatcacgctcgaggacctccgcctcggggaggagattgcgcggtgcccctcgtgctccctcttcctcaccgtcgtctacaacgccgaggacttcgccgaagccaaggagccgccccacaagccgggcccgagcccagtcgccgtcgcctgaggcggtcccccgtgcgcggcgagatggatgtgttgaattgatctcagggcaggaaaagaaacgtgagttgatgtttgacatacacgagagcatttgtac

SEQ ID NO: 27042 - protein, 81 aa, Panicum virgatum
  misc_feature: Ceres CLONE 1874699
  misc_feature (5)..(59): Pfam Name: zf-CSL Pfam Description: CSL zinc finger
MSAYDEVEIEDMEWNAELKAYTYPCPCGDLFQITLEDLRLGEEIARCPSCSLFLTVVYNAEDFAEAKEPPHKPGPSPVAVA

SEQ ID NO: 27043 - DNA, 678 bp, Panicum virgatum
  misc_feature: Ceres CLONE 1874704
  misc_feature: Encodes the peptide sequence at SEQ ID NO. 27044
ggaaaataggacaggccgagaacgaagccgagctagctggtgctccggcgtgatggcggccacggtgtactccctggcgctcctcggcggcgcgcgcctccccgccgccccgcgctccgccctcctcccgcgccgcatcgcctgccagctccgcctccatcaagatgcgccgaggctctccctgctccgcgtgaaggccgcctccgaggacacctcctcggcctccgccgacgagctcatcgaggacctcaaagccaagtgggacgccgttgaggacaagcccaccgtgctcttgtacggcggcggcgccatcgtcgccctctggctgacctccgtggtcgtcggcgccatcaactccgtgccgctgctgcccaagatcatggagctcgttggcctcggctacgccggctggttcgtctaccgctacctcctcttcaaggaaagtcggaaagacttggctagcgacattgataccttgaagaagaagatcaccggaacagaatctacacactctcttggagagttttgagtggttctttcatgttgcggggaaaatttgtaatgggagaaccgtctgcttgagtactactgccgatttgtgctatatatctggatacaaaggaggctttgttatgttgtgcaataacgttgtagttttgatatttcccaccaccagtt

SEQ ID NO: 27044 - protein, 158 aa, Panicum virgatum
  misc_feature: Ceres CLONE 1874704
  misc_feature: SWISSPROT Homolog: EC 6.1.1.9 Valine--tRNA ligase
MAATVYSLALLGGARLPAAPRSALLPRRIACQLRLHQDAPRLSLLRVKAASEDTSSASADELIEDLKAKWDAVEDKPTVLLYGGGAIVALWLTSVVVGAINSVPLLPKIMELVGLGYAGWFVYRYLLFKESRKDLASDIDTLKKKITGTESTHSLGEF

SEQ ID NO: 27045 - DNA, 601 bp, Panicum virgatum
  misc_feature: Ceres CLONE 1874714
  misc_feature: Encodes the peptide sequence at SEQ ID NO. 27046
gttcctctcatcgctttgttgtaggcttagggtttgcgattttccgagatggcagtgcccttgctgacgcagaagattgtgaagaagcgggtcaagcagttcaagagaccccatctcgaccgctacaagtgcctcaagccaagctggcgcaggccaaagggtattgactcccgtgttaggaggaagttcaagggatgcaccttgatgcccaacattggttatggttctgacaagaagaccaggcactacctgccgaacaagttcaagaagtttgtagtccacaatgtctctgatctggagttgcttatgatgcacaacaggacatactgtgctgaaattgcccacaacgtctcaacccgtaagcgcaaggagattgtggagcgtgctgcacagcttgacattgtggtcacaaacaagcttgccaggcttcgcagccaggaggacgagtagtatgctatgaagattgctgctctgattaatttgtttgtaggaagcatctctgtttgaatgcataattttaatgttacactggtgtatggacgccctgtaattcagtgagctcatcatatgacatacagttttggatggtctgaagtatttg

SEQ ID NO: 27046 - protein, 133 aa, Panicum virgatum
  misc_feature: Ceres CLONE 1874714
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFVVHNVSDLELLMMHNRTYCAEIAHNVSTRKRKEIVERAAQLDIVVTNKLARLRSQEDE

SEQ ID NO: 27047 - DNA, 719 bp, Panicum virgatum
  misc_feature: Ceres CLONE 1874717
  misc_feature: Encodes the peptide sequence at SEQ ID NO. 27048
gccaagcttcgtccttccagccaaggaaacgtagcgatacgtcatgtgcgggggagcgatcctcgccgagctcgtccccgcgcgggtgcaccggccgctcacggtcgccacgctctggccggcggccgacagcggggccaccgccggcggcaagaggaaggcggccgacgtcgacgagctcgagaccgtcaccgacgacgaggagttcgaggccgagttccagcttttcgtggacgacgacgagccgtctccggccgcctcgccggaatccggcggccgcaggtccagggctgccccttctcctgcagtttcagggcgctccgtttgcacgagcccggctccgcgcgtgaacaagtacaggggcgtccgctaccgccggtcggggaggtgggcggcggagatcagggacccgcggcaggggcggcgcgcctggctcggcaccttctgctccgccgaggaggccgcccgggcgtacgaccgcgaggcccgccggatccgcgggaagagcgcgcggctcaacttcccgctcctggacgaaggccgccgccagaggcggaccgcgccggcgccggccatggccatcgacctcaacctgccggccgtctccgacgacgacaccatggatgctgacgacgattccgacgacgctcaccgttcagcgatgggcggtgaggcggtgcagagcacgctggcgcggatcaaggaactgatcacacagc

SEQ ID NO: 27048 - protein, 225 aa, Panicum virgatum
  misc_feature: Ceres CLONE 1874717
  misc_feature (103)..(154): Pfam Name: AP2 Pfam Description: AP2 domain
MCGGAILAELVPARVHRPLTVATLWPAADSGATAGGKRKAADVDELETVTDDEEFEAEFQLFVDDDEPSPAASPESGGRRSRAAPSPAVSGRSVCTSPAPRVNKYRGVRYRRSGRWAAEIRDPRQGRRAWLGTFCSAEEAARAYDREARRIRGKSARLNFPLLDEGRRQRRTAPAPAMAIDLNLPAVSDDDTMDADDDSDDAHRSAMGGEAVQSTLARIKELITQ

SEQ ID NO: 27049 - DNA, 768 bp, Panicum virgatum
  misc_feature: Ceres CLONE 1874719
  misc_feature: Encodes the peptide sequence at SEQ ID NO. 27050
agcacacacacatcgaactatccaaactttcaccagcgtagtaagtcgttgccatggccaagacggtgttgctccccgtgctcctctccttcctcctcctccccttcgcctccctcgctctgacgcaggacttctgcgtcgctgacctctcctgcagcgacacgccgtccggctacccgtgcaagtctagcgtcaccgccaacgacttctactaccacggcctggctgccaaaggcaaaatcaacgacctcatcaaggccgccgtgacgcctgccttcgtcggtcagttcccgggcgtcaacgggctcggcatctccgcggccaggctcgacttggagggcaccgtcgccgctggcttcatcagctccggagcgaacaccccctacaccaagacgctgtaccccggcgacatcatggtgttcccacaaggattgctccactaccagtacaacgccggcactggccctgcagtggcgctcgttgccttcagcagccctaaccccggcctgcagatcaccgacttcgcgctcttcgccaacaacctcccgtcggccgtcgtcgagaaggtcaccttcttggatgacgcgacggtgaagaagctcaagagtgtgctcggcggcagcggctaagttgctcaagagttgagcaagctcgtcaactgatcgtggtcttggtcgtcgcttgtgcgtgtatgcatgatcgaacatgtcgtcatttcatcaaagtcatgtggtcttttcaagttattctttgactctttgttcatgt

SEQ ID NO: 27050 - protein, 191 aa, Panicum virgatum
  misc_feature: Ceres CLONE 1874719
  misc_feature (55)..(181): Pfam Name: Cupin_1 Pfam Description: Cupin
  misc_feature (25)..(112): SWISSPROT Homolog: EC 1.15.1.1 Superoxide dismutase
  misc_feature (94)..(190): SWISSPROT Homolog: EC 1.2.3.4 Oxalate oxidase
MAKTVLLPVLLSFLLLPFASLALTQDFCVADLSCSDTPSGYPCKSSVTANDFYYHGLAAKGKINDLIKAAVTPAFVGQFPGVNGLGISAARLDLEGTVAAGFISSGANTPYTKTLYPGDIMVFPQGLLHYQYNAGTGPAVALVAFSSPNPGLQITDFALFANNLPSAVVEKVTFLDDATVKKLKSVLGGSG

SEQ ID NO: 27051 - DNA, 654 bp, Panicum virgatum
  misc_feature: Ceres CLONE 1874735
  misc_feature: Encodes the peptide sequence at SEQ ID NO. 27052
aggcagagccgaaagccgagggcgaaaccaatcgcgaaggcgaagcgaagccaccgcgagaggagagggagaggaggcgaggagggatggggcggaagcggaaggagctgctgtcgtcggcgccgtggcggacgggggaggccgccgaggacgaggaggcggccaggctcagccgcgaggggaaggtcagcgtcaccaacaaccccggcgagacggccaccatgaacgtcccccgcagcaggcgccaggacctcgacctcactgttgacgacttcgacgaggaggagatcgaccccgagctgcgctactccttccagcggaacagcaggtttttgaagagagtttttagtgtggatacacttgtcaagcctcttcctcctgtaatggcatacagtgtatctcgtaatgtaaactttttcttcaggatcttcacacagttctggggtaagctatgttgatagaagatcatattgtgtgttggcaatagtttcgctcttctgatctttattcagcctgtttttctatttgtgtcattgtaataacttagtttccttttgcttgcattaatgtttgtaaattaagagtaagggggttgataccttgctctgcgtacaaacaatagccctcgtatacacggagctgagtgcatcttgt

SEQ ID NO: 27052 - protein, 123 aa, Panicum virgatum
  misc_feature: Ceres CLONE 1874735
  misc_feature: Functional homolog of the protein sequence given in SEQ ID NO 50121
  misc_feature: Useful for making plants with modulated nitrogen use efficiency
MGRKRKELLSSAPWRTGEAAEDEEAARLSREGKVSVTNNPGETATMNVPRSRRQDLDLTVDDFDEEEIDPELRYSFQRNSRFLKRVFSVDTLVKPLPPVMAYSVSRNVNFFFRIFTQFWGKLC

SEQ ID NO: 27053 - DNA, 673 bp, Panicum virgatum
  misc_feature: Ceres CLONE 1874737
  misc_feature: Encodes the peptide sequence at SEQ ID NO. 27054
atcactcattcaggcacgctacgcaacaaggcttgctgctgttgctgctgcttctgcttcccggcctaatcttgtggctcacgagagcgacccagaaagctaggctataccagttgggtccttggccataatgtgcggcggagccatcatcgccgacttcgtccccgccggcgcccgccgcccggcgagctccaccgtctccgcctccatcctctccggcgacgaggagctggccaaggaggcgccggcgagcagggcgcctgcgccggggcgcaagacggcgtaccgtgggatccggcgccggccctggggccgctgggcggcggagatccgcgacccgcgcaagggcgcgcgcgtctggctgggcacctacgccacccccgaggacgccgcgcgcgcctacgacgtcgccgcgcgcgagatccgcggcgccaaggccaagctcaacttcccgcccgccgtcggcgcgggcggacccccggcgaccaaaaggcgccggaccaaagtccccgcggccgaggagagctccgggtcgtcgttctccccggcggccgccctcgtggggccgccggccgtcggcggagcggaggagacgctgcgcgactgcatgtccgggctggaggcgttcctggggctgccgctggaggacgccgacgccgcggcgggtggcggc

SEQ ID NO: 27054 - protein, 180 aa, Panicum virgatum
  misc_feature: Ceres CLONE 1874737
  misc_feature (50)..(101): Pfam Name: AP2 Pfam Description: AP2 domain
  misc_feature: Functional homolog of the protein sequence given in SEQ ID NO 50249
  misc_feature: Useful for making plants with altered lignin content
  misc_feature: Functional homolog of the protein sequence given in SEQ ID NO 50227
  misc_feature: Useful for biocontainment applications
MCGGAIIADFVPAGARRPASSTVSASILSGDEELAKEAPASRAPAPGRKTAYRGIRRRPWGRWAAEIRDPRKGARVWLGTYATPEDAARAYDVAAREIRGAKAKLNFPPAVGAGGPPATKRRRTKVPAAEESSGSSFSPAAALVGPPAVGGAEETLRDCMSGLEAFLGLPLEDADAAAGG

SEQ ID NO: 27055 - DNA, 703 bp, Panicum virgatum
  misc_feature: Ceres CLONE 1874743
  misc_feature: Encodes the peptide sequence at SEQ ID NO. 27056
actcatctctcccaaatccccacccccaaaatcccccaatcccccaacctctccgagtcgagcgagcgaccatgtctgggcgcggcaagggcggcaaggggctgggcaagggcggcgcgaagcgtcaccgcaaggtcctccgcgacaacatccagggcatcacgaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagacagtcaccgccatggacgtcgtctacgcgctcaagcgccagggccgcaccctctacggattcggcggctgaggggcgccgccgccgccgcccggtggccgtgccaaaagtcttgggtcgcggtcaagaaatcgcggaggaggcgagattgttctggtccatatatgctctgtttcgtaggcttcccagtagtgctaaatattgttggttggcggtttggatcattctagatccgcggtcgagtagtactgtagtagtatgtgaagctgtatggcaaagttcacctgcatatgctatctgttctgaacttcagatatatgaatccggtgccttgccgtgtttatgatgtgtattcgcttcatacctcatcagaacagctggtgaattcactt

SEQ ID NO: 27056 - protein, 103 aa, Panicum virgatum; identical to SEQ ID NO: 12044
  misc_feature: Ceres CLONE 1874743
  misc_feature (25)..(94): Pfam Name: Histone Pfam Description: Core histone H2A/H2B/H3/H4

SEQ ID NO: 27057 - DNA, 855 bp, Panicum virgatum
  misc_feature: Ceres CLONE 1874768
  misc_feature: Encodes the peptide sequence at SEQ ID NO. 27058
aacagagattagcctttcacccaacacgaatcccatagcttgaggtcgctcgatcgtcgggtgcagcagccgcttgttggagcctgcaggaagcaggaggaagagcagtggtggtgcagccatggcgcagccgcagccgagaagggaagaccaggagctgcgccaggcgcagcagggcagcaaggccccgcagcaggagcccatcaagtacggcgacgccttcgccgtgaagggcgagctggccgcgcagcccatcgcgccgcgcgacgcggcggccatgcggtccgccgaggacagcgtgccgggcgtgcaggtcccgcaggagagcggcggcgggttcagcgccgcggccttcatggagtcggcggcccagtacaacgaggcagtcggcgccgtgcgccccggccaggccagcgacgccgccgccaagcacgggatcaacgtcgcccaggacgccgtgcccggcgggcgcatcgtcaccgagttcgtcgcaggccaggttgtagggcagtacgccgtcgccgaagcggcgccggcgcaaccggacgcggcgggggctaacaacaaggccaccggcggcgcgggccaaggtgacgctggcggagctcccggagcgcgcggcgggccagcgtcggcgaggggcaactgagatgtcgctcctacatatgtaatcaacatgttccgggccagcgtatgaagaactcatcatgtgactgcacagtgtctggacagaccgatctacgcagtagctagtgcttagtagaagcttgttgtgtatcagtttggcgatgtattcaactgtgtactgaaataagcagcaacggggtgactgccactgcgattttaccctacccc

SEQ ID NO: 27058 - protein, 175 aa, Panicum virgatum
  misc_feature: Ceres CLONE 1874768
  misc_feature (27)..(91): Pfam Name: SMP Pfam Description: Seed maturation protein
MAQPQPRREDQELRQAQQGSKAPQQEPIKYGDAFAVKGELAAQPIAPRDAAAMRSAEDSVPGVQVPQESGGGFSAAAFMESAAQYNEAVGAVRPGQASDAAAKHGINVAQDAVPGGRIVTEFVAGQVVGQYAVAEAAPAQPDAAGANNKATGGAGQGDAGGAPGARGGPASARGN

SEQ ID NO: 27059 - DNA, 762 bp, Panicum virgatum
  misc_feature: Ceres CLONE 1874779
  misc_feature: Encodes the peptide sequence at SEQ ID NO. 27060
agccaaccagcccggccccacctatagctgctagctctattcaagcagtagcactagtacagcttctcctctgccccttcgacaacgcagcaaacttcaactgttcaaggtcgtagccagaggacgatgagccgttgcggcggtctctcttcgccgctcgcggctgtttccctgctcctcctcctcatctgcttcttccaccgcgcggcggcggctcgccccctgccggctgctgctgctgttcctcttcaggttcaccaagaggacgtagccatggtggctgcagacgacgagccagtgcttcagaaaggcgccgccgcgggtagtggccatgagctctcggtctcatcagtcgctgaggtgatggtgggagcagaggaggaggaggccgaggacccggcgtgcgaggaggggaacgacgactgcatgcagcggcggctgctcggcgacgcgcacctcgattacatctacacccagcacaagggcaagccatgagcgaggatcccggccggccatcttctccggcgtacgttgggagtgtgtgtgtggggggcaaagtcgtacatgctgcaaagttgacactgggaatctcgtctactagtatatctaccttctgctacctgctcacagtttctgccactgatcaaccagtatccggggatccatccatgtaggattaatatatgtgtgtgactgtcatcgcctcgctcgtttgtacatcgtctctcttcttggtcatgtataatacatgcatcgttaatt

SEQ ID NO: 27060 - protein, 73 aa, Panicum virgatum
  misc_feature: Ceres CLONE 1874779
  misc_feature (22)..(72): Pfam Name: PSK Pfam Description: Phytosulfokine precursor protein (PSK)
MVAADDEPVLQKGAAAGSGHELSVSSVAEVMVGAEEEEAEDPACEEGNDDCMQRRLLGDAHLDYIYTQHKGKP

SEQ ID NO: 27061 - DNA, 747 bp, Panicum virgatum
  misc_feature: Ceres CLONE 1874781
  misc_feature: Encodes the peptide sequence at SEQ ID NO. 27062
atggcccaatagcccagcaaccgactcatattaacctagccggagggcgccgcgcatcagccccccatcaatcaggtcgaagaatccccgcctcccctagggtttccgctccgcgagccgggtcgggtcgagtcgggggatccgccgcgccatggcgtcgcgcccgtcgctgaaggcgaagcccaagggcaagggcgggaggaagggcgccgccccgggcgcggacgacggggaggccaccagggcggcgaccgcggtgcggctcgtcaaggagtggaccacgtggacgatgaagacggccaaggtggcggcgcactacggcttcatcccgctcgtcatcgtcatcggcatgaactcggagcccaagccctccatcacgcagctcctctcccccgtctgatcggggcctcccccggcgccggcagggccccgggtgcggtcggtcccgcctgctctcgtagtagctcatagctggttagttgttttcacatgtgctggatcgagtgatgcttctgtgaggaggttgagcgtaataatttcttgttggcggatgtgtcttctatagaacggaccaaatctgttaagttggttatatgaatctgctatatgctattaatgtgatggtatatgaactagatccttgttcatctgtgttcggtttttatgtgcgtccatcatgtgcctgatgttttcattggacagccagttgaggtgaactagctgcggtgtggtgcaatctagctagtt

SEQ ID NO: 27062 - protein, 82 aa, Panicum virgatum
  misc_feature: Ceres CLONE 1874781
  misc_feature (40)..(79): Pfam Name: Tom7 Pfam Description: TOM7 family
MASRPSLKAKPKGKGGRKGAAPGADDGEATRAATAVRLVKEWTTWTMKTAKVAAHYGFIPLVIVIGMNSEPKPSITQLLSPV

SEQ ID NO: 27063 - DNA, 664 bp, Panicum virgatum
  misc_feature: Ceres CLONE 1874790
  misc_feature: Encodes the peptide sequence at SEQ ID NO. 27064
accacaccaccacggaactcgccgccgccgcacttccactcctcaactctccccgcctcgcacccatggcgacgaccctgatggctgcggccaccacctcctgctccccgcgccgcgcggcgccgctcccggcgctggcggagcagatggagaaggcggcgctcttcgacttcaacctgacgctcccggcgatcgcgaccgagttcctgctgctcatggtcgcgctggacaagctctacttcacgccgctcggcaagttcatggacgagcgggacgccaagatccgcggcgagctcggcgacgtcaaggacgcctccgaggaggtcaagcagctggaggagcaggccgccgccatcatgaaggcggcgcgcgccgagatcgccgcggcgctcaacaagatgaagaaggagaccaccgccgagctggaggccaagctggacgagggccgccgccgcgtcgaggccgagctcgtcgaggcgctcgccaacctcgaatcccagaaggaggaggccgtcaaggcgctcgacgcgcagatcgcctcgctcagcgacgagatcgtcaagaaggtgctcccatccgcgtgaggaggaatcgaaacagcgagccagccttcttccttgctcagctttctgatctgtgtgtatacgcttggtggggccgccgg

SEQ ID NO: 27064 - protein, 172 aa, Panicum virgatum
  misc_feature: Ceres CLONE 1874790
  misc_feature (39)..(170): Pfam Name: ATP-synt_B Pfam Description: ATP synthase B/B' CF(0)
  misc_feature: SWISSPROT Homolog: EC 3.6.3.14 H(+)-transporting two-sector ATPase
MATTLMAAATTSCSPRRAAPLPALAEQMEKAALFDFNLTLPAIATEFLLLMVALDKLYFTPLGKFMDERDAKIRGELGDVKDASEEVKQLEEQAAAIMKAARAEIAAALNKMKKETTAELEAKLDEGRRRVEAELVEALANLESQKEEAVKALDAQIASLSDEIVKKVLPSA

SEQ ID NO: 27065 - DNA, 609 bp, Panicum virgatum
  misc_feature: Ceres CLONE 1874795
  misc_feature: Encodes the peptide sequence at SEQ ID NO. 27066
atgctctctcagaggtgggttggcttctccccctcttaccaagtcctcggttctagggttttaattgaaagggtagatggagggggctgatgaggaatgccactgcttcgacggcggactcgcctgggccacccacaacgcgtccctccaccaggccttcgcctcctacggcgacgtcctcgactccaaggtcatcagcgaccgtgagaccgggaggccccgcgcgttcggcttcgacaccttctcaaccgaacggtcgatgctccacgccatcgaagccatgaacggcaaggagctcgacggccgcaacatcaccgtcaatcatgcccaatcccgcggcggtggaggtggcggcggcggcggcggttacggcagcggtcgcgagggaggctaccgtggcggcggcggcggctacggcggcggtcgccgtgagggcggctacggtggcggcggttacgacggtggcggtgtcggatacggctgccgtcgccgcgaggacggctacgacggtggcgcctacggcagccgcggtgactcctgtagtaactggaggaactaatgggctggtcctcccgtgctggcaaccaagaaatcctatttatctgttag

SEQ ID NO: 27066 - protein, 160 aa, Panicum virgatum
  misc_feature: Ceres CLONE 1874795
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MEGADEECHCFDGGLAWATHNASLHQAFASYGDVLDSKVISDRETGRPRAFGFDTFSTERSMLHAIEAMNGKELDGRNITVNHAQSRGGGGGGGGGGYGSGREGGYRGGGGGYGGGRREGGYGGGGYDGGGVGYGCRRREDGYDGGAYGSRGDSCSNWRN

SEQ ID NO: 27067 - DNA, 709 bp, Panicum virgatum
  misc_feature: Ceres CLONE 1874798
  misc_feature: Encodes the peptide sequence at SEQ ID NO. 27068
gtgcgccaccattttcccctccccatctcgcccgccgtcctctcctcctcgatctcctcgcatccgcagctctccccggcgcttaaccaagggtttaggagcggcggcgatggcggcgaggctggcgcagctgcgcgcgcaggcggcgcgtgcggcggagctcgcctcgaagcacggctgcgcctactacaaggaggtcatggagaagaacaagcagtacgtagtgcagccccccaccgtcgagaagtgccaggagctctccaagcagctcttctacacccgcctcgcaagtctaccaggccgctatgaagcattctggaaggagcttgatggtgtcaagcaggtatggaagaacagaaaggagctcaaggttgaggaccttggggttgcgactttatttggagttgagctttatgcatggttctgcgtaggcgagattgttggcagagggtgcaccttaaccggctataaggtctagatgatttctcctggttaagacctgctttgcaatctatacttttagctgatgcttgttgaaacgacgatgatacctgccttcgttcacaattttgtttcttaaaaagagtttctctagtgctgaatgtcagcaaggacgggcacatcgttgcaacattgcctcaataatttgctcgctcgattgtccattttggtgctctgtaattctttgtccattccatctgctgcagta

SEQ ID NO: 27068 - protein, 122 aa, Panicum virgatum; identical to SEQ ID NO: 15778
  misc_feature: Ceres CLONE 1874798
  misc_feature (8)..(122): Pfam Name: ATP-synt_G Pfam Description: Mitochondrial ATP synthase g subunit

SEQ ID NO: 27069 - DNA, 737 bp, Panicum virgatum
  misc_feature: Ceres CLONE 1874807
  misc_feature: Encodes the peptide sequence at SEQ ID NO. 27070
acctcgcccaccgggccctccaccgggccccgctcttcgcccgctaccacgcagcgcaccactcctccggcgtcacccagccgctgacagccgggttcggcacgccgctggagagcctgctcttgacgctggcgatgggggccccgctcgcgggcgccttcctggtgggccacggctccctaggcctggtgtacggccacgccttcgtgttcgactacctgcgggccatgggctacagcaacgtggagatcgtgtcgcccagggtgttcgacgccttccccccgctcagatacatcctctacacgccctcgtacctgagcctgcaccaccgcgagaggcgcggcaacttctgcctgttcatgccggcgctggacgcggcgttcggcaccctggacgggcggtcgtgggcgctgcagcgcgcggcgtacgacggcgcggcgggcggcggcgcgctgggcacgccggagttcgtgttcctggcgcacgtggtggacatcatgtcgtcgatgcacgtgccgttcgtgctccggtcgctgagctccatccccttcgccaaccacttcatcctgctccccttctggcccgtcgccttcgccttcatgctcctcatgtggtgctgctccaagaccttcgtcgtcagcttctactacctccgcggccacctccaccagacgtggtccgtcccgcgctacggcttccaagtaagcaatggcgccgccggccggccgtggtcggcg

SEQ ID NO: 27070 - protein, 244 aa, Panicum virgatum
  misc_feature: Ceres CLONE 1874807
  misc_feature (1)..(110): Pfam Name: FA_hydroxylase Pfam Description: Fatty acid hydroxylase
LAHRALHRAPLFARYHAAHHSSGVTQPLTAGFGTPLESLLLTLAMGAPLAGAFLVGHGSLGLVYGHAFVFDYLRAMGYSNVEIVSPRVFDAFPPLRYILYTPSYLSLHHRERRGNFCLFMPALDAAFGTLDGRSWALQRAAYDGAAGGGALGTPEFVFLAHVVDIMSSMHVPFVLRSLSSIPFANHFILLPFWPVAFAFMLLMWCCSKTFVVSFYYLRGHLHQTWSVPRYGFQVSNGAAGRPWS

SEQ ID NO: 27071 - DNA, 670 bp, Panicum virgatum
  misc_feature: Ceres CLONE 1874828
  misc_feature: Encodes the peptide sequence at SEQ ID NO. 27072
accagcatcgatcacacagcaatcaacacacacagccatcccactacttgcacgccgaaggaggagcaactcaccaagcgagagccatgacgacgaaggcgatctcggcgcttgccgtcgtcctgctcgcggcggcggcgttccaccagcagctggccgcgccggcgcgcgccgcctacatcacgtgccccgccgtgctccaggacatgacgccgtgcctgcccttccttcagggcggcgaccgcagcccctccgccggctgctgcgccggcgtgaggtccctctacgaggccgccgacaccatcgccgagaggcgcgccacctgcgagtgcctcaagacggcgtacctccaggtccaggcccagctctccgccgcgcaggcgctgcccggcgactgcggcctctcgctgccctacatcatcacccccgacatcgactgcaacacgattgaatgaagcagggatagatgcagctgtgaccgctcaatccaaatccatatacgacgactgatggtgatgatcgtatcagtgctctgacatgctgtatgtggaagcactgcgttattagaattagaataaaggatttggtgccaattaatgctgtcgcttgtaatcgtgtgtgagccatcagtagtggcttctatgtgtgctagttaatcaatctcccatgt

SEQ ID NO: 27072 - protein, 122 aa, Panicum virgatum
  misc_feature: Ceres CLONE 1874828
  misc_feature (34)..(118): Pfam Name: Tryp_alpha_amyl Pfam Description: Protease inhibitor/seed storage/LTP family
MTTKAISALAVVLLAAAAFHQQLAAPARAAYITCPAVLQDMTPCLPFLQGGDRSPSAGCCAGVRSLYEAADTIAERRATCECLKTAYLQVQAQLSAAQALPGDCGLSLPYIITPDIDCNTIE

SEQ ID NO: 27073 - DNA, 684 bp, Panicum virgatum
  misc_feature: Ceres CLONE 1874859
  misc_feature: Encodes the peptide sequence at SEQ ID NO. 27074
ccagatcctggtgaacaacctgcccaccgcgaagctcaccgtggagtcggtggacaccgtcagcaacctgctcacctgcaccatccaaaagatcaagtccgccctccaggccacgccctagctggcatttgacatggattccggccaccggcagccctcgcaaaaggtccggagccggagccggagccggagccggatgccgtatcaaatgcttagcttgaggccatggtggcagctagaaatggctgtgccgagcgcgtcgccgcagaatggcgaggaactagcagtggtgcttgagaggcggtgaaagatgaaggaaaaataaattacagagtgtggagtacaagtattattgcgcagagcaatatatatatgaggtgagttacacagggattaagtcaagaacgaaccgtgcgctagggttcatcaatctcttgagcagacatgttttttactgtttgctcaggcttgataggctcatgtggtggttcgggtattgacttaagtctctggcaaatgaagttcaaatatcccccctaggacttctatatgtatctagcagcttgtttattttaaccaatttgtgaagagtttctttcttcttctactagttctccagtatggggaatctcatagaaatgaggtgacaatgagatttatcgtatcccgagggtggcttgtgtc

SEQ ID NO: 27074 - protein, 39 aa, Panicum virgatum
  misc_feature: Ceres CLONE 1874859
  misc_feature: The sequence is a functional homolog of SEQ ID NO 92 in the 10/666,642 US patent application
  misc_feature: The sequence is a functional homolog of SEQ ID NO 130 in the 10/666,642 US patent application
  misc_feature: The sequence is a functional homolog of SEQ ID NO 1024 in the 10/225,066 US patent application
  misc_feature: The sequence is a functional homolog of SEQ ID NO 2886 in the 10/374,780 US patent application
  misc_feature: The sequence is a functional homolog of SEQ ID NO 434 in the 10/666,642 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 526 in the 11/479,226 US patent application
  misc_feature: The sequence is a functional homolog of SEQ ID NO 840 in the 11/435,388 US patent application
QILVNNLPTAKLTVESVDTVSNLLTCTIQKIKSALQATP

SEQ ID NO: 27075 - DNA, 741 bp, Panicum virgatum
  misc_feature: Ceres CLONE 1874863
  misc_feature: Encodes the peptide sequence at SEQ ID NO. 27076
cttccccgcaaagaaagaaacgagcagcagcagcggaacgagagcgaagcagcagcagcgacgatggcgagcggcggcatgaagagggagatcagcgagacccacgacgccctccgcttcggcatcaacgccggcgtcaaggccgacctcgctccgccgcacccgctccagtccaccatccagtcggaggccaaattctgggcggacaagaaaaagttcgggacggaggccatctacggatccgccttcaacatccgcaaggatctcgatgcccaaatcctctccaggttccaaaggccccctggtgctttgccatcatctatgcttggatatgaggcactgacaggttccctggatgattttggatttgaagattatcttaacatgcctcaagattctgacagtttccgtcaacctgacttgcaccatggaatggaggttcgccttggcttgtccaagggacctatctgcccttgcttcaattgatccatccatgtagttctgcagtacgttgtgcacctcagtccagtgcgtcggtcaatagaccatattatcatagtgaaaagtgaaaaccgacgaggctagcacctgttcaatgttcagtgtcatgtttcagtcaacacagaatttagttcttacccctatttgagcacacatttgatggttggtctgcctctctgaatctacgtgttccagcttgctgacaaaatttcgcagcttttactccacttattttgatct

SEQ ID NO: 27076 - protein, 140 aa, Panicum virgatum
  misc_feature: Ceres CLONE 1874863
  misc_feature (2)..(131): Pfam Name: UMP1 Pfam Description: Proteasome maturation factor UMP1
MASGGMKREISETHDALRFGINAGVKADLAPPHPLQSTIQSEAKFWADKKKFGTEAIYGSAFNIRKDLDAQILSRFQRPPGALPSSMLGYEALTGSLDDFGFEDYLNMPQDSDSFRQPDLHHGMEVRLGLSKGPICPCFN

SEQ ID NO: 27077 - DNA, 682 bp, Panicum virgatum
  misc_feature: Ceres CLONE 1874864
  misc_feature: Encodes the peptide sequence at SEQ ID NO. 27078
agtcgtcgcctccctcgccctgcactcacccgtccctggccaccagcccgccacagcgccggtgccctgcgcccccgccgccccgatcctgcacgcgccgacctgtcccctccactccccagccgctcggcccgtgcgcaccaccagctcctcgcaggcgcgcagccgcgccgcagccctagtccctacgcgccgccggccagcgccctcaccaagacttgctgcgctgctctgcgtgacgacgtctacagctccgggcgacggggccccctctccccgcgaccaggaagaccctgttggctggtggctgtggcctcgctagctctggcagctggttttctggttgcgggcgcggtcggaggctagggttttgcggcgagatgtcggcgtacgacgaggtggagatcgaggacatggagtggaacgcggagctgaaggcgtacacgtacccgtgcccctgcggcgacctcttccagatcacgctcgaggacctccgcctcggggaggagattgcgcggtgcccctcgtgctccctcttcctcaccgtcgtctacaacgccgaggacttcgccgaagccaaggagccgccccacaagccgggcccgagcccagtcgccgtcgcctgaggcggtcccccgtgcgcggcgagatggatgtgttgaattgatctcagggcaggaaa

SEQ ID NO: 27078 - protein, 81 aa, Panicum virgatum; identical to SEQ ID NO: 27042
  misc_feature: Ceres CLONE 1874864
  misc_feature (5)..(59): Pfam Name: zf-CSL Pfam Description: CSL zinc finger

SEQ ID NO: 27079 - DNA, 695 bp, Panicum virgatum
  misc_feature: Ceres CLONE 1874877
  misc_feature: Encodes the peptide sequence at SEQ ID NO. 27080
attccccatccccaaatcgaccgagcgaatccctcccggcctctcgccaccgctaaccctagcatccgtttcgatggcccgcaaggtggataagaagccggcggagaagaagcccgcggaggaggagcccgcgacggagaaggcggagaaggccccggcggggaagaagcccaaggccgagaagcggctgcccgcgggcatgtccgccggcaaggagggcggcaagggcaagaaggggaggaagaaggggaagaagtcggtggatacctactagatctacttcttctaggtgctgaagcaggtgcaccccgacatcgacatctcctccaaggccatgtccatcatgaactccttcatcaacgacatcttctagaaggtcgccggctaggccaccaagctggcgcgctattactagaagccgaccttcacctcctgtgagatccttacctcggtccgcctcgtcctctgcggcgagctcgccaagcgcgccgtctacgagggcaccaagggcgtcacctagttctgctcattttaggttggtggaaggagtagacgagtggtgttggttgatttggctcattttgtcctgtatggctggtgcttgtagtttatgagactagatgtggatggatgctgatctctatgtagtttatttcgtgatgcgttattgtgatgctgttgggagacttgggagt

SEQ ID NO: 27080 - protein, 66 aa, Panicum virgatum
  misc_feature: Ceres CLONE 1874877
  misc_feature: Functional homolog of the protein sequence given in SEQ ID NO 50160
  misc_feature: Useful for biocontainment applications
  misc_feature: Useful for making plants with modulated flowering time
MARKVDKKPAEKKPAEEEPATEKAEKAPAGKKPKAEKRLPAGMSAGKEGGKGKKGRKKGKKSVDTY

SEQ ID NO: 27081 - DNA, 609 bp, Panicum virgatum
  misc_feature: Ceres CLONE 1874879
  misc_feature: Encodes the peptide sequence at SEQ ID NO. 27082
cacaccagccaatcgcccctctcgctccctccctcttatcccctctcctcggctccgccagctccgcgctcgtcgtcattgccccgctgctgtgttgccgccgccgccgccttcctcgtcgtcccctggcagccggcagctagcagcgatggccctgcaggctccggcgtcgtccctggcgcgcgcgccggcggcgccgctccggtcgtcgttctcggcgccgtggccggcgctgcggctgccggcgcccgcgcggcggcgggcgggcgccgcggccgcgcggatcaccatgcgggtcgcgtccaagcaagcctacatctgccgcgactgcgggtacatctacaacgacaggaccccgtttgagaagctggccgacaactacttctgccccgtttgtggagctccaaagaggaggttcagaccataccagccggcggtgtccaagaacgcgaatgctaccgatgcccgcaaggcgaggaaggagcagctgaagaaggacgaagcaatcgggcaggccttgccgatcgccattgtcgccgggatcatcgctctggccggactctacttctacctcaacaacgcctacaactagaggaacaaacacgcttc

SEQ ID NO: 27082 - protein, 147 aa, Panicum virgatum; identical to SEQ ID NO: 10271
  misc_feature: Ceres CLONE 1874879
  misc_feature (55)..(90): Pfam Name: Rubredoxin Pfam Description: Rubredoxin

SEQ ID NO: 27083 - DNA, 407 bp, Panicum virgatum
  misc_feature: Ceres CLONE 1874903
  misc_feature: Encodes the peptide sequence at SEQ ID NO. 27084
attcagctgagtgtgctcgatcatcaagcaatcaacaaagcctcccaattatcctttcatccgatcatcttccttcttccaagatgtcttgcagctgcggatcaagctgcaactgcggctccaactgcaagtgcggcaagatgtaccctgaccttgaggagaacagcagcggcggcgctcaggccaccgtcgtcctcggcgtggccccggagaacaaggccggccagttcgaggcggcggcggagtccggcgagaccgcccacgcctgcaagtgcggtaacagctgcagctgcgacccctgcaactggctgatttcgacggggaaaaacacaacacaaccgcctgcctgcccaaacaataacaaccacccctaccgccgcgtgaggtgcagatgcggacacaacaca

SEQ ID NO: 27084 - protein, 107 aa, Panicum virgatum
  misc_feature: Ceres CLONE 1874903
  misc_feature (1)..(75): Pfam Name: Metallothio_2 Pfam Description: Metallothionein
MSCSCGSSCNCGSNCKCGKMYPDLEENSSGGAQATVVLGVAPENKAGQFEAAAESGETAHACKCGNSCSCDPCNWLISTGKNTTQPPACPNNNNHPYRRVRCRCGHN

SEQ ID NO: 27085 - DNA, 1040 bp, Panicum virgatum
  misc_feature: Ceres CLONE 1874905
  misc_feature: Encodes the peptide sequence at SEQ ID NO. 27086
gccccagacaaatccaatccggaaccgactcccccctcgcttcgccggggagaggagggacgagcgacgccgcgcccgtccgcgtccgcgtccgtctgcccctcccgcgccgaccacttcccggagcgcggagacgggcgggcggtcatcccgctcaaaaacgccgcaggtatgcagagccagatcgtgtgccacgcgtgccggaccgttctgctctacccgcggggggcgcccagcgtctgctgcgcggtgtgccaggccgtcaccaccgtgccgccaccaggactagagatggctcagcttatatgtggtggttgtcgaactttgctgatgtatactcgaagtgcagacaccgtaaggtgttcatgttgcaatacagtcaatcttgttagaccagtgaataatatagctcatgttaactgcggccactgccagacaactttgatgtatccatatggagcacattcagtaaaatgtgccatatgcaatcatatcactaccactggagtaaatacggtggcacccacaccgtctgcaaggccagcatcaaatggatcttcatatagtacctcatctacttctgctcctaaatctcagccccagaatgtaactgttgttgttgagaaccctatgacagtagatgataagggaaaactagtgagcaacgttgtagttggagtcacaactgggaaaaactgatgtgctatctacatcattgttgtgtgttctatatcagaagctaggaaatattatgggtcacagtgctatcgagtggctggttgcatggtcgcccttgaccaaagatgcaccaaatgtttcttgtatcttgcaaggaaaccatgaaggtcaaaagctgtgttttgaatctattgattcttttgtgtgtataagagctcttttagacttcagtgtgtgatcagatagtagaggtgactgatagtatagtttcattatacatgcatatgtacacactttgtttgttagtttgtgctgtcttgttcataattttttgctggtatacacgcgctatgctcgtttcg

SEQ ID NO: 27086 - protein, 175 aa, Panicum virgatum
  misc_feature: Ceres CLONE 1874905
  misc_feature (84)..(108): Pfam Name: zf-LSD1 Pfam Description: LSD1 zinc finger
  misc_feature (46)..(70): Pfam Name: zf-LSD1 Pfam Description: LSD1 zinc finger
  misc_feature (7)..(31): Pfam Name: zf-LSD1 Pfam Description: LSD1 zinc finger
  misc_feature: Functional homolog of the protein sequence given in SEQ ID NO 51236
  misc_feature: Useful for making plants with modulated oxidative stress sensitivity
MQSQIVCHACRTVLLYPRGAPSVCCAVCQAVTTVPPPGLEMAQLICGGCRTLLMYTRSADTVRCSCCNTVNLVRPVNNIAHVNCGHCQTTLMYPYGAHSVKCAICNHITTTGVNTVAPTPSARPASNGSSYSTSSTSAPKSQPQNVTVVVENPMTVDDKGKLVSNVVVGVTTGKN

SEQ ID NO: 27087 - DNA, 698 bp, Panicum virgatum
  misc_feature: Ceres CLONE 1874915
  misc_feature: Encodes the peptide sequence at SEQ ID NO. 27088
acacatcgctccctctccctctccaccacagcaggctagctagggttttctggggtttgcgagggggttgctccggtccggcgggaggggggagatggcggcggagcgggctcaggggacggtgaagtggttcaacgggaccaacgggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggcggcggcgcgctcgccggcggggagcgcccggacaacggctacggcggacgcggtggcggcggctacggcggcggaggcgaccgcggctacgggggaggcgacgaccgcggctacggcggaggcggcgaccgcggctacggcggaggcggcgaccgcggctacggtggaggaggtgaccgcggctacggcggaggcggcggcgaccgcggctacgggggaggaggtggctacggaggaggcggcgaccgtggctacggcggcggcggcggaggcggccgcggctcctggtgctactagtgcggcgaggagggccacatcgcacgggactgctcccacggcggctgcggctacggcggtggtggctacggcggaggccgcggctccg

SEQ ID NO: 27088 - protein, 171 aa, Panicum virgatum
  misc_feature: Ceres CLONE 1874915
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50180
  misc_feature: Useful for making plants with altered alkaloid content
MAAERAQGTVKWFNGTNGFGFISPDDGGQDLFVHHSSVKADGFPNLKDGDAVEFTVGADNDGRAKAIDVSAPGGGALAGGERPDNGYGGRGGGGYGGGGDRGYGGGDDRGYGGGGDRGYGGGGDRGYGGGGDRGYGGGGGDRGYGGGGGYGGGGDRGYGGGGGGGRGSWCY

SEQ ID NO: 27089 - DNA, 731 bp, Panicum virgatum
  misc_feature: Ceres CLONE 1874936
  misc_feature: Encodes the peptide sequence at SEQ ID NO. 27090
gcttcacttcaccgcggcgaccttcgcgtcggcatcgcgatcccgcccgatggccgcccgtctcgccgccatccccgcgctcctcctcctcctgctcgcgtcctccccggccgcggcggccggcgacgaggggccggggaaggtggccgtggcgctctactacgagtcgctgtgcccctactcggcgcgcttcgtggtggaccgcctcgccagggtcttcgaggacggcctcctcgacgccatcgacctcacgctcttcccctacggcaacgccagggtccacgccggcggcgagatcacgtgccagcatggtccatacgagtgcctgctcaacactgtggaagcttgcgccatcgacgcctggccggatttggacgtgcatttccgtttcatctactgcatggaggacctggtggtgaagcgccagtacaaggagtgggagtcctgcttccagaagctggggcttgacccgaagcccgtaactgaatgctacaaaagcgaacagggtcacaagcttgagctcaagtacgcgaaccagaccgacgctcttgtgccgccgcaccggtacgtcccgtgggtggtcgttgacgggcagccactgcttgaggactacgagaacttcgaggcttacgtctgtcaggcctacaagggcagtcctccgaaggtatgcgaggggctgggtgcatctgccggtggcgcttgagaccgtggtggcgcgcagcggcgtcact

SEQ ID NO: 27090 - protein, 217 aa, Panicum virgatum
  misc_feature: Ceres CLONE 1874936
  misc_feature (32)..(141): Pfam Name: GILT Pfam Description: Gamma interferon inducible lysosomal thiol reductase (GILT)
MAARLAAIPALLLLLLASSPAAAAGDEGPGKVAVALYYESLCPYSARFVVDRLARVFEDGLLDAIDLTLFPYGNARVHAGGEITCQHGPYECLLNTVEACAIDAWPDLDVHFRFIYCMEDLVVKRQYKEWESCFQKLGLDPKPVTECYKSEQGHKLELKYANQTDALVPPHRYVPWVVVDGQPLLEDYENFEAYVCQAYKGSPPKVCEGLGASAGGA

SEQ ID NO: 27091 - DNA, 480 bp, Panicum virgatum
  misc_feature: Ceres CLONE 1874937
  misc_feature: Encodes the peptide sequence at SEQ ID NO. 27092
tctcgcacgcacaccacaagcgagggacccggggcggggcaggaggaaaaaacaagagagagaaggcgtctctctctctcctctctcgccgtccccagcctctcgtcttcgctgcctgcgaaaggagttcgtcatggcatcgaagcgtatcctgaaggagctgaaggacctgcagaaagatccccccacatcatgcagtgcaggccctgctggtgaggacatgtttcattggcaagcaacaattatgggaccgcctgacagtccctatgctggtggtgtgttcttagtgaacattcatttcccgccagactaccccttcaaaccaccaaaggtgtctttcaagacaaaggtcttccatccaaatatcaacagcaatgggagtatatgccttgacattcttaaagagcagtggagccctgctttgacaatttctaaggtcttgctctccatctgctccctgctggcggaggagaccccccc

SEQ ID NO: 27092 - protein, 115 aa, Panicum virgatum
  misc_feature: Ceres CLONE 1874937
  misc_feature (5)..(114): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
  misc_feature: Functional homolog of the protein sequence given in SEQ ID NO 50119
  misc_feature: Useful for making plants with modulated low light sensitivity
  misc_feature: Functional homolog of the protein sequence given in SEQ ID NO 50120
  misc_feature: Useful for making plants with modulated light quality sensitivity
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLAEETP

SEQ ID NO: 27093 - DNA, 462 bp, Panicum virgatum
  misc_feature: Ceres CLONE 1874939
  misc_feature: Encodes the peptide sequence at SEQ ID NO. 27094
gtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgggagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcagtggcagccgctactgccgacgcggggg

SEQ ID NO: 27094 - protein, 120 aa, Panicum virgatum
  misc_feature: Ceres CLONE 1874939
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGSGSRYCRRG

SEQ ID NO: 27095 - DNA, 215 bp, Panicum virgatum
  misc_feature: Ceres CLONE 1874943
  misc_feature: Encodes the peptide sequence at SEQ ID NO. 27096
caacttcctcaacgtcgtcgttgacaacttccgcgcgggcatcgtgccccagatcgtcgccaagttcgagaccgtctacaacgcgctcaggggccctgagctcgcccgccgccccctccgttcgtgctcctccattcccgggccctccggacagagccgaagaacctcgacaagaaaagggggggggcgaaaagcccccccctcctacaaaaaca

SEQ ID NO: 27096 - protein, 71 aa, Panicum virgatum
  misc_feature: Ceres CLONE 1874943
  misc_feature: SWISSPROT Homolog: EC 3.6.3.14 H(+)-transporting two-sector ATPase
NFLNVVVDNFRAGIVPQIVAKFETVYNALRGPELARRPLRSCSSIPGPSGQSRRTSTRKGGGRKAPPSYKN

SEQ ID NO: 27097 - DNA, 629 bp, Panicum virgatum
  misc_feature: Ceres CLONE 1874953
  misc_feature: Encodes the peptide sequence at SEQ ID NO. 27098
aaatttgctcttcctccctccgctgtggtcagcctttgggaaaggaaacacaagcggcccccctctcgcccaccaccacaccagacctccggcggcggcgaccccagtcgagaacacgaaggcgacggcgatggcgacggcgctcaaccgcggcctccgcctcctcgccgccggcgccgaggcgtccaagccagcttctcgtggattccatgccactggtgtgaagagaatgggagggcacggccacgatgagccgtactatctccatgccaagcacatgtacaacttgcacaggatgaagcatcaggggttgaaggtgactctttccgtgctgggagcagttagcatcggcgttggagtccccgtgtacgcagtcattttccagcagaagaagaccgcctcaggttgagcgatcatgctctcaaagcctacatattggagacttattttcaacaacattttgtgaagttttaagcttgattctaccttggtggttgcttattattaccatgttttcttacgagaagttgtaacctcgtttcttgccatgttttcaagtaggacacaactttctgttaataatatcgtggcttgaactttccaggctgtggagaaacctcagcagtgat

SEQ ID NO: 27098 - protein, 92 aa, Panicum virgatum
  misc_feature: Ceres CLONE 1874953
  misc_feature: Functional homolog of the protein sequence given in SEQ ID NO 50154
  misc_feature: Useful for making plants with modulated nitrogen use efficiency
MATALNRGLRLLAAGAEASKPASRGFHATGVKRMGGHGHDEPYYLHAKHMYNLHRMKHQGLKVTLSVLGAVSIGVGVPVYAVIFQQKKTASG

SEQ ID NO: 27099 - DNA, 727 bp, Panicum virgatum
  misc_feature: Ceres CLONE 1874957
  misc_feature: Encodes the peptide sequence at SEQ ID NO. 27100
cccgtttcatcctccatcttcccttcacggggagggtcagagccgccaccggtgctcccaggggtcgccgcccaggattcgccgccgtctctaggaggccgccgcccaaggaatcgctgcggctgcccccagcagctgccgcctccaggagccgcaggccgccaccccaaggagccgcgctgcggcccccagcagcagccgaccccaggagccgacgttgcccccagcagctgcactccccccaggcccctacacgcgagatccagaggctcctggggagagcgcgtccaggacagagcgcagaggcaacagcagcatccccttcgtctagatctgagttcagattaccgttttcaaccctagaagcgtagcatggcgaagctcaagccaaaggcgttgctggcacaaagcaaagtgaagaagggccctagccaaatcagtgtgatcacgatcttcacctacttggtccttggtgtcgtagtcgtatcctctgtttatgctgcttacaaatactgggtaggcaaatgaccagaagtgacagcagcaggcgtcgaggggaattaaaccccaaactatgtaactgattttgttgttgtatcatccagttggataattttggttgctgcagcctagttaatggaacatggatagattgtatcttgctacatgtttattgtaaaccgtggggacattatactgatatatgtatgctaaattcctttccctc

SEQ ID NO: 27100 - protein, 51 aa, Panicum virgatum
  misc_feature: Ceres CLONE 1874957
  misc_feature: SWISSPROT Homolog: EC 5.2.1.8 Peptidylprolyl isomerase
MAKLKPKALLAQSKVKKGPSQISVITIFTYLVLGVVVVSSVYAAYKYWVGK

SEQ ID NO: 27101 - DNA, 665 bp, Panicum virgatum
  misc_feature: Ceres CLONE 1874960
  misc_feature: Encodes the peptide sequence at SEQ ID NO. 27102
acgctcgctcgagcacgagcactgcaccctctcatctgccggtgctagctcctcctagctttctcccccacttcagccggtagcctcttcttgagagaagctagcaggaagagggatcgagcaagatgatgagcggcaaggctctccttgtcgccgtgctcttggtgggcgtcgcctcccggtgctccggcagcaggggcctgcagggggatcacatcgctgagcagaagtacggtggcggtggctacggtggcggcggcggcggatacggaggcggaggtggtggcggcgggtacggaggcggaggtggtggcggtgggtacggaggcggcggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgctctgtgcaacacccgcaccgactgctacggcgacctcctccgcgagggcgccgccgcctacctcaactccgtcgccgcccagaagtacgcctacaccacgcagcaggtcaaggactgcatcgccgtcgcgctcacctccgaggccgccgccgccgcgcaggcc

SEQ ID NO: 27102 - protein, 179 aa, Panicum virgatum
  misc_feature: Ceres CLONE 1874960
  misc_feature (1)..(82): Pfam Name: GRP Pfam Description: Glycine rich protein family
MMSGKALLVAVLLVGVASRCSGSRGLQGDHIAEQKYGGGGYGGGGGGYGGGGGGGGYGGGGGGGGYGGGGGGGYTPGYSGTGTCDYWKSHPDAIISCIGSLGSILGSFGDVCSAFFGSKLQTLQDALCNTRTDCYGDLLREGAAAYLNSVAAQKYAYTTQQVKDCIAVALTSEAAAAAQ

SEQ ID NO: 27103 - DNA, 748 bp, Panicum virgatum
  misc_feature: Ceres CLONE 1874963
  misc_feature: Encodes the peptide sequence at SEQ ID NO. 27104
cagcagccacaccagggcgacctctccctctctccctcttgacgccacagtagtcgtcccttcgcggaccaggaggcggcggcggcggcggcaatggggcacccctatgcgccggcggagctgcagctgccgggcttcgtgccgctgcagctgtcgcagggccagatcctcgcgccctacctgggcacctcgctcttcgtcgtcgtcgccatctggctcatctccggaagatgccggggactatccaagaccgaccgtctgctcatgtgctggtgggcgttcaccggcctcactcacatcgtcatcgaggggaccttcgtcttagcccccgggttcttcaagaaggagaaccccaactacttcgacgaactttggaaagagtacagcaaaggcgattccagatatgtcgccagggataccgcaaccgtcacagttgaagggataacagctgtgttggaaggccctgcatcactgcttgcagtttatgccattggatcccgcaagtcctacagccatattctccagttcaccgtctgcttgggccagctctacggatgcttggtttacttcatcaccgcatacttggatggcttcaacttctgggtcagtccattctacttctgggcatatttcattgccgcaaacagtttctggacatggatacaaacgctcatcgccatgaggagttggaagaagatttgtgcagcaattcgagcagaaaaggtgaagaactaagtaatgctgcatt

SEQ ID NO: 27104 - protein, 213 aa, Panicum virgatum
  misc_feature: Ceres CLONE 1874963
  misc_feature (17)..(213): Pfam Name: EBP Pfam Description: Emopamil binding protein
  misc_feature: SWISSPROT Homolog: EC 5.3.3.5 Cholestenol Delta-isomerase
  misc_feature: Functional homolog of the protein sequence given in SEQ ID NO 51237
  misc_feature: Useful for making plants with altered sterol content
  misc_feature: Useful for making plants with modulated nitrogen use efficiency
MGHPYAPAELQLPGFVPLQLSQGQILAPYLGTSLFVVVAIWLISGRCRGLSKTDRLLMCWWAFTGLTHIVIEGTFVLAPGFFKKENPNYFDELWKEYSKGDSRYVARDTATVTVEGITAVLEGPASLLAVYAIGSRKSYSHILQFTVCLGQLYGCLVYFITAYLDGFNFWVSPFYFWAYFIAANSFWTWIQTLIAMRSWKKICAAIRAEKVKN

SEQ ID NO: 27105 - DNA, 619 bp, Panicum virgatum
  misc_feature: Ceres CLONE 1874976
  misc_feature: Encodes the peptide sequence at SEQ ID NO. 27106
gtctcagcctcctccgttgcagcgccgccgccgccgcctccatctagggcgcattccccactcctcgtcgccgccgccgagcttgagcgagccctgcaagatggtgctccagaacgacatcgacctgctcaaccccccggcggagctcgagaagctcaagcacaagaagaagcgcctcgtccagtcccccaactctttcttcatggacgtcaagtgccagggatgcttcagcataaccactgttttcagccactcccagactgttgtggtgtgcccgggctgccaaactgtcctctgccagcccactggaggaaaggctaggctcacggagggctgctccttccgccggaagggagactagaatgtagtctggaagatgatgtttgttctgagccaagtttttcacttgagtatgtagccgtcaaattttgtgctatgtgaaatgttagggccctgaactgctgcttactataaggctttcaatatctattcctatgttatgtacctgatactactactcaatgttctgtttggcacctgctttatctaattagctggggttgttttggattatgatgaaccaagtggtgaaattgttgaatactctcggttggcttgc

SEQ ID NO: 27106 - protein, 86 aa, Panicum virgatum; identical to SEQ ID NO: 9875
  misc_feature: Ceres CLONE 1874976
  misc_feature (30)..(84): Pfam Name: Ribosomal_S27e Pfam Description: Ribosomal protein S27

SEQ ID NO: 27107 - DNA, 583 bp, Panicum virgatum
  misc_feature: Ceres CLONE 1874994
  misc_feature: Encodes the peptide sequence at SEQ ID NO. 27108
gggactgaccgggaacttaccgtccctcgcttcgcgctgttcctctcgacaacttctcctctcgttccgtcccccgcctccgcctcgtttcgccgtcgtcgcccagtggtagagagaagagatggcgggccgtggcaaggcgatcggtgcgggcgcggccaagaaggcgacctccaggagctctatcgcccggctccagttccccgtcggtgggatcgccaggttcctcaaggacggcgagtacgtcgagcgcgtcggcgcccgcgcccccgtctacctcgccgccgccctcaagtacctcgctgctgatgttcttgagctggccggatacgccgcaagggacaacacgaagagcctgatcgtgccgcgccacatctggcttgccgtccgtaatgacaaggagctctcgcgttctcctgggcgcggtgaccatcgctggtggtggtgtcgtgcccaacgtccacgtcctactgctccacgacatggggggcggtgtcagcgccactgctgcggccggcgatgaggactagatccctgactgcaccgtccttcgtgtggtcgtgcttcttgtggatgctgcgta

SEQ ID NO: 27108 - protein, 133 aa, Panicum virgatum
  misc_feature: Ceres CLONE 1874994
  misc_feature (19)..(92): Pfam Name: Histone Pfam Description: Core histone H2A/H2B/H3/H4
MAGRGKAIGAGAAKKATSRSSIARLQFPVGGIARFLKDGEYVERVGARAPVYLAAALKYLAADVLELAGYAARDNTKSLIVPRHIWLAVRNDKELSRSPGRGDHRWWWCRAQRPRPTAPRHGGRCQRHCCGRR

SEQ ID NO: 27109 - DNA, 923 bp, Panicum virgatum
  misc_feature: Ceres CLONE 1874995
  misc_feature: Encodes the peptide sequence at SEQ ID NO. 27110
ctcagcagtagtcaacagccagtcctcgatccagcagccatggcctgccgcgcaggaccaccgctccgccggcggccgccgccgcgccccgcgctgctcgctctggccgtcctctcctgcctgcagctcgccgcgtcgcagctgtcgtcgacctcgacccggccccttgcgcgccccgccgccacggcggcagtaccgctggaagaggccgccgccggcggcggcggcgtcgcgcgtcgcgcgtgcacgtacacggtggagatcaagacgagctgctcgtccccgcgggcgtccccggacgcggtgagcctcgcgttcggcgacgcgtaccggaacgaggtgtacacggcgcgggtgtcgccggcgtacgggttcgagcggtgcgccaaggacacgttccgggtctccgggccctgcggctacggcgtctgctacctctacctccgccgctccggcggcgtcgggtggacgccccagtgggtcagggtgtacgagcccgcctcccgcacgccctccaccttctacttcggcgacccgctccccaacggcgtctggtacggcctcgaccgctgcctgcgccgccccgcgcccggcgccggcgccggcgcctctcccgacgccgcggcccaggcgtcacagtgagcgatggatggggcttggttgcgcacggtggaagccagcaacaggatgaccactcgtcgtcacgacgcggctggctgtaagcctgtgacgcgatgatttgtggagcgtgcgagaattcacttcacttttacaagtattttttttctaccgagtggataaatcatacatgatacatctgtgtgtatacgctgcaatcacgtcatgtaaaaaccttggtcgtatttgttcgagtaataagagcgtctgatcagccctattttgttggcggtcacatttctgac

SEQ ID NO: 27110 - protein, 200 aa, Panicum virgatum
  misc_feature: Ceres CLONE 1874995
  misc_feature (45)..(178): Pfam Name: ATS3 Pfam Description: Embryo-specific protein 3, (ATS3)
MACRAGPPLRRRPPPRPALLALAVLSCLQLAASQLSSTSTRPLARPAATAAVPLEEAAAGGGGVARRACTYTVEIKTSCSSPRASPDAVSLAFGDAYRNEVYTARVSPAYGFERCAKDTFRVSGPCGYGVCYLYLRRSGGVGWTPQWVRVYEPASRTPSTFYFGDPLPNGVWYGLDRCLRRPAPGAGAGASPDAAAQASQ

SEQ ID NO: 27111 - DNA, 356 bp, Panicum virgatum
  misc_feature: Ceres CLONE 1874999
  misc_feature: Encodes the peptide sequence at SEQ ID NO. 27112
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggaaaagaaggccggccagttcgaggcggcggcggagtccggcgagaccgcccacgcctgcaagtgcggtaacagctgcagctgccacccctgcaactgctgatttcgatgggaaaagtaaaaacacaccgggaggcatggcaacccc

SEQ ID NO: 27112 - protein, 102 aa, Panicum virgatum
  misc_feature: Ceres CLONE 1874999
  misc_feature (28)..(102): Pfam Name: Metallothio_2 Pfam Description: Metallothionein
SAECARSSSNQQSLPIILSSDHLPSSKLSCSCGSSCNCGSNCKCGKMYPDLEEKSSGGAQATIVLGVAPEKKAGQFEAAAESGETAHACKCGNSCSCHPCNC

SEQ ID NO: 27113 - DNA, 560 bp, Panicum virgatum
  misc_feature: Ceres CLONE 1875001
  misc_feature: Encodes the peptide sequence at SEQ ID NO. 27114
atcacttggcatctctgactcatctctatcttttccggccaccgtataatcaatcctctaatcccaccagcaaggcagtaatggcggatggggagatggactggatcgcggcgcggttcctgctgtccaccatactcggggtgcacccgctggtggtcctggacgacggcggccgcgacgacgagcacttcgccgtggacgaccgcggccagcgcgtgacggtgccggtgccggcggcggtggaggcgcccgagggggtggccggcgtgtcggtgtgcgcggtgtgcacggaggaggtcgcggcggggcaggccgtggtgcggctgccgtgcgcgcactggtaccacgccggctgcatcgccccctggctgcggatccggaacaactgcccgacgtgccgggcggagctgcctcgggagggcggggcggacagagaggccgcggccgcctgccggctggttgcggcgggaggcgtcctacacgatgcttgccggcacgttgccctgctaataattaaactagctactagccggtggacgtgcgtgacagcctgacaggcc

SEQ ID NO: 27114 - protein, 157 aa, Panicum virgatum
  misc_feature: Ceres CLONE 1875001
  misc_feature (66)..(106): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MADGEMDWIAARFLLSTILGVHPLVVLDDGGRDDEHFAVDDRGQRVTVPVPAAVEAPEGVAGVSVCAVCTEEVAAGQAVVRLPCAHWYHAGCIAPWLRIRNNCPTCRAELPREGGADREAAAACRLVAAGGVLHDACRHVALLIIKLATSRWTCVTA

SEQ ID NO: 27115 - DNA, 948 bp, Panicum virgatum
  misc_feature: Ceres CLONE 1875028
  misc_feature: Encodes the peptide sequence at SEQ ID NO. 27116
acacagactccctctctctcctcccccgccctctctctctcatccgatctgcatctgcttttcttccccccttatctctgtcccttctggcgtgcgcaaagatttgattttttttctcaatcgaggaggcggagcctgaagagtggtagtggtgggagaacttggggaggaaggagatcttgatctgttgtgggaggggagaggtcgaagaggaagatggcggcgcaggagcaggagaaacagcaggcgaagacgagcaccacgagctcgctcccctccagcagcgagcgctcctccagctccgcgcccaacaacctcagggaaggaggggcggagagcgacgaggagatacggcgggtgccggagatgggcggcgcgtcggcgtcggcctcgtcgggcgcgggcgcggacgagcgccccaaggaggacggcaaacaggggcagctggtggcggccgcgggggcgcaggggcagccgccggcgccggggaagaagcgcgggcgcaccgccggggacaaggagcagaaccggctcaagcggctgctccggaaccgcgtctcggcgcagcaggcgcgggagcggaagaaggcgtacctgacggagctggaggccaaggccaaggacctcgagctccgcaatgccgagctcgagcagcgggtctccacgctccagaacgagaacaacacgctccgccagattttgaagaacacgacggcgcacgcgagcaagaggagcggtggcggcggcgccggtggcggcaagggcggcgacggcggcggcaagaagcaccacttcaccaagagctgatggcgccggttcgtgctaggagctgtgaacttttctcgcctgatctgaccccccactgttacggctggtacatttgctggctttgttgctgttgctgatgacgcttttcccttctttttttctactgtgtccgtctgcttc

SEQ ID NO: 27116 - protein, 196 aa, Panicum virgatum
  misc_feature: Ceres CLONE 1875028
  misc_feature (100)..(163): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Functional homolog of the protein sequence given in SEQ ID NO 50426
  misc_feature: Useful for making plants with modulated light quality sensitivity
  misc_feature: Functional homolog of the protein sequence given in SEQ ID NO 50427
  misc_feature: Useful for making plants with altered alkaloid content
  misc_feature: Useful for making plants with altered terpenoid content
MAAQEQEKQQAKTSTTSSLPSSSERSSSSAPNNLREGGAESDEEIRRVPEMGGASASASSGAGADERPKEDGKQGQLVAAAGAQGQPPAPGKKRGRTAGDKEQNRLKRLLRNRVSAQQARERKKAYLTELEAKAKDLELRNAELEQRVSTLQNENNTLRQILKNTTAHASKRSGGGGAGGGKGGDGGGKKHHFTKS

SEQ ID NO: 27117 - DNA, 523 bp, Panicum virgatum
  misc_feature: Ceres CLONE 1875048
  misc_feature: Encodes the peptide sequence at SEQ ID NO. 27118
atctcttctccctcccctcacctaatcctccttgtcctctgcaatcctcagtcccgccgcgcaggctcactggactgactggtcactggtcactccatcctatcggatcatcccacgcaggcaggcaaggccggaaagcacttcccgtactccgtcctcagatgatgctgcacgccgtggaccccggccccatagttcgccacttcgggggttcaaccatcgtagctccccatcctcccggatgacgcggtggctccctagtagagaccagcccgtcacgtgcggtctcctcttccctcaaactgccgtcttgctccaacgatttcttgtgcgtgtccgaagcggcgcagaaaggctattgcctgaatggcacacctataaaagcaccgaactgatcctcatggctgaggttgccaccactgatcgtaccacaaagactctgactagtgcagatacatcatcctctacatcctacgtcttgatacttgcatgtggatcctccttgatcaagatatctgcttct

SEQ ID NO: 27118 - protein, 93 aa, Panicum virgatum
  misc_feature: Ceres CLONE 1875048
  misc_feature: SWISSPROT Homolog: EC 1.6.5.4 Monodehydroascorbate reductase (NADH)
MTRWLPSRDQPVTCGLLFPQTAVLLQRFLVRVRSGAERLLPEWHTYKSTELILMAEVATTDRTTKTLTSADTSSSTSYVLILACGSSLIKISA

SEQ ID NO: 27119 - DNA, 696 bp, Panicum virgatum
  misc_feature: Ceres CLONE 1875054
  misc_feature: Encodes the peptide sequence at SEQ ID NO. 27120
agttatgcagcagctcgtgtcctaccaaacaacaaccggttgtgttgtgtttgcatgcagcgactcaccccgtcgctacgaacaccaattctcgcagtgtggtggcacgagaacccaagtcgttcttcctcacattcgcctcgctcgccgtgctcgggcaatcgagcaacaggcaccaccaccaccaccactcccatgttcagagcaaagggcatggtgggggtggtggtggggtgctagcggccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgccgccgcccactgaccggccggctgagcggacgacaacgagtcgacgactcgttctgattgctgctgttgacccaccaactgtccaacccaacccacccgcccgcaattcctaccttctgaaggcaagctgtggattatagatttttgtgtgtagagagagatgaggaatctgttcatctgatgagcaaaccaaaccaaaccaagcttggatcttttttttttctttttatt

SEQ ID NO: 27120 - protein, 157 aa, Panicum virgatum
  misc_feature: Ceres CLONE 1875054
  misc_feature (91)..(117): Pfam Name: Bowman-Birk_leg Pfam Description: Bowman-Birk serine protease inhibitor family
MQQLVSYQTTTGCVVFACSDSPRRYEHQFSQCGGTRTQVVLPHIRLARRARAIEQQAPPPPPLPCSEQRAWWGWWWGASGRGKAAARAWPCCDNCGGCTKSNPAQCRCLDAAPRGCHPACRDCVKSSLSADPPVYQCMDRVPNFCSRRCSAAAAAAH

SEQ ID NO: 27121 - DNA, 591 bp, Panicum virgatum
  misc_feature: Ceres CLONE 1875072
  misc_feature: Encodes the peptide sequence at SEQ ID NO. 27122
ggacactgcagatccttactcctctgcgagctgcttgcttgctgtgatcgttcaacccccactccatctgaatcgcatcgagtcccgtcaggtcagcctgcaggccgggctccgatcagccatggcgaacgcggcgtccggggtggcggtggcggaggacctgcacggcgcggttccaggagctgcgcacggcgcgcgcgcgccgcttcgtgatgttcaatatcaacaactccctggagcgcgtggtggtcgacgaggtgggcgcccggcacgccggcttcagcgacctcaccgccagcctccccgccgacggctgccgctacgccgagtacgaccacgacttcgccgtcagggacaccatcgcgcagggcgccccggtcgacgcgccccgcagcacgatcgtcttcgtgtcctggtccccggcgacggcggacgtgaagagcaagatcgtgtacgcgagctcctgcgatgagttcaagaaggagctggacggcgtgcacatcgacctgcaggccacggagcccagcgagctcaccctcgacgtcctcaacgaccacgtcgcctgaacgactggtggtggtagtccgaaat

SEQ ID NO: 27122 - protein, 117 aa, Panicum virgatum
  misc_feature: Ceres CLONE 1875072
  misc_feature (2)..(117): Pfam Name: Cofilin_ADF Pfam Description: Cofilin/tropomyosin-type actin-binding protein
MFNINNSLERVVVDEVGARHAGFSDLTASLPADGCRYAEYDHDFAVRDTIAQGAPVDAPRSTIVFVSWSPATADVKSKIVYASSCDEFKKELDGVHIDLQATEPSELTLDVLNDHVA

SEQ ID NO: 27123 - DNA, 750 bp, Panicum virgatum
  misc_feature: Ceres CLONE 1875076
  misc_feature: Encodes the peptide sequence at SEQ ID NO. 27124
gagaaagtgcttgcaagaagcggagagaaataaagatcttgctgctagaaagagagagagggggatcggagcttcggaacgaaggaagaagaagagatgggccgcgggaaggtggagttgaagcggatcgagaacaagatcagccggcaggtgacgttcgccaagcgccggaacgggctgctcaagaaggcgtacgagctctccgtgctctgcgacgccgaggtcgccctcatcatcttctccagccgcggccgcctcttcgagttctccacctcctcatgtatgtacaagacattggagcgataccgcatctgcaacttcgcatctgaagcatcatcagctccaatcgaggctgaactgaataattaccaggagtacttgaagttaaagacaagaattgagttcctacaaacaactcaaagaaatcttctaggtgaggacttgggcccacttagcataaaggagcttgagcaacttgagaatcaaattgagatctctctcaagcatatcagatcatcaaagaaccagcagatgcttgatcaactctttgagctcaagcgtaaggaacaacaactgcaagactctaacaaggacttaagaaggaagatacaagaaattagtgaggagaacgtgctgcgtctgacctgccaggaccttgggcctagtggatctagcggtcatggcgatgactctagccaggaactccttcgcactgctgtttgtgatccttcctgcatatagggtatcaac

SEQ ID NO: 27124 - protein, 214 aa, Panicum virgatum
  misc_feature: Ceres CLONE 1875076
  misc_feature (76)..(173): Pfam Name: K-box Pfam Description: K-box region
  misc_feature (9)..(59): Pfam Name: SRF-TF Pfam Description: SRF-type transcription factor (DNA-binding and dimerisation domain)
  misc_feature: The sequence is a functional homolog of SEQ ID NO 4 in US patent 7057087
  misc_feature: Functional homolog of the protein sequence given in SEQ ID NO 51040
  misc_feature: Useful for making plants with modulated biomass
  misc_feature: Useful for making plants with modulated flowering time
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 30 in the 10/666,642 US patent application
  misc_feature: The sequence is a functional homolog of SEQ ID NO 707 in the 10/666,642 US patent application
  misc_feature: The sequence is a functional homolog of SEQ ID NO 28 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 6 in US patent 7279615
  misc_feature: Functional homolog of the protein sequence given in SEQ ID NO 50968
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: Functional homolog of the protein sequence given in SEQ ID NO 50969
  misc_feature: Useful for making plants with altered alkaloid content
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: Functional homolog of the protein sequence given in SEQ ID NO 50970
  misc_feature: Useful for making plants with altered terpenoid content
  misc_feature: Functional homolog of the protein sequence given in SEQ ID NO 51057
  misc_feature: Useful for biocontainment applications
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 32 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1965 in the 10/412,699 US patent application
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MGRGKVELKRIENKISRQVTFAKRRNGLLKKAYELSVLCDAEVALIIFSSRGRLFEFSTSSCMYKTLERYRICNFASEASSAPIEAELNNYQEYLKLKTRIEFLQTTQRNLLGEDLGPLSIKELEQLENQIEISLKHIRSSKNQQMLDQLFELKRKEQQLQDSNKDLRRKIQEISEENVLRLTCQDLGPSGSSGHGDDSSQELLRTAVCDPSCI

SEQ ID NO: 27125 - DNA, 701 bp, Panicum virgatum
  misc_feature: Ceres CLONE 1875098
  misc_feature: Encodes the peptide sequence at SEQ ID NO. 27126
agctggagcgcccgtgccccaccgcactggaaatcgaaatatccccttgcacttttccgtgcgcttttccctcgggccaacagggaaacccgcgacttttacctcccccgctttcccctcctcctccttcgtccctgccaagaacaggggcggcagggctcggaatccttccatccatcgcccgtgcgtccatggcgaagctggtgcggaagtttgtggactcctacgacgacgacggcgacgacgcccaggacgccggctgcgtgcgcgccgtgctggccgagctcgtcctcaccttcctcttcgtcttcaccggcgtctccgccgccatggccgccggatccggcgggaagcccggcgaggccatgccgatggcgacgctggccgcggtggcgatcgcgcacgcgctggcggcgggggtgctggtcacggcgggcttccacgtctccggcggccacctgaacccggcggtgaccgtgtccatgatggtgcgcggccacctcagcaagctccggacggtgctgtacgtcgccgcgcagctgctggcctcctccctcgcctgcatcctcctccgctacctcaccggcggcatggtgaccccggtgcacgccctgggcgctggcatccggccgatgcagggcctggtgatggaggtgatcctcaccttctccctcatcttcgtgacctacgccatgatcccg

SEQ ID NO: 27126 - protein, 169 aa, Panicum virgatum
  misc_feature: Ceres CLONE 1875098
  misc_feature (18)..(169): Pfam Name: MIP Pfam Description: Major intrinsic protein
MAKLVRKFVDSYDDDGDDAQDAGCVRAVLAELVLTFLFVFTGVSAAMAAGSGGKPGEAMPMATLAAVAIAHALAAGVLVTAGFHVSGGHLNPAVTVSMMVRGHLSKLRTVLYVAAQLLASSLACILLRYLTGGMVTPVHALGAGIRPMQGLVMEVILTFSLIFVTYAMI

SEQ ID NO: 27127 - DNA, 612 bp, Panicum virgatum
  misc_feature: Ceres CLONE 1875101
  misc_feature: Encodes the peptide sequence at SEQ ID NO. 27128
aaaaccctagcgccgccgccgccgccgccgagaatggccccgaagaaggacaaagccccgccgccgtcctccaagccggccaagtccggcggtggcaagcagaagaagaagaagtggagcaagggaaagcaaaaggagaaggtgaacaacgcggtgctcctcgaccaggccacctacgacaagctgctctcggaggtgcccaagtacaagcagatcaccccctcagtcctctccgagcgtctcaggatcaatggctccctggctcggagggccatcaaggacctgatggctcgtggcctcatccgaatggtctcagtgcactcaagccagcagatctacaccagggcaaccaacacctaaggattcgggaagctgtaatgcctctgtttgccctctgtaggaggagctcctctgccttagaacagttgtcatctttgtcaagggtttgctaatgttatgttacctgtgatgagtatctccatgtggctgaaacatttcagtgattttgcgaattagttcagtactatggtttacctattataagttgccttgcatcaatagctacatgtttttcagtgttttgttactgttaatgccaaggctttcccactg

SEQ ID NO: 27128 - protein, 108 aa, Panicum virgatum
  misc_feature: Ceres CLONE 1875101
  misc_feature (1)..(106): Pfam Name: Ribosomal_S25 Pfam Description: S25 ribosomal protein
MAPKKDKAPPPSSKPAKSGGGKQKKKKWSKGKQKEKVNNAVLLDQATYDKLLSEVPKYKQITPSVLSERLRINGSLARRAIKDLMARGLIRMVSVHSSQQIYTRATNT

SEQ ID NO: 27129 - DNA, 385 bp, Panicum virgatum
  misc_feature: Ceres CLONE 1875108
  misc_feature: Encodes the peptide sequence at SEQ ID NO. 27130
aggatcgtcgtggcctgaccctgatcccgtccatcctctctctctctctctctctctctctctctctctgttccccggcgagacgagatcccatggcgggctccaccttcagcggcgatgagacggcgcccttcttcggcttcctcggcgccgccgccgcgctcatcttctcatgcatgggcgccgcctacggcacggccaagagcggcgtcggggtcgcctccgtgggggtcatgcgcccggagctcgtcatgaagtccatcgtccccgtcgtcatggccggagtcctcggcatctacggcctcatcatcgccggcatcatctccaccgggatcaacccccaggggaagccatactacctcttcgagaggtgcggccccctctc

SEQ ID NO: 27130 - protein, 97 aa, Panicum virgatum
  misc_feature: Ceres CLONE 1875108
  misc_feature (15)..(80): Pfam Name: ATP-synt_C Pfam Description: ATP synthase subunit C
  misc_feature: SWISSPROT Homolog: EC 3.6.3.14 H(+)-transporting two-sector ATPase
MAGSTFSGDETAPFFGFLGAAAALIFSCMGAAYGTAKSGVGVASVGVMRPELVMKSIVPVVMAGVLGIYGLIIAGIISTGINPQGKPYYLFERCGPL

SEQ ID NO: 27131 - DNA, 680 bp, Panicum virgatum
  misc_feature: Ceres CLONE 1875112
  misc_feature: Encodes the peptide sequence at SEQ ID NO. 27132
accactcaagctgagctcagctgtagcctagctagctaggtagctaataaatccatcacatccccgcgccatggcgaagaaccaccaccgcattgtggcgctcctgctcgtcgcggccacgctggtcgcgcagctcatcgcgccggccgcggcctgcccgtcctgcccgacgcctaagcctccgccgccgcccccgacgcccgtgccgtgcccgccgccgccgtcgtccgcgccgccgtccacgggcaagtgccccctgaacacgctgaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggtcaaggcgcgcagcatcaacctcgtgctccccctccccatccaggtggtggtccacgaaagaaaccaaaaaaacccccccaccttccagtgcccgtaatcacacactcactcatcactattgcgtatgtatgtaccattaattaattatacatctgcatgcatgcatccatgcatgatgggttaaggttatgataaaccagtcatatactcatatatctatatatatcttaagcatgtacgtatagcttaatgcatgagctctctttggcttg

SEQ ID NO: 27132 - protein, 144 aa, Panicum virgatum
  misc_feature: Ceres CLONE 1875112
  misc_feature (61)..(143): Pfam Name: Tryp_alpha_amyl Pfam Description: Protease inhibitor/seed storage/LTP family
MAKNHHRIVALLLVAATLVAQLIAPAAACPSCPTPKPPPPPPTPVPCPPPPSSAPPSTGKCPLNTLKLLACVDALNGLVHAVVGAKASEKCCPLLQGVADLDAALCLCTTIKVKARSINLVLPLPIQVVVHERNQKNPPTFQCP

SEQ ID NO: 27133 - DNA, 671 bp, Panicum virgatum
  misc_feature: Ceres CLONE 1875135
  misc_feature: Encodes the peptide sequence at SEQ ID NO. 27134
agagagcccacggtccgtgtccgcgcgaaccaacgcgaggaagaagagtctctcgaggagggaggggaaggaaagggaagcgagcaggaagcggggggtaccgagcggcggcgaggatgaggggtggcggcggcgggatgatggacgacgacgaccgggtgacccacgcggagatcccgaccagcttcggtcacgagctgcgggcctgcctccgatgccgcctcgtcaagacctacgaccagttcaggcagaacggctgcgagaactgcccgttcctggagatggacaaggagcacgacaatgtcgtcaactgcactacaccgaacttcactggaataatctctctgatggaccccagtaggagttgggctgctcgttggttgagaattggtaggttcattccagggtgctacacactggcagtctcagaggagcttccggaagagtaccaggggatttgccaggacaacaacgtgcagtacgtgccgcccaaacgtgtctaaggatcaacatgttcacggcatcccaacccagaagcagcatcataatattaatatagaatagctggaacgtatgtaacccttattgtactcaaggagtctattctctggtcaaatcggcatgctacgctgagaagctaatagtatcgattggctgctaatgatgggtct

SEQ ID NO: 27134 - protein, 128 aa, Panicum virgatum
  misc_feature: Ceres CLONE 1875135
  misc_feature (26)..(128): Pfam Name: Spt4 Pfam Description: Transcription elongation protein Spt4
MRGGGGGMMDDDDRVTHAEIPTSFGHELRACLRCRLVKTYDQFRQNGCENCPFLEMDKEHDNVVNCTTPNFTGIISLMDPSRSWAARWLRIGRFIPGCYTLAVSEELPEEYQGICQDNNVQYVPPKRV

SEQ ID NO: 27135 - DNA, 726 bp, Panicum virgatum
  misc_feature: Ceres CLONE 1875153
  misc_feature: Encodes the peptide sequence at SEQ ID NO. 27136
acaccacctcactcagcaggtccagctcatagtcccagacacccaggcacccagccaccagtgcgcagcgcagcggagcagagcagagcgcagccggccaccgggtcagggtcagccatgagcaagggggagaagcaccaccggcacgagcaccacctgcgccgctgctgcgggtgcctggcctcctgcctgctggcgctggtcctggtggtggccttcgtcgcgctggtcgtctacctggcgctgcgcccctccaagccgtccttctacctgcaggacctgcagctccgacggcccatcaccgtcggcgacccctccctctcggcgtccgcgcaggtcacgctcgcctcccgcaaccccaacggccgcgtcggcgtccactacaagcgcctcgacgtcttcgtcacctaccgcgaccagcccatcacggcgcccgtctccctcccgccgcagtaccagggccaccgcgacgtcaccgtctggtcccccgtgctggcggccgaggccgtgcccgtggcggcctacgtcgccgacgccatgaagcaggacgtcgccgccgggttcgtcgcgctgcaggtcaaggtcgacggccggatcaagtggaaggtcgggagctgggtctcagggagctaccacctcttcgtcagctgccccgccatgctctccgccgccggcggcttcggatcaggctccaacttcaccttgtcggcgctcaagttcgcgcag

SEQ ID NO: 27136 - protein, 202 aa, Panicum virgatum
  misc_feature: Ceres CLONE 1875153
  misc_feature (40)..(178): Pfam Name: Hin1 Pfam Description: Harpin-induced protein 1 (Hin1)
MSKGEKHHRHEHHLRRCCGCLASCLLALVLVVAFVALVVYLALRPSKPSFYLQDLQLRRPITVGDPSLSASAQVTLASRNPNGRVGVHYKRLDVFVTYRDQPITAPVSLPPQYQGHRDVTVWSPVLAAEAVPVAAYVADAMKQDVAAGFVALQVKVDGRIKWKVGSWVSGSYHLFVSCPAMLSAAGGFGSGSNFTLSALKFA

SEQ ID NO: 27137 - DNA, 1431 bp, Panicum virgatum
  misc_feature: Ceres CLONE 1875155
  misc_feature: Encodes the peptide sequence at SEQ ID NO. 27138
gacgacgctgcacaccactccccaccccgagctgtccccccccccccccattccttccgcaccagctgctcgctcgctctagagttccctcgcggtccggtccagaaagatcgagctcctgcagccatggcggctcccctgcttctcctgctgctactggccatgttcgcaggctcagatgcggcgttctgcgtgtgcaagccgggcacccccgacgcgatgctgcagaaggcgatcgactacgcctgcagcaagggcgccgactgcgcccagaccacgcagggcgggccgtgctacggcaacggcaacaaggtggccgtctgctcctacatctgcaacagctacttccagagcaggagctccatgggcgccacctgcgacttcggcggcgtcgccaccctcaccggcaccgaccccagcaccggcacctgcaagttcgcctccggccccaggtaagaccgaaccggcctcctcgcttccatctccgccaccgatgcacatagtagtgttaggaatctgggaagtcgagtatcctaagcaggacgcggtatatttggcatactttaatcgggttattggcctcaaagtttcagattctgtacatgggggaacgcacggccgtgcacagtcaagtcacacagataacattagtctaaactcaggccttgaataatgttacattccagtcaccaggacacaagaagtagtgctgctcgagtacacgagctcgaatatcatgcagcaagttgcaagcttgcaatgccaaccagtacacaagaagtagtgctgctcgagtacacgagctcgaatatcatgcagcaagttgcaagcttgcaatgccaaatcagaacaaaagaattctaaaaagcgtccaactttagccgcagcagcagtgtattgttcccggcatcgagttctttgcccatgtgaaagtaaagggcatctgaaacggatcctccggtccgagctttaaagcaagcccgctggccggggtccctctccgccccgcgttaaccaaaggacactgaacctgctggagcctggaccccaagttgcaccggtgtcgatgcatccgcggttcatccgtttactcgaagagctctctttttgccaagcaaagcatgcggatatccccagatttttcggtgcacgatagctaataaagcgtggctctttcatgcgactaacgtttcctgctcttgattcgtgctgcagcagcgttggcaccggcggcggcggcatgggcaccggcggggcaggcgccggcaccggcaccggcggcggcatgggcgccggcgcgggcacaggaggagcaggcaccggcgctggcactggagcgggcactggtggcatgggcgcggggaccggggctgacgctggcatcggcactggagcaggcacgggcacggggatcacgacccccgggagcag

SEQ ID NO: 27138 - protein, 109 aa, Panicum virgatum
  misc_feature: Ceres CLONE 1875155
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50404
  misc_feature: Useful for making plants with altered carbohydrate content
  misc_feature: Functional homolog of the protein sequence given in SEQ ID NO 50405
  misc_feature: Useful for making plants with altered alkaloid content
MAAPLLLLLLLAMFAGSDAAFCVCKPGTPDAMLQKAIDYACSKGADCAQTTQGGPCYGNGNKVAVCSYICNSYFQSRSSMGATCDFGGVATLTGTDPSTGTCKFASGPR

SEQ ID NO: 27139 - DNA, 642 bp, Panicum virgatum
  misc_feature: Ceres CLONE 1875155-R
gagcccaccgttcggcggcacgggcgcgtacggcccggtaggccccgactacaacggcgccgccgccccgatcgtggccgggcgccacgtcgccgccgcgcttctccttgccgccgcggcgcccctccttttccgctgagccgccggcgcgcgctgccatcccttgaagaggcagcagcgggttccgcgggcacgcctgccggcgccgctttggccgctgccgcgcgcgcctttccgggcctgctgggttttgatcgaccacaagccatcggtgtggtagccggattgtagccactggcacgggctgctaccaccatcccaactgacctcgtgctggtggccgccatgtggtgctctgtactggtagagatctaggggattcttttgtagttccggacatacgtgtcgccgtgttcgcccgtcccttctttttttttcctttttctggtttgttgctatgccctgttatgtcatgctattgctaggctgtgttgggattcttttgtagttccggacatacgtgtcgccgtgttcgcccgtcccttttttttttcctttttctggtttgttgctatgccctgttatgtcatgctaggctgtgttactgtactatgctagttgttcgtggcggcggccactttc

SEQ ID NO: 27140 - DNA, 443 bp, Panicum virgatum
  misc_feature: Ceres CLONE 1875159
  misc_feature: Encodes the peptide sequence at SEQ ID NO. 27141
accagcctcccaagcctccgcctccccactgcctcctccgccgccgcgcgccgcagacgtccggcgtccagtcctccttctccatggtctcccccagctctgccgtcttccaggtgattgttggtgccgtcggtggcggcgcgatgatcagtggaggtgctgctgttggtggtgcggctgcctcaggtggtggtgcggctgaggcccccaaggaggagaagaaggaagaggagaaggaagagagcgacgatgacatgggtttctccctgttcgactagattatttagctcccataagtggtggtttggtcctattgcggtacttaattttgctgtcttgttgccacgagccagtggcttgtgaacctgtaaactctgttaaattggtacaagcgacccggagttcccagttcatgtgaggatttggctatgttgtttagaatc

SEQ ID NO: 27141 - protein, 91 aa, Panicum virgatum
  misc_feature: Ceres CLONE 1875159
  misc_feature (19)..(90): Pfam Name: Ribosomal_60s Pfam Description: 60s Acidic ribosomal protein
QPPKPPPPHCLLRRRAPQTSGVQSSFSMVSPSSAVFQVIVGAVGGGAMISGGAAVGGAAASGGGAAEAPKEEKKEEEKEESDDDMGFSLFD

SEQ ID NO: 27142 - DNA, 609 bp, Panicum virgatum
  misc_feature: Ceres CLONE 1875185
  misc_feature: Encodes the peptide sequence at SEQ ID NO. 27143
aaagataagccacgccccacatgatcatcagctcacctctctctcacctggtggcctttcttcccctccaggcctccaccccacaagtcgagaacaagaagcatatagctctaactactctgacagccagccagctgcctgcaggtgatcgaacagcaaaaggggaggagccctcaacgaccatcacctggcctgctagaggcaaaggcagcaggatgtcggactggggccccgtggtgatcgcggtggtgctgttcgtgctcctctcgccggggctgctcttccagctccccggccgctgcagcttcgtcgacttcggcaacctgcacaccagcgccgcctccatcgtcgtccactccatcatcttcttcgcgctcatcaccatcttcgtcatcgtcgtcggggtgcacatcaccacaggcgaccagtctgcctactagctactggcatgctgatccaatggctcctccgatcctttcctggtcctccaatgtagccacgcagtcttacgattctgcttctgtttctcaattgttcctcctttctttctttgcatccatggcgctctctgtccttcagaaatatacataataaactgcttcttttctc

SEQ ID NO: 27143 - protein, 74 aa, Panicum virgatum
  misc_feature: Ceres CLONE 1875185
  misc_feature: Functional homolog of the protein sequence given in SEQ ID NO 50117
  misc_feature: Useful for making plants with altered cell wall content and/or composition
MSDWGPVVIAVVLFVLLSPGLLFQLPGRCSFVDFGNLHTSAASIVVHSIIFFALITIFVIVVGVHITTGDQSAY

SEQ ID NO: 27144 - DNA, 1984 bp, Panicum virgatum
  misc_feature: Ceres CLONE 1875226
  misc_feature: Encodes the peptide sequence at SEQ ID NO. 27145
aggtgattccaaatcacctccctcactttctctctctctcttcaccccttcctctcccccgcgcgggctgctctcccccttccccattcacactgcggagctcccacagcaacctcccccatagccattggcgccctcaatccattctgagctccaaacctcaggagccatcaccccaggaggatccgaatccatgcccccactaccttcactccgctgccactctcctgcattgctataaaatccgctgcatcttggctccggctcatctaatccgccaaggagccatggctggagcgcccaaatccaccggcattgccctcttccccctgctgctgctcgcagcagccgccgccgcctcggcgctccccgagctcaactcctcggtccccgaccccgccaccgtcgtcgccgacttccacaggtacggcgtctttcgacaaggtggcctcgtcgcggcggcggatgcaggaggccggcggcggcggcggcgggtgcatgacgggcaaccccatcgacgactgctggcggtgcgcgggcacggactggcgccaggaccggcagcgcctggcggactgcggcatcgggttcggccgcaacgcgctgggcggcaagggtggcccgctgtacgtggtgacggattcctccgacggcgaccccgtgaaccccgccccaggcacgctccgccacgccgccatccaggagggccccctctggatcgtgttcgccgccgacatgaccatccgcctgcgcgaggagctcctggtgaacagctacaagaccatcgacgggcgtggcgcgcgggtgcacatcggcgccggcggtgcgtgcatcacgctgcagtacgtgtcgaacgtgatcatccacaacgtgcacgtccacgactgcgtcccggcgggggacgccaacgtgcggtcgtcgccgacgcactacgggtggcggacgcggtcggacggcgatggcatctcgctgttcggcgcgcgggacgtgtgggtggaccactgcgcgctgtggcggtgcgccgacgggctggtggacgccatcatgggctccacggccatcaccgtctccaacagctacttcgcgcaccacgacgaggtgatgctgctgggcgccagcgacgcgtacctgccggactcggcgatgcaggtgaccatcgccttcaaccgcttcggcccggggctcgtgcagcggatgccgcgctgccggaggggctacttccacatcgtcaacaacgactacacgtcgtgggagatgtacgccatcggcggcagcgccagccccaccatcaacagccagggcaaccgctacatcgcccccgccgacccgaacgccaaggaggtgacgaagcgggtggacacggcggaggggcagtggtccgggtggaactggcggacggagggcgacatgatggttaacggcgccttcttcgtgccctccggcgagggcatggaggagatctacgacaaggcgtccagcaccgaccccaagtcctcggcgctcgtcgacgcgctcacgcagaacgccggcgtcctcggcgaccccaggaacgacgccgcggagaccggctacgcgggcgtcaactacgccggagttgggaacgggcgtggcggcggcggcggcgacgggtacggctacctcgggatgatctacgccaacggcgccggtcggggacgcagagcgctgtcgacgctgcagctggtttctccggtgatcaccctcgtcgcgctcggatgcttgcgcttgttgtgacacacgctcggctgagatgctttgtcaagattcaattggaaagttagtaggaaagggggagggaaaaaggaagcagtagtagggaaggggggaggtagtcacttgtcaggtaggcaacagtgatgaccacagcaaccacagccatgttaagttgcacatggctggggcatattgcatggaaatggaatgtagtcactgtagttatttacaaaggggaatggatgattcattc

SEQ ID NO: 27145 - protein, 428 aa, Panicum virgatum
  misc_feature: Ceres CLONE 1875226
  misc_feature (96)..(282): Pfam Name: Pec_lyase_C Pfam Description: Pectate lyase
  misc_feature: SWISSPROT Homolog: EC 4.2.2.2 Pectate lyase
  misc_feature: Functional homolog of the protein sequence given in SEQ ID NO 50645
  misc_feature: Useful for making plants with altered carbohydrate content
  misc_feature: Functional homolog of the protein sequence given in SEQ ID NO 51238
  misc_feature: Useful for making plants with altered cell wall content and/or composition
  misc_feature: Functional homolog of the protein sequence given in SEQ ID NO 50644
  misc_feature: Useful for making plants with modulated phosphate use efficiency
MQEAGGGGGGCMTGNPIDDCWRCAGTDWRQDRQRLADCGIGFGRNALGGKGGPLYVVTDSSDGDPVNPAPGTLRHAAIQEGPLWIVFAADMTIRLREELLVNSYKTIDGRGARVHIGAGGACITLQYVSNVIIHNVHVHDCVPAGDANVRSSPTHYGWRTRSDGDGISLFGARDVWVDHCALWRCADGLVDAIMGSTAITVSNSYFAHHDEVMLLGASDAYLPDSAMQVTIAFNRFGPGLVQRMPRCRRGYFHIVNNDYTSWEMYAIGGSASPTINSQGNRYIAPADPNAKEVTKRVDTAEGQWSGWNWRTEGDMMVNGAFFVPSGEGMEEIYDKASSTDPKSSALVDALTQNAGVLGDPRNDAAETGYAGVNYAGVGNGRGGGGGDGYGYLGMIYANGAGRGRRALSTLQLVSPVITLVALGCLRLL

SEQ ID NO: 27146 - DNA, 649 bp, Panicum virgatum
  misc_feature: Ceres CLONE 1875231
  misc_feature: Encodes the peptide sequence at SEQ ID NO. 27147
caacgatctccacaatgaaattgagtctgctccaagctcttcgcttgttgggccaacatcagccagctttcaaccgtcaacaccaacattgcaaacatttcctggacatgtcaaagaggaactttgtccagctgcattccctagccctaatgggcagcaagccacggttgaagtcaggatgagggaggggcatgcagtcaatatccacatgttctgcgcgcgtaggccaggcatcctgctgtccacaatgacggccctggatggcctgggtctcgacattgagcaggcggtcatcagctgcttcaatgggtttgcaatggatgtcttccgagctgagcaatgcggggatggtcctggactcgtgcctgatgaaattaaggccgtgctgctgcacactgctggtctgcagaacgcaatgtagctagtctgaaaacaaaggcttcgattcggaagcggcaaagctgtgctgttcatcggtttctggttcaagtaatgagatgatgctcgccatctagggaaatgagttatgatgtaactatggattttctttcgtttactttcggttttctctttggtactgtgatgtaggaaaatctatgtcgtgtgtcaaacaatctgttggatggtgatgggataatcagattcagac

SEQ ID NO: 27147 - protein, 139 aa, Panicum virgatum
  misc_feature: Ceres CLONE 1875231
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: The sequence is a functional homolog of SEQ ID NO 148 in the 10/225,068 US patent application
  misc_feature: The sequence is a functional homolog of SEQ ID NO 216 in the 10/374,780 US patent application
  misc_feature: The sequence is a functional homolog of SEQ ID NO 228 in the 10/225,066 US patent application
  misc_feature: The sequence is a functional homolog of SEQ ID NO 56 in the 10/286,264 US patent application
  misc_feature: The sequence is a functional homolog of SEQ ID NO 714 in the 10/412,699 US patent application
  misc_feature: The sequence is a functional homolog of SEQ ID NO 862 in the 11/435,388 US patent application
  misc_feature: Functional homolog of the protein sequence given in SEQ ID NO 51092
  misc_feature: Useful for making plants with modulated cold sensitivity
  misc_feature: Functional homolog of the protein sequence given in SEQ ID NO 51091
  misc_feature: Useful for making plants with altered lignin content
NDLHNEIESAPSSSLVGPTSASFQPSTPTLQTFPGHVKEELCPAAFPSPNGQQATVEVRMREGHAVNIHMFCARRPGILLSTMTALDGLGLDIEQAVISCFNGFAMDVFRAEQCGDGPGLVPDEIKAVLLHTAGLQNAM

SEQ ID NO: 27148 - DNA, 2313 bp, Panicum virgatum
  misc_feature: Ceres CLONE 1875239
  misc_feature: Encodes the peptide sequence at SEQ ID NO. 27149
aaacgggctagctctctctgtcacgcacgcacgcgcccacctgaccgccgcggccatgggttctccgttggcttcctggccatgggcgagcctcggctcctacaagtacctgctgtacgggcccctggcggcgaaggtggcgcacgcgtggagggagacggggagcccgccgctgggctcgtggtgcctccacctgctggtcctcctggcgctccgatcgctcaccttccagctctggttctcctacggcaacatgctcttcttcacccgccgccgccgcgtcgtcaaggacggcgtcgacttccgccagatcgacgccgagtgggactgggataacatggtgatcctgcagaccctgatcgcggccatggtggccaacaacccgtcgttcccgggcgtggcggagctccgcgcgtgggacccgcgcgggtgggccctggccctgctcctgcacgtgaccgtcgcggagccggccttctactgggcccacagggcgttccactggggcccgctcttcaggcagtaccacgccaagcaccactcgtccccggtcacccagccgctgacggccgggttcggcacgccgctggaggcgctggtcctgacggcggcgatgggggccccgctggcgggcgccttcgccgccggcgccgggtccgtgagcctcgtctacggccacgtcctcctcttcgactacctccggtgcatggggtacagcaacgtggaggtcatctcccacaaggccttcgccgccgtccccgcgctcagatacctcatctacaccccaacgtatttaagcctgcatcacagggagaaggacagcaacttctgcctgttcatgccgctgttcgacgccctcggagggaccatcaacgccaagtcctgggagcttcagaaggaggtcgaccaaggcatgaacgaccgggtgccggacttcgtgttcctggcgcacgtcgtggacgtggtgtcgtcgatgcacgtgcccttcgcgttccggtccaacagctcgctgcccttcgcgacccgcctcgtgctgctgccgctctggcccgtcgccttcgccttcatgctcatccagtggttctgctccaagaccttcaccgtcagcttctacttcctccgcggccggctccaccagacctggagcgtccccagatacggcttccagtacttcattccgtcggcgaagaagggcatcaaccggcagatcgagctggccatcctgagggcggataagatgggcgtcaaagtgatcagccttgctgcgctcaacaagaacgaggcgctcaatggcggcggcacgctgttcgtgagcaagcaccccaacctgcgggtgagggtggtgcacggcaacaccctgacggccgccgtgatcctcaacgagatccccagcaacgtgaaggaggtgttcctcaccggcgcgacgtccaagctcggcagggccatcgcgctctacctctgccggaagaagatcagggtcctgatgctgacgctgtcgacggagaggttcctgaagatccagagggaggcgccgcccgagtcccagcagtacctcgtgcaggtcaccaagtaccaggcggcgcagagctgcaagacatggatcgtgggcaagtggctgtcgccgcgggagcagcggtgggcgccgccgggcacccacttccaccagtttgtggtgccgcccatcatcggcttccgacgggactgcacctacggcaagctcgccgccatgaggctccccaaggatgtcgagggcctcggctcctgcgagtacacgatggagcgcggggtggtgcacgcgtgccacgccggcggcgtggtgcactgcctggaggggtgggggcaccacgaggtgggcgccatcgacgtggaccggatcgacgtcgtgtggaaggcggcgctcaagcacggcctcacgccggcgtgagcggacggcggcgcggcgccggccggaataacgcgtcgtctatttgtttctcgctcctgtgtcggggacgggtgggtgtgttaccgtgtaccagccgcggcagagctgatgacctctgcttcgctcacatatatactactggtatttacgtgcggtataccgcaagaaacatttgggctggcacgtcgcggcatgggttccgtttgggcacgtaggttggtcggaatgggtcgacccaaaccctgaccaactctcggctggtacttacggtaacggtcgagcctgaagcactggtgccaagagtcataaattaaatggtgccaaacaggtgtttttttgcgataagggaagatatattaatgtgaagcacagtacatccctccttttac

SEQ ID NO: 27149 - protein, 622 aa, Panicum virgatum
  misc_feature: Ceres CLONE 1875239
  misc_feature (130)..(252): Pfam Name: FA_hydroxylase Pfam Description: Fatty acid hydroxylase
  misc_feature: Functional homolog of the protein sequence given in SEQ ID NO 50972
  misc_feature: Useful for making plants with modulated nitrogen use efficiency
MGSPLASWPWASLGSYKYLLYGPLAAKVAHAWRETGSPPLGSWCLHLLVLLALRSLTFQLWFSYGNMLFFTRRRRVVKDGVDFRQIDAEWDWDNMVILQTLIAAMVANNPSFPGVAELRAWDPRGWALALLLHVTVAEPAFYWAHRAFHWGPLFRQYHAKHHSSPVTQPLTAGFGTPLEALVLTAAMGAPLAGAFAAGAGSVSLVYGHVLLFDYLRCMGYSNVEVISHKAFAAVPALRYLIYTPTYLSLHHREKDSNFCLFMPLFDALGGTINAKSWELQKEVDQGMNDRVPDFVFLAHVVDVVSSMHVPFAFRSNSSLPFATRLVLLPLWPVAFAFMLIQWFCSKTFTVSFYFLRGRLHQTWSVPRYGFQYFIPSAKKGINRQIELAILRADKMGVKVISLAALNKNEALNGGGTLFVSKHPNLRVRVVHGNTLTAAVILNEIPSNVKEVFLTGATSKLGRAIALYLCRKKIRVLMLTLSTERFLKIQREAPPESQQYLVQVTKYQAAQSCKTWIVGKWLSPREQRWAPPGTHFHQFVVPPIIGFRRDCTYGKLAAMRLPKDVEGLGSCEYTMERGVVHACHAGGVVHCLEGWGHHEVGAIDVDRIDVVWKAALKHGLTPA

SEQ ID NO: 27150 - DNA, 711 bp, Panicum virgatum
  misc_feature: Ceres CLONE 1875246
  misc_feature: Encodes the peptide sequence at SEQ ID NO. 27151
atcctccgcgttcgagatcgtgagcgctagagagagacagaggaagagagaggagggagcgaagcaaccatgccgacgggtaggctgagcggcaacatcacccaggactgggagccggtggtgctgcggcggacgaagccgaaggcggcggacctcaagtcggcgaaggcggtgaaccaggcgctgcgctcgggcgcggccgtggagacggtgcggaaggcggcggcgggcacgaacaggcacgccgcggcgccggcggcgcccgcgcggaagctggacgagacgacggagcccgcggcggtggagcgggtggccgcggaggtgcgcgcggcgatccagagggcgcgcgcggccaaggggtggagccaggcggagctggccaagcgcatcagcgagcgcgcgcaggtggtgcaggagtacgagagcggcagggcggcgcccgcgcaggccgtgctcgccaagatgtagcgcgcactcgaggtcaagctccggcggcggcaagtgatcgatgcggtggccctgtgcagaccggaacgggtcgatggattaacctctttcggctcgtggagggtgcgaatcggcggcgaatcggatgtgtagtttgttcgtgttgtgatcggcttggaagacttgggggggatgcaatcagtagtaacgcgtgcgctagtgatttccagaaattttcttgtgtttgtggtgatcgcttggaag

SEQ ID NO: 27151 - protein, 132 aa, Panicum virgatum
  misc_feature: Ceres CLONE 1875246
  misc_feature (12)..(81): Pfam Name: MBF1 Pfam Description: Multiprotein bridging factor 1
  misc_feature: Functional homolog of the protein sequence given in SEQ ID NO 51239
  misc_feature: Useful for making plants with altered alkaloid content
  misc_feature: Useful for making plants with modulated drought sensitivity
  misc_feature: Useful for making plants with modulated heat sensitivity
MPTGRLSGNITQDWEPVVLRRTKPKAADLKSAKAVNQALRSGAAVETVRKAAAGTNRHAAAPAAPARKLDETTEPAAVERVAAEVRAAIQRARAAKGWSQAELAKRISERAQVVQEYESGRAAPAQAVLAKM

SEQ ID NO: 27152 - DNA, 591 bp, Panicum virgatum
  misc_feature: Ceres CLONE 1875280
  misc_feature: Encodes the peptide sequence at SEQ ID NO. 27153
tcttccccggtctcctgccaggaaccgcgcgcaccactcttctcctctccaacgatgcaggcggcggcggcggcggcggagtgcgcgcctggcccctccccctctcaccacctcctcctcgcctgcctccttcagggggggggttgcgtccacggccgtgccggcttctcccgcgcccacgctggccgccacgaccgcgcccctgcgccgtcggacgcggcagccagctctggttcaagctgttgcctacccccaccctgctatccatctgccgctgactgctgaaaatgttgagatggttttggatcaagtaaggccatatcttatggcagatggaagaaatgttgcattgcgtgacattgactgcaatgtcctgaggttaaagctgccaggagcatgtggctcatgcccggcttctttaacaacgataaagatggatatcgaccgatccttagaggagaaaataccacatattgtaccaattgaacctctcactgatgatgagactgggcttgacttgaccctagataacattgaacatgtacttgatgacattaagccgtaccttgctggtgcatgaggtggctagct

SEQ ID NO: 27153 - protein, 192 aa, Panicum virgatum
  misc_feature: Ceres CLONE 1875280
  misc_feature (97)..(164): Pfam Name: NifU Pfam Description: NifU-like domain
LPRSPARNRAHHSSPLQRCRRRRRRRSARLAPPPLTTSSSPASFRGGVASTAVPASPAPTLAATTAPLRRRTRQPALVQAVAYPHPAIHLPLTAENVEMVLDQVRPYLMADGRNVALRDIDCNVLRLKLPGACGSCPASLTTIKMDIDRSLEEKIPHIVPIEPLTDDETGLDLTLDNIEHVLDDIKPYLAGA

SEQ ID NO: 27154 - DNA, 637 bp, Panicum virgatum
  misc_feature: Ceres CLONE 1875282
  misc_feature: Encodes the peptide sequence at SEQ ID NO. 27155
gcgagatcgagcaggatcactcaagccaagcagcagcagcagcaagcctcttgcagagtgtggagcagagcaccaactccgcgcacgcatgggatccttgggccctaccgtgaccgtgagcatggccaagcccaacgccgcggcggccggcggcggccatcagccgccggagaggaaggagggtggcggcaggtgcggcgtgctcggcggcggcggcggctgcggctgcggctgcggcttccggatgccgctgcactacccgcggtacaagaaggaggactacaaggccatgccggagtggcgcgtcgactgcctgctccgcgagtacggcctccccgccgacagcgacctcgacagcaagcgccgcttcgccatgggcgccttcctctggcccgaccagtactgaaccgtgggaggaagctcgccgccgccggccgttccgacaatgagctgcagctgcaggcagcttcagtgattacatatagcgatagcaacctgattgtgtcgtcgatcatcacactcactttactatttagaaagagatcctcttaacctaccatcatctgcttgtaatagccggacatgacacagaggcggtgaatgcatatgtttcttgcgccctgtatagctatggcgg

SEQ ID NO: 27155 - protein, 105 aa, Panicum virgatum
  misc_feature: Ceres CLONE 1875282
  misc_feature: Functional homolog of the protein sequence given in SEQ ID NO 50167
  misc_feature: Useful for making plants with modulated nitrogen use efficiency
MGSLGPTVTVSMAKPNAAAAGGGHQPPERKEGGGRCGVLGGGGGCGCGCGFRMPLHYPRYKKEDYKAMPEWRVDCLLREYGLPADSDLDSKRRFAMGAFLWPDQY

SEQ ID NO: 27156 - DNA, 648 bp, Panicum virgatum
  misc_feature: Ceres CLONE 1875286
  misc_feature: Encodes the peptide sequence at SEQ ID NO. 27157
gctctctctctctctctctctctctctctctggatacaacaacagggaactagagccatggctgctccgaagaagacgatgagagccctgcagtacgacaagtatggcggaggtgcagaaggtctcaagcatgtggaggtgccggtcccgtcgccgaagaagggggaggtgctgctcaagctggaggcggccagcatcaaccctatcgactggaaaattcagaagggcatggtccggcccttccttcccaggaagttccccttcataccagttggagacatgtctggcgaagtcgtcgagctgggcagcgatgtgaccgacctcaaaccaggcgacaaggtcatctccatcagcttcccgactggcggcgggctcgcggaatacgcggtggcgccggcgtcgcttacggtggcacggccgccggaggtgtccgcggccgaaggcgcctctctgccgacggccgcgtccaccgcgctccagcagctgaaggccgcgggggtcagcagcttcgacgggtccggcagcagcaacggccccaggaacgtgctggtcaccgcgtcctccggcggcgtcggccactacgccgtgcagctggccaagctggcggggctccacgtgacggccacctgcggcgcgcgcaacctgggc

SEQ ID NO: 27157 - protein, 196 aa, Panicum virgatum
  misc_feature: Ceres CLONE 1875286
  misc_feature (35)..(120): Pfam Name: ADH_N Pfam Description: Alcohol dehydrogenase GroES-like domain
  misc_feature: SWISSPROT Homolog: EC 1.6.5.5 NADPH:quinone reductase
MAAPKKTMRALQYDKYGGGAEGLKHVEVPVPSPKKGEVLLKLEAASINPIDWKIQKGMVRPFLPRKFPFIPVGDMSGEVVELGSDVTDLKPGDKVISISFPTGGGLAEYAVAPASLTVARPPEVSAAEGASLPTAASTALQQLKAAGVSSFDGSGSSNGPRNVLVTASSGGVGHYAVQLAKLAGLHVTATCGARNL

SEQ ID NO: 27158 - DNA, 746 bp, Panicum virgatum
  misc_feature: Ceres CLONE 1875300
  misc_feature: Encodes the peptide sequence at SEQ ID NO. 27159
atggccgccgcctcgctcctgtccaccgcgtgctcctttctccgccgcatccccgccgcgccgcacctttcccgctccgcacgcttcaagaggttcgaccgggttcgccggttctcgcccgccgccatgtcgacgccgtcggggccgaaggaggtgccgggtaataaccccggtctccacaccgagatcgaccccgccaccaagggctactttctgcagcagacgatgttacgtgtgaaagacccagaagtgagccttgacttctactcccgtgtaatgggcatgtcgttgctgaaaagattagattttgaagagttgaagttcagcttgtattttctcggttatgaggatgtggcttcagcccctgctgatcatatcaagcggactgaatggactttcaggcaaaaagctactctcgaactcacccacaactggggcacagaaagtgaccctgaattcaaaggttaccataatgggaattcagaccctcgtggttttggtcatataggagtaactgtggatgatgtctacaaggcatgtgagcgctttaaacgtcttggtgttgactttgtgaagaaacctgatgatgggaaaatcaaaggtattgcgttcatcaaagatcctgatggctactggattgagatttttgaccacaccatcgggacggtgactgcttcagcatcatgaggtgttgtggttcagatattctggaggctttgtgttcaggtttagcatgctataatgcc

SEQ ID NO: 27159 - protein, 186 aa, Panicum virgatum
  misc_feature: Ceres CLONE 1875300
  misc_feature (29)..(173): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MSTPSGPKEVPGNNPGLHTEIDPATKGYFLQQTMLRVKDPEVSLDFYSRVMGMSLLKRLDFEELKFSLYFLGYEDVASAPADHIKRTEWTFRQKATLELTHNWGTESDPEFKGYHNGNSDPRGFGHIGVTVDDVYKACERFKRLGVDFVKKPDDGKIKGIAFIKDPDGYWIEIFDHTIGTVTASAS

SEQ ID NO: 27160 - DNA, 2488 bp, Panicum virgatum
  misc_feature: Ceres CLONE 1875310
  misc_feature: Encodes the peptide sequence at SEQ ID NO. 27161
acgcaacgcagccgcgccgcacgccgacgccgccccgacctcccggtcccggaccctgacctcctctccccctctgctaccacagcccacgagcgcctaggcctcgcttcctccctccccgcccccgggcgcgcttctcaaggcgcgccgtcccccgaggcgacgacccgtccagtccaagggcggcggcgggggttgcgcgcgcgcgcgcgcttcgtcggtcggaggggtcggaggaggcgacccggcgcggagcggtgcgcgggtttcgtccgtccgtccgcccgcagccatggacggggagaggggggaggcgctggtggtggactccggcgagaagcgcctcaacgagctcgggtacaagcaggagctccgcagggagatgacgctgttcaagacgctggccatctccttctcgacgatgacgctcttcacggggatcacgccgctgtacgggaccagcctgcagtacgcggggccggcctccctcgtctggggctgggtcgtcgtctccttcttcacctggttcgtcggcgtcgccatggccgagatctgctcctccttcccgaccacaggctccctgtatttctgggctgcgcacttggccggtccagtatggggtccgttggcatcttggtgctgcgcttggctggaggcaattggcctcattgccggaattggcacacaggcatatgcaggatcccaggtactgcagagcatcattctactctgcaccggcaccaacacgggcggtggctacctggccccgcgctggctattcctggtcatgtacatcgggctaaccctgatctgggccgtgctcaacacctttgcgctcgaggtcatcgccttcctcgacgtgatctccatgtggtggcaggtgattggtggcaccgtcatcgtggtgatgctcccgctggtggccaagaccacgcagccggcgtcgtacgtgttcacccatttccagacggccccggaggtgaccgggatcagcagcagcgcctacgccgtcgtcctgtccttcctggtgagccagtactccctgtatgggtacgacgcggcggcgcacctgacggaggagaccaagggcgccgacaagaatggtcccatcgccatcctctccagcatcggcatcatctccgtctttgggtgggcgtacatcctcgcgctcaccttcagcatccaggacttcagctacctgtacgaccccaacaacgagacggccggcacgttcgtgccggcgcagatcctgtacgacgcgttccacgggcggtaccacagctcggtgggtgccatcgtgctgctcttcgtcatctggggctccttcttcttcggcgggctgtccatcacgacgagcgcggcgcgcgtggtgtacgcgctgtcgcgcgaccgcggcgtgcccctgtcgtccgtgtggcgccgcatccacccgcggcacaaggtgccggcgaacgcggtgtggctgtgcgcggcggtgtgcgcgctgctgggcctgccgatcctgcgcctcaacgtggtgttcacggccatcacgtccgtggccaccatcgggtgggtgggcggctacgccgtgcccatcttcgcgcgcatggtgatgcgggaggaggacttccggccggggcccttctacctgggcgccgccagccgccccgtctgcctcgtcgccttcctgtggatctgctacacctgcgccgtgttcctgctccccaccacgtacccgatcaagatggacaccttcaactacgcgcccatcgcgctcggggtctgcctcggcctcatcatgctctggtgggcgctcgacgccaggaagtggttcaagggccccgtcaggaacatcgacgaccacaacggcaacggcaaggtctgatcaacaagcacgtgatgccgcgagcgatcgaccggcgccggcgccatttttctctctctcttttcttggccccttgagtgcccatgatgatgacgctctccgggatgtagtagctccataaggaataggaaagagcacacaagaacaataggaatgggaggcatcgagaaagaacacaagcaaggtcttcacctctccaacactcgagagcgaggaggggaaggatcgccattaacactttctcgcatgttcccattcccttcactcttgcacgctctctttcttcctcttccctgatttgctgcatagccagcataggccatgctctcggcgagattctcaacaggtatacgtacagtataagcacatacgtgtgatttggcatctaggccctagtgcagggttcaagaatcaagaacgagactcgcatgaccgtgacatctaggctctagtgcagggttcaagaaatcaaaagtcaaacacgcacatgcaccgtgctgcgccgcaacatatacgtgtgtgtcgataaatttgtgcacacgatcagtgggatttagtttagactgtggtggtggtgacttgtgtgtggtacaagaggaaggaattacaaagggatttttg

SEQ ID NO: 27161 - protein, 524 aa, Panicum virgatum
  misc_feature: Ceres CLONE 1875310
  misc_feature (33)..(510): Pfam Name: AA_permease Pfam Description: Amino acid permease
MDGERGEALVVDSGEKRLNELGYKQELRREMTLFKTLAISFSTMTLFTGITPLYGTSLQYAGPASLVWGWVVVSFFTWFVGVAMAEICSSFPTTGSLYFWAAHLAGPVWGPLASWCCAWLEAIGLIAGIGTQAYAGSQVLQSIILLCTGTNTGGGYLAPRWLFLVMYIGLTLIWAVLNTFALEVIAFLDVISMWWQVIGGTVIVVMLPLVAKTTQPASYVFTHFQTAPEVTGISSSAYAVVLSFLVSQYSLYGYDAAAHLTEETKGADKNGPIAILSSIGIISVFGWAYILALTFSIQDFSYLYDPNNETAGTFVPAQILYDAFHGRYHSSVGAIVLLFVIWGSFFFGGLSITTSAARVVYALSRDRGVPLSSVWRRIHPRHKVPANAVWLCAAVCALLGLPILRLNVVFTAITSVATIGWVGGYAVPIFARMVMREEDFRPGPFYLGAASRPVCLVAFLWICYTCAVFLLPTTYPIKMDTFNYAPIALGVCLGLIMLWWALDARKWFKGPVRNIDDHNGNGKV

SEQ ID NO: 27162 - DNA, 616 bp, Panicum virgatum
  misc_feature: Ceres CLONE 1875314
  misc_feature: Encodes the peptide sequence at SEQ ID NO. 27163
gaaaccccaccaggcacagccgcaccaaccatggacgccggcggcgcacgtccatcggcaccgtcggccgccgccgccgccggggccggggccgggggcgcctccgtcgcggacgagccccgggacgcgcgggtggtgcgggagctcctgcgctcgatggggctcggcgagggcgagtacgagccccgcgtcgtgcaccagttcctggacctggcctaccgctacgtcggcgacgtgctcggggacgcccaggtctacgccgaccacgccgggaaggcccagatcgacgccgacgacgtccgcctcgccatccaggccaaagtcaatttctccttctcgcagccgccgccgcgcgaggaagtggttgttgaatgtcgtaagttgagggtttcgatgtgttaaaccagatgggctgctggtagttcccttggtcctattaaagcccttcatactgtagtgcaatcaagatgaagtagtcttctggtacctgacactgtgttaacagtctgcgcaaagactttgtaatttctttgtgatctcgtaatgagattcagattcgcctaatctggaaaaagaattgaaagcttactagtgttgtagtgaaacactggaactc

SEQ ID NO: 27163 - protein, 123 aa, Panicum virgatum
  misc_feature: Ceres CLONE 1875314
  misc_feature (21)..(114): Pfam Name: TFIID-31kDa Pfam Description: Transcription initiation factor IID, 31kD subunit
MDAGGARPSAPSAAAAAGAGAGGASVADEPRDARVVRELLRSMGLGEGEYEPRVVHQFLDLAYRYVGDVLGDAQVYADHAGKAQIDADDVRLAIQAKVNFSFSQPPPREEVVVECRKLRVSMC

SEQ ID NO: 27164 - DNA, 1410 bp, Panicum virgatum
  misc_feature: Ceres CLONE 1875326
  misc_feature: Encodes the peptide sequence at SEQ ID NO. 27165
atcgacccagcggcgactccccccgctcgctcgcttgcttgcgcggccgtggtcgtcgtcgcactcgcacgcactggccgtctggccgccagccacccagcgcccaatcccagcccggggacgggaccaatccagagtcccgacgaacgagcgagcgcacggcaggagcggttgcgtgcgctgcgctcgctttccccgaaacgtgacccgagcggcagaagaccagggagaagccgccatgaagcagcgccagctgcgacagcagctgcctcctactagtcccggtcctcgccgttaaatccagagccccccaagccccggttcctctcctcccgctcgcccccattccctgacccacaaccagaacacccagataagagattccgttccgtctccgtgagcgggcggccgccgggagcttgatgcgccaggggcggcggctccccccggtcgtttgatgggcaacgcatgcggcggcgcccttagatccaagcacctgcccagcttcaagcgcgccgcgtcgcagcgccaggactccgagtacagcgccgcagccgccgacgactcgccgaagaagcccgcctcccgcgcgcccacgccgcccgccaccacggacgcccacgcgggccacgcgtcggcgccgcccgccgccgggatgaggcgcggcggggcgggcgcgccgccggacgtcggctccgtgctcggccaccccacgcccaacctccgcgacctctacgcgctgggccggaagctcgggcaggggcagttcggcaccacctacctctgcaccgagctcgccacgggggtcgactacgcctgcaagtccatctccaagcgcaagctcatcaccagggaggacatcgaggacgtgcgccgcgagatccagatcatgcaccacctctccggccacaagaacgtcgtcgccatcaagggcgcctacgaggaccagctctacgtgcacatcgtcatggagctctgcgccggaggcgagctcttcgaccggatcatacagcgcgggcactacagcgagcgcaaggccgccgagctcaccaggatcatcgtcggggtcgtcgaggcctgccactcgctcggggtcatgcaccgggacctcaagcccgagaacttcctgcttgccaacaaggacgatgacctctcgctcaaggccatcgatttcgggctctctgtcttctttaagcccggtcaagtttttactgatgtcgttggtagcccatattatgttgctccagaagttttgtgcaaaagttatggaccagcagctgatgtatggacagccggtgtcattctctacattctgctaagtggtgtaccccctttttgggcagaaacacagcaagggatatttgatgctgtattgaaaagtgtcatcgattttgattctgacccctggcc

SEQ ID NO: 27165 - protein, 317 aa, Panicum virgatum
  misc_feature: Ceres CLONE 1875326
  misc_feature (93)..(317): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNACGGALRSKHLPSFKRAASQRQDSEYSAAAADDSPKKPASRAPTPPATTDAHAGHASAPPAAGMRRGGAGAPPDVGSVLGHPTPNLRDLYALGRKLGQGQFGTTYLCTELATGVDYACKSISKRKLITREDIEDVRREIQIMHHLSGHKNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQVFTDVVGSPYYVAPEVLCKSYGPAADVWTAGVILYILLSGVPPFWAETQQGIFDAVLKSVIDFDSDPW

SEQ ID NO: 27166 - DNA, 642 bp, Panicum virgatum
  misc_feature: Ceres CLONE 1875326-R
  misc_feature: Encodes the peptide sequence at SEQ ID NO. 27167
agaaatgttccagaccatggacactgataacagcggtgcaattacatatgatgagctaaaagaaggattgagaaaatatggctccacactaaaggatactgagattcgtgatcttatggatgcagccgatatcgacaacagcgggacaattgactatattgaattcattgctgcgacgttgcatctcaataagctggaacgtgaggaacatctcgtggcagccttttcatatttcgacaaagatggtagtggctacatcacagtggatgaactgcagcaagcttgcaaagagcataacatgccagatgcttttcttgatgatgtcattaacgaagcagatcaggataatgatggccgcattgactatggagagttcgttgccatgatgaccaagggcaatatgggagtcggtcgaagaacaatgagaaacagcctgaatatcagcatgagggacgcacctggtgcattctagagacttaacacgatgtacagcttgtggcttagcttcttgtcttgctgccctccgaagccttctgcaatttttcaaaatgttgttaattatctgtgtggatgtgtttttctgggaattacgattcaactcttgtgattgattccatgaaatgcataacatgtccatgtcag

SEQ ID NO: 27167 - protein, 156 aa, Panicum virgatum
  misc_feature: Ceres CLONE 1875326-R
  misc_feature (104)..(132): Pfam Name: efhand Pfam Description: EF hand
  misc_feature (70)..(98): Pfam Name: efhand Pfam Description: EF hand
  misc_feature (34)..(62): Pfam Name: efhand Pfam Description: EF hand
  misc_feature: SWISSPROT Homolog: EC 2.7.11.1 Non-specific serine/threonine protein kinase
EMFQTMDTDNSGAITYDELKEGLRKYGSTLKDTEIRDLMDAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 27168 - DNA, 529 bp, Panicum virgatum
  misc_feature: Ceres CLONE 1875327
  misc_feature: Encodes the peptide sequence at SEQ ID NO. 27169
acccaccacccgcagcaagaccaccaattaggaggctgcagccgctcgcctccacctccgctcacatcactgaggattagtgcgtcgttgcgctgcgcaccaacaagagcaattgaggcaaggaaaatggcggcggcgtccctcacgttcgcggagcggaggaaggcgggggagctggtggccccggcggcgccgacgccgagggagctgaaccggctctcggacatcgacgaccaggacggcctaccgctccacatccccgtcatccagttctaccgccggagcgcgatggacggggcgcgggaccccgcgccggtgatccgggccgccgtctcccgggcgctcgtgcactactacccgttcgccggcaagctccgggagctcgagggccgcatgctcgccgtggactgcaccagggagggcgtgctgttcatcgaggcctacacgaacgtccgcctcgagcacttcggggacgcgctgctgccgccgttaccgtgcctcgacgagctcatcttcgacgtccccggct

SEQ ID NO: 27169 - protein, 134 aa, Panicum virgatum
  misc_feature: Ceres CLONE 1875327
  misc_feature: SWISSPROT Homolog: EC 2.3.1.167 10-deacetylbaccatin III 10-O-acetyltransferase
MAAASLTFAERRKAGELVAPAAPTPRELNRLSDIDDQDGLPLHIPVIQFYRRSAMDGARDPAPVIRAAVSRALVHYYPFAGKLRELEGRMLAVDCTREGVLFIEAYTNVRLEHFGDALLPPLPCLDELIFDVPG

SEQ ID NO: 27170 - DNA, 2053 bp, Panicum virgatum
  misc_feature: Ceres CLONE 1875334
  misc_feature: Encodes the peptide sequence at SEQ ID NO. 27171
atcccaccgagcacacaaacaatacaattgaaaatctctctctctctgcgagcgaggactcaaggtgagccatggcggagctgccgctggcggcagggctgctggaccttcgacccagcaagttctcaccgaaaccacctccgccgctccctctcccgctccctgcgcgccgccgcacgcatgctaccgccgccgccgcggcggtcccgtcccctcgccgcgcggttcccgaactccactccaccaccgagctggcggatgggagcatcgtcttccgcttcggcccaccaaagcccgaagtgctggagccgcaggctgagccggcgagccatggtttgggagtggccgcagcgaccagccccgactccacagtctcccctgcctcgggcgctgccagcggcggcgagacggaaccgcagcctgactctgagcagggagtcaccggcgcgggatcgggcgccccgacagcggtccagcagtcgtgcccgaacgcctcagctgtggtttccctcgcacctccccctcctgacgccggtgccgcctccgccgcggatgaggaggaaccggaacagtcagcgggttccaatgccggtgttgaggaggcagaggctaggccggcctccgtcgaggcgattgcggccgccgaatctgagtatgagcgtgagggtgacggcgtcgcagttggggcaggcgtgctgacgagtggtgctgccgtggagacaacatggacaggtttggagctgcgcgaggggagcgaggatgcctcagccgctgatgtgagtggtggctgcgaggaggcgactgggatggctggtttggagggctctgaggccgcatcagaaggctccaccgctcacaatttcaacaccgacgttgagacggagtgcagcggctccagtggtgacgagcagggagccgagttcggggtccccctaccaacagaggaacaagttagcaaggaggtggattggggaaaaggcacttcagaagtgaaagattctgttaggatggttgaaatagcccgatcaacacttgtgttgtcgtcaggtgctgcaatcctgcctcatccttctaaggtagcaacaggaggggaagatgcgtattttattgcaggcaatggctggtttggtgtagcagatggagttggccaatggtcttttgaaggaatcaacgcggggctttatgcaagagaactaatggatggttgtaacaaattcgttagtgagaatcaaggaacttcagatcttagaccagagcaaatcctttctaaggcagcagatgaagcatgctctcctggttcttccactgtattagttgctcactttgatggtcaggtccttcaagcatcaaatatcggagactctgggtttttggtaataagaaacggagaagtgtatgagaaatcaaaacctatggtttatggtttcaattttccactacaaattgagaagggagatgacccctttaaacttgtacagaattatactattgatctagaggaaggtgatgtaattgtgacggcaacggatggccttttcgataatgtctatgagcatgaagtagctgcaattatctccaaatcgttgcaggcagatctaaaaccaatggagattgcggagcacttggctgcgaaggcccaggaagtgggtaggtctggaactgggagaagcccattttcagatgctgctctctcagttgggtaccttggtttcagtggaggcaaactggatgatatagctgttgttgtatcaatcgtccggacttcagagatttaagttatacaagactgactgatgcagaaaaaagaaactctcaagtaatgttgaagctgtactccaagctcgccccatcagcaatctagaagttaagcttgcatggtggtttcccaacagttcaacaagatgtaaacatgagcatcatacaccatgtttgatcagcaaacagccaacggccaacagtgctgcgagcaaagctcctccctgttgcccttgcatgcgttcagacagtattgtttttttttcttttgcttccgaaatataacaccatttagatg

SEQ ID NO: 27171 - protein, 567 aa, Panicum virgatum
  misc_feature: Ceres CLONE 1875334
  misc_feature: SWISSPROT Homolog: EC 3.1.3.16 Phosphoprotein phosphatase
MAELPLAAGLLDLRPSKFSPKPPPPLPLPLPARRRTHATAAAAAVPSPRRAVPELHSTTELADGSIVFRFGPPKPEVLEPQAEPASHGLGVAAATSPDSTVSPASGAASGGETEPQPDSEQGVTGAGSGAPTAVQQSCPNASAVVSLAPPPPDAGAASAADEEEPEQSAGSNAGVEEAEARPASVEAIAAAESEYEREGDGVAVGAGVLTSGAAVETTWTGLELREGSEDASAADVSGGCEEATGMAGLEGSEAASEGSTAHNFNTDVETECSGSSGDEQGAEFGVPLPTEEQVSKEVDWGKGTSEVKDSVRMVEIARSTLVLSSGAAILPHPSKVATGGEDAYFIAGNGWFGVADGVGQWSFEGINAGLYARELMDGCNKFVSENQGTSDLRPEQILSKAADEACSPGSSTVLVAHFDGQVLQASNIGDSGFLVIRNGEVYEKSKPMVYGFNFPLQIEKGDDPFKLVQNYTIDLEEGDVIVTATDGLFDNVYEHEVAAIISKSLQADLKPMEIAEHLAAKAQEVGRSGTGRSPFSDAALSVGYLGFSGGKLDDIAVVVSIVRTSEI

SEQ ID NO: 27172 - DNA, 2076 bp, Panicum virgatum
  misc_feature: Ceres CLONE 1875345
  misc_feature: Encodes the peptide sequence at SEQ ID NO. 27173
gttgccgccacgccgccgctgcccacctttcccctctccgccgcgaaaaccctagaaactacctaaccaccctgcgcgccgccatgtcgtccgcgacgccggccgtcgcgtcccccgcctccgagcattccaaatcgaagaagaagaagcacaagtcgaaggacgatcccgccgccgccgcggccgacccgccgtcgctcgctgaggcagaggagaagaccgacggctacctcatcaagccccagtccctggtgccgtccctcgacacctccacctggccgctcctcctcaagaactacgaccgcctcaacgtccgcaccggccactacaccccgctcccctccggccactcgccgctcaagcgccccctcgccgagcacctccgctacggcgtcatcaacctcgacaagccgtcgaacccctcctcccacgaggtggtcgcctggatcaagcgcatcctccgcgccgagaagaccggccacagcgggacgctcgaccccaaggtcaccggcaacctcctcgtctgcatcgaccgcgccacgcgcctcgtcaagtcgcagcagggcgccggcaaggagtacgtctgcgtcgcccgcttccacgccgccgtgccggacaccgcgcgcgtggcccgcgcgctggaggcgctcaccggcgcggtgttccagcgtccgccgcttatctctgcggtcaagcgtcagctcagggtgcggaccatctacgagagcaagctcctggagcacgaccccgagcgtcatctcgccgtgttctggatctcctgcgaggcaggtacctatgtccggactctctgtgtgcaccttgggctgctccttggagttggcgcgcatatgcaggaactgcgccgtgtcaggtcggggatcctcggggagcaagacaacatggtgaccatgcacgatgtgatggacgcgatgtggtcgcttgacaactacaaggatgagtcgtacttgaggcgtgttgtgatgccacttgaggtactgcttactagctacaaaaggcttgtggtgaaggactctgctgtgaatgctatatgctatggtgctaagcttatgatccctgggttgctccgatttgagaatgatattgagactggggaggaggtggttctcatgacaacaaagggtgaggcaattgctattggtattgctgagatgactactgctgtgatggccacatgtgaccatggtgcagttgcaaagatcaagagggtggtgatggacagagacacttacccgaggaagtgggggcttggcccggtggcactcaagaagaaaaagatgattgcggatggtctccttgacaagcatgggaagccaaatgagaagaccccggctgagtggcttcggaatgtggtgcttcccactggtggtgatgtttcgattgccagcattgcagctgctcctgagccagagaaggtgaaggtggaaccagaagcagccgtgactgaagaggtcaaggagaagaagaagaagaggcggaaggatgaggaggacactgatgcagatgcctctgttccttcaaagaagatcaaggttgaggaagctgctgaggcagtggagggagagaagagtgagaagaagaagaagaaaaagaaagacaagggtgaatcaggatcagctgaggttgtggaggtcaaggaggaggttgatgtggctgatgataagggcagtgagaagaaaaagaagaagaagaaaagcaaggagggaaatgatgctgttgatccagagagcactcaaaatggagatggtgcagaagctgagaagagtgagaagaaaaaggagaagaaaaagaagaagagtcgagatacagaggaatcgcaataggtgctgtttgtggcgacagtctatcttctctgtctggagttgcaggggaagcttgaaatctttttcttgcttgctttgtatctcttgcaactgtaatggctgatgtaccattcttaggttactactattctactattttgaactgctatgccaagtggtgatattttcattgaaactctcaacaatggctgtatttttgtttcagttatcagataatgcaatgggctttgctccc

SEQ ID NO: 27173 - protein, 585 aa, Panicum virgatum
  misc_feature: Ceres CLONE 1875345
  misc_feature (123)..(260): Pfam Name: TruB_N Pfam Description: TruB family pseudouridylate synthase (N terminal domain)
  misc_feature (61)..(119): Pfam Name: DKCLD Pfam Description: DKCLD (NUC011) domain
  misc_feature (310)..(383): Pfam Name: PUA Pfam Description: PUA domain
MSSATPAVASPASEHSKSKKKKHKSKDDPAAAAADPPSLAEAEEKTDGYLIKPQSLVPSLDTSTWPLLLKNYDRLNVRTGHYTPLPSGHSPLKRPLAEHLRYGVINLDKPSNPSSHEVVAWIKRILRAEKTGHSGTLDPKVTGNLLVCIDRATRLVKSQQGAGKEYVCVARFHAAVPDTARVARALEALTGAVFQRPPLISAVKRQLRVRTIYESKLLEHDPERHLAVFWISCEAGTYVRTLCVHLGLLLGVGAHMQELRRVRSGILGEQDNMVTMHDVMDAMWSLDNYKDESYLRRVVMPLEVLLTSYKRLVVKDSAVNAICYGAKLMIPGLLRFENDIETGEEVVLMTTKGEAIAIGIAEMTTAVMATCDHGAVAKIKRVVMDRDTYPRKWGLGPVALKKKKMIADGLLDKHGKPNEKTPAEWLRNVVLPTGGDVSIASIAAAPEPEKVKVEPEAAVTEEVKEKKKKRRKDEEDTDADASVPSKKIKVEEAAEAVEGEKSEKKKKKKKDKGESGSAEVVEVKEEVDVADDKGSEKKKKKKKSKEGNDAVDPESTQNGDGAEAEKSEKKKEKKKKKSRDTEESQ

SEQ ID NO: 27174 - DNA, 1420 bp, Panicum virgatum
  misc_feature: Ceres CLONE 1875367
  misc_feature: Encodes the peptide sequence at SEQ ID NO. 27175
catgtgaaaacctctcttcctcctttcccgtgcttctgtctgtcacacggatcgggtgggtgacctcgagctggaggaaaccgtgtttcgtgtgctgccttggctcctccgtttccttggagcggcgtctcgccgtcctgtctattgaagcttcccttcgcgatcgattctcatcaatcttgcatctctcttcgccgcaaatttaaagctttctttgtttggacttgtggaagcaataaatctcgaagcttccttagtctgattggttgctgggagttcagagagctgttgagatcttcgcaggctccgatcggcgcgccgggatggcgaatctagccgcgctgcgcccgtatctctgcttgctggcggcaatggcgtcggcggcgtcgtggtccggcgtcgggacggtggacgcgctggggatgaactggggcacgcaggcgacgcaccccctgtcgcccaaggtcgtggtgcagatgctcaaggacaacggcatcaagaaggtgaagctgttcgacgccgaccaggccacgctcagcgtgctcgccggcagcggcatcgaggtcatggtcgccattcccaatgtcctgctcgacaggatcaccgactacgataccgccaaggagtgggtccggcacaatgtctcgcgctacaacttcgacggcggcgtcactatcaagtacgtggccgtgggcaacgagccgttcctggcggcgtacaacggcacgttcgacaaggtgaccttcccggcgctgcagaacatccagaacgcgctggacgaggccgggctcggcgacagcatcaaggccaccgtccccctcaacgccgacgtgtacatgtccccggcggacaacccggtgccgtcggcggggcggtggcggcccgacatcgcggacctgatgacgcagatggtgcagttcctgagcaaccacagcgcgcccttcaccgtcaacatctaccccttcatcagcctcttcctcaacgacaacttccccgtggacttcgccttcttcgacggcggcgcgacgcccgtggtggacaacggcgtctcctacaccaacgtgttcgacgccaacttcgacaccctggtggcggcgctcaaggcgtcggggcacggcgacatgcccatcgtcgtcggcgaggtcggctggcccaccgacggcgacaagcacgccaccaccgcgtacgcgcagcgcttctacagcggcctcctccggcggctcgccgccaacgccggcacccccgtccggcccaaccagtacatcgaggtctacctcttcggcctcctggacgaggacatcaagagcgtggcgccgggcaacttcgagcgccactggggcatcctccggtacgacgggcagcccaagttcccgatggatctgacggggcagggccagaacgcgatgctggtgccggcgcg

SEQ ID NO: 27175 - protein, 365 aa, Panicum virgatum
  misc_feature: Ceres CLONE 1875367
  misc_feature (32)..(353): Pfam Name: Glyco_hydro_17 Pfam Description: Glycosyl hydrolases family 17
  misc_feature: SWISSPROT Homolog: EC 3.2.1.73 Licheninase
  misc_feature: Functional homolog of the protein sequence given in SEQ ID NO 51176
  misc_feature: Useful for making plants with altered carbohydrate content
  misc_feature: Functional homolog of the protein sequence given in SEQ ID NO 51240
  misc_feature: Useful for making plants with altered cell wall content and/or composition
MANLAALRPYLCLLAAMASAASWSGVGTVDALGMNWGTQATHPLSPKVVVQMLKDNGIKKVKLFDADQATLSVLAGSGIEVMVAIPNVLLDRITDYDTAKEWVRHNVSRYNFDGGVTIKYVAVGNEPFLAAYNGTFDKVTFPALQNIQNALDEAGLGDSIKATVPLNADVYMSPADNPVPSAGRWRPDIADLMTQMVQFLSNHSAPFTVNIYPFISLFLNDNFPVDFAFFDGGATPVVDNGVSYTNVFDANFDTLVAALKASGHGDMPIVVGEVGWPTDGDKHATTAYAQRFYSGLLRRLAANAGTPVRPNQYIEVYLFGLLDEDIKSVAPGNFERHWGILRYDGQPKFPMDLTGQGQNAMLVPA

SEQ ID NO: 27176 - DNA, 690 bp, Panicum virgatum
  misc_feature: Ceres CLONE 1875372
  misc_feature: Encodes the peptide sequence at SEQ ID NO. 27177
aacaccagtgacccagaccagggccggcgctccaccatctcggctcctcttttattcgcagccatgtcgggcagcgcaaatggtgcctccgccggcgctgctcacgtcgtgatgctcccgtagctcgccttcgggcacatcaccccgttcgcgcagctggcacgcaaactggtctccgccgacggcggtggcgtccgcgtgacgttcctgacggccgccgggaacgtgccgcgcgtcgaggccatgctggcgccgtcggccgcgggcgcggtggtggttgtgccgctccacctgccccacgtcccggggctggacgcgggggcctccagcacggcggagctctccgccgacggcgccgagcttctcaaggtcgccgtgatcatggacttcgccacgccgtgggtctacgacatcgccgcgccgctcggcctcaaggcgctccacctcagcgtcttctccgccactgcgggcgcttttaactgcgtccacgcgcgccgccaccacgggccgcacccgtccgcgcacgatctgcggtcggccccggccggcttcccggagggctcttcggtggcgaccatcccggcgtaccaggccgccgacctcacctacttgttcaccagcttcgacggcaagccgtgcgtctacgaccgtgtactggccagcatcgaggcgtgccatggcatcgtgatg

SEQ ID NO: 27177 - protein, 148 aa, Panicum virgatum
  misc_feature: Ceres CLONE 1875372
  misc_feature: SWISSPROT Homolog: EC 2.4.1.115 Anthocyanidin 3-O-glucosyltransferase
MLAPSAAGAVVVVPLHLPHVPGLDAGASSTAELSADGAELLKVAVIMDFATPWVYDIAAPLGLKALHLSVFSATAGAFNCVHARRHHGPHPSAHDLRSAPAGFPEGSSVATIPAYQAADLTYLFTSFDGKPCVYDRVLASIEACHGIV

SEQ ID NO: 27178 - DNA, 886 bp, Panicum virgatum
  misc_feature: Ceres CLONE 1875380
  misc_feature: Encodes the peptide sequence at SEQ ID NO. 27179
ctggcgtcgatcaccctctcctccgactcgcccagccgcccctgtcgctctcgtgctctcctcccgcttcaccgcaaaaccctagctccgctacatgcaccggggcgacgaccgttccggcggtccctcgggcggcggcgaccgctccggtggccggttccagcggggtccttcccgctggtcgggcggcggtggcggaggagcgggtagtccgccccatcgttactcctcgcgcagcgggggagatggcagtggtcgaggaggcagtggcggtggcgggaggtttcacccgtaccgtggctcttccgatttttctggtggcggcggtgtaggcgggggtggagggtacagaggcggcggtggggacgatttcggcgagcagaggcaacgctacggtggcggcaaccgtggtggaggccgtggggatttccaagatcatgatagcagaagtaattacgtcaaactttttgttgggtctgttccaaggacagcaactgaagaagatgtccgtcctttatttgaggagcatggagatgttcttgaagttgctttaatcaaggataggaagaccggtgaacaacaaggtgcactatgactttgtttttttcctcatattatcacaatgcaagtatctcttttgttttcaggtttctgagaggttataggagcaacaaggttgcatcttatctcagttagagttggtggttgttgattttcatttcctgcgcttccattctgttcgtctcctgtggattcagtagaagaccagaatggaagcaactaactgtccactgattactgtaacctaactagcctcaactctactgctacacaaggcagcagattcagtaccaaaaactgtgtttatatgatattgaccttctgg

SEQ ID NO: 27179 - protein, 166 aa, Panicum virgatum
  misc_feature: Ceres CLONE 1875380
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50180
  misc_feature: Useful for making plants with altered alkaloid content
MHRGDDRSGGPSGGGDRSGGRFQRGPSRWSGGGGGGAGSPPHRYSSRSGGDGSGRGGSGGGGRFHPYRGSSDFSGGGGVGGGGGYRGGGGDDFGEQRQRYGGGNRGGGRGDFQDHDSRSNYVKLFVGSVPRTATEEDVRPLFEEHGDVLEVALIKDRKTGEQQGAL

SEQ ID NO: 27180 - DNA, 700 bp, Panicum virgatum
  misc_feature: Ceres CLONE 1875384
  misc_feature: Encodes the peptide sequence at SEQ ID NO. 27181
acgatccgccggattaagtttgtgcacgtacgtactcgccggaacactagcaccgaccggtcatacacagcaccagccgtaccgccatggcctccctcgccgccgtctccgtgcagccggtcgccgtaaagggcctcgccggcagctccatctccggcaggaggctcgccgccgctaggccgtcgcgcgccggcgcctgccgctccgcccgcaggccccgcggcgccgccgtggtggccaagtacggcgacaagagcgtctacttcgacctcgacgacatcggcaacaccaccgggcagtgggacctctacggctccgacgcgccctcgccctacaacccgctccagagcaagttcttcgagacgttcgcggggccgttcaccaagaggggcctgctgcttaagttcctgctgctgggcggcgggtcgctgctggcctacgtcagcgcgtcggcgtcgccggacctgctgccgatcaagaaggggccgcagcagccgccgcagccggggccgcgcggcaagatctaagctcagttgttccttctcctccatctgtctctactagctgcttgcttgtaccaccactggctccggacgccatggatcgtcgtccctgctgcctgttgtgctgctgatatttgatcgcgctgcctgtttatcgatgttgatactgttgtatttatactctggcatacgattac

SEQ ID NO: 27181 - protein, 146 aa, Panicum virgatum; identical to SEQ ID NO: 14493
  misc_feature: Ceres CLONE 1875384
  misc_feature (5)..(146): Pfam Name: PSI_PsaH Pfam Description: Photosystem I reaction centre subunit VI

SEQ ID NO: 27182 - DNA, 734 bp, Panicum virgatum
  misc_feature: Ceres CLONE 1875386
  misc_feature: Encodes the peptide sequence at SEQ ID NO. 27183
attgcagcactcatctccttcattaattcccagctagtacgtaggtgtgcacgccttgccgcgaactcttccctcctagcagctacctagctagctagctttatttcagcagcagctgctgcagctctagctagcaataattaagcagcaatggccaccgccctcagcagcctccgcgcgccggccagcagcttctcctccggcgtgcgcgccgccccggcgcccggcgtcgtcgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgcccttctcctgccgcgcggggtcctgctcctcctgcgccggcaaggtcgtctccggctccgtcgaccagtccgaccagagcttcctcgacgacgaccaggtcgccagcagctgggtgctcacctgccacgcctaccccacctccgacgtcgtcatcgagacgcacaaggaggaggagctcaccgcttaagctccatcatcacatcatcatcatatcccatgcataaaattaaagctgctagctgccttgcaagagatctatcgatcgatgtaatcgagttgacgagaatccgatccgccggacaaatttcttttcctagcttaattgtatcatccatcatg

SEQ ID NO: 27183 - protein, 143 aa, Panicum virgatum
  misc_feature: Ceres CLONE 1875386
  misc_feature (54)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MATALSSLRAPASSFSSGVRAAPAPGVVAMPAAKQVVARGARLRAQATYNVKLITPDGEVELQVPDDVYILDQAEEEGIDLPFSCRAGSCSSCAGKVVSGSVDQSDQSFLDDDQVASSWVLTCHAYPTSDVVIETHKEEELTA

SEQ ID NO: 27184 - DNA, 578 bp, Panicum virgatum
  misc_feature: Ceres CLONE 1875409
  misc_feature: Encodes the peptide sequence at SEQ ID NO. 27185
ctcgccgaccacctccgcaccgcaccgcgccgctttgggttttggaccccggccgagcggcgtgtcgctgatctctcgcgcggcgcggcgatgtggcgttcggcggcgcggcggtcttcgccggtccggcggctcctgtcgacgtccgcacccccggcggggccgctcgccaccgtgccggcgccctgcgtcgtgcagaagcgcgggaacgacatcctcaacgtcccttggtaccacaaggacacggcgttccccttgacggagcgcgaccgcctcggcctccgcgggctgctcccgccgcgggtcatgtccttcgagcagcaggacgagcggttcatagactcgtaccggtcgttggacaacatcccgcggggcgagccggactccctcgtcgcgctggccatgtggaggatcctcagctggctgcaccaccggaacgagtccttgtacttctgggtgctcatcgactatgtctgggatcccgcgcccatcttctcccctccccctgtcggcttggtctgtgagaattacagtggcctgttcagacggcctcgtgggatgtatttcgtcgcagacga

SEQ ID NO: 27185 - protein, 162 aa, Panicum virgatum
  misc_feature: Ceres CLONE 1875409
  misc_feature: SWISSPROT Homolog: EC 1.1.1.39 Malate dehydrogenase (decarboxylating)
MWRSAARRSSPVRRLLSTSAPPAGPLATVPAPCVVQKRGNDILNVPWYHKDTAFPLTERDRLGLRGLLPPRVMSFEQQDERFIDSYRSLDNIPRGEPDSLVALAMWRILSWLHHRNESLYFWVLIDYVWDPAPIFSPPPVGLVCENYSGLFRRPRGMYFVAD

SEQ ID NO: 27186 - DNA, 1438 bp, Panicum virgatum
  misc_feature: Ceres CLONE 1875432
  misc_feature: Encodes the peptide sequence at SEQ ID NO. 27187
ctccctccgtcgctgcccgcttgccgccgcggcagcgcgcccgggccccgtccccagatcgccgcggcgctccccgccggcgtcggcgcgccgcaggtcggaaatctatttggccacgctggtagtggccgcgtgttaagtccatttctggtttggaagagacacacaagccaatatgcttcaatgacatctggaaactggaatagtatgtgctgattttatatgcttcatcagctgattatcaatgggcgctttcctaaggaaacagcccagctacctcttcattttgataattctgcaccttgttgctcatgaggcaagaacactaaattcggatggcgaagcacttcttgccttcaagaaggcagttacaaattcagatggcgtctttctaaattggcacgagcaagatgcagacccctgcaactggaagggtgttaattgtgatagtcatagcaagagagtgattaatctgattcttgcatatcacagattagttgggccaatacctccagaaattggaaggttaaatcagttgcaagctttatcactgcaggggaacagtttgtatggttcactccctcctgaattgggaaactgtaccaagctgcagcaattgtatctacaaggaaattacttaagtggatacatcccttcagaatttggcgatctggtggaacttgaggcattggacttatccagtaatatgttgagtggatctattccacattctattgataagctgtccaaacttacatcattcaatgtttccatgaacttcctaacaggagaaataccatcttctggttcacttgtcaatttcaatgagacatccttcgttgggaaccttggtttatgtgggaagcagattaactcagcgtgcaaagatgcacctcaatcaccatcaaatgctcctcagtcaccttcagatgacgcgtttaataaaaagaatgggaagaattctaccagacttgttattagtgcagtagcaacagttggagctctcctattggtggctttaatgtgtttctggggttgctttctttacaagaattttggaaagaaagatatgcgtggtttcagggttgagctttgtggaggctcttctgttgtgatgttccatggggaccttccatactcctcaaaagacatcctcaagaaactagagactatggatgaggaaaatatcattggagcagggggctttggaactgtttataaacttgcgatggatgatgggaatgtctttgcattgaaaagaatagtgaaaacaaatgaagggctagatcgcttctttgatagagaacttgaaatattgggaagtgttaaacatcgttatctggtcaaccttcgtggttactgcaactctccttcatccaaacttttgatatatgactatcttcaaggtgaaagcttggatgaagtgttgcacgaaaag

SEQ ID NO: 27187 - protein, 397 aa, Panicum virgatum
  misc_feature: Ceres CLONE 1875432
  misc_feature (28)..(68): Pfam Name: LRRNT_2 Pfam Description: Leucine rich repeat N-terminal domain
  misc_feature (9)..(198): SWISSPROT Homolog: EC 2.7.11.1 Non-specific serine/threonine protein kinase
  misc_feature (301)..(386): SWISSPROT Homolog: EC 2.7.11.22 Cyclin-dependent kinase
MGAFLRKQPSYLFILIILHLVAHEARTLNSDGEALLAFKKAVTNSDGVFLNWHEQDADPCNWKGVNCDSHSKRVINLILAYHRLVGPIPPEIGRLNQLQALSLQGNSLYGSLPPELGNCTKLQQLYLQGNYLSGYIPSEFGDLVELEALDLSSNMLSGSIPHSIDKLSKLTSFNVSMNFLTGEIPSSGSLVNFNETSFVGNLGLCGKQINSACKDAPQSPSNAPQSPSDDAFNKKNGKNSTRLVISAVATVGALLLVALMCFWGCFLYKNFGKKDMRGFRVELCGGSSVVMFHGDLPYSSKDILKKLETMDEENIIGAGGFGTVYKLAMDDGNVFALKRIVKTNEGLDRFFDRELEILGSVKHRYLVNLRGYCNSPSSKLLIYDYLQGESLDEVLHE

SEQ ID NO: 27188 - DNA, 598 bp, Panicum virgatum
  misc_feature: Ceres CLONE 1875432-R
  misc_feature: Encodes the peptide sequence at SEQ ID NO. 27189
gacttgcaaaactattagaggatgaagaatcacatattactacaatagttgcaggaacatttggttaccttgcaccagagtatatgcaaagtggcagagccactgagaagactgatgtctacagctttggggttctggtacttgaaatactgagtggaaagcggcctactgatgcatcattcattgagaagggattgaacattgttggatggttgaattttctggctggtgagaatcgggagagggaaattgtcgatcccaactgtgaaggtgtgcagattgagaccttagatgctctgctttctctagccaagcaatgtgtaagctctttgccagaggagcggccgacaatgcacagggtggtacagatgctggagtcggatgtaattacaccatgccctagcgatttctacgattcagagtagtctcctggacaagccacactgctcccaatttcccgaggcgcattcctttattctttgcagatattttgtaaatgcattgccgaggtgtttggtctccaatgggctggttccacgagtgacatttttgcgtctgtatacctatgtatgttgatttaataagagaacttaccagt

SEQ ID NO: 27189 - protein, 140 aa, Panicum virgatum
  misc_feature: Ceres CLONE 1875432-R
  misc_feature: SWISSPROT Homolog: EC 2.7.11.1 Non-specific serine/threonine protein kinase
LAKLLEDEESHITTIVAGTFGYLAPEYMQSGRATEKTDVYSFGVLVLEILSGKRPTDASFIEKGLNIVGWLNFLAGENREREIVDPNCEGVQIETLDALLSLAKQCVSSLPEERPTMHRVVQMLESDVITPCPSDFYDSE

SEQ ID NO: 27190 - DNA, 1458 bp, Panicum virgatum
  misc_feature: Ceres CLONE 1875441
  misc_feature: Encodes the peptide sequence at SEQ ID NO. 27191
gtgaacgcgtgggcgtgctgtgcgtgtgttgccttggagcagcaggaagggagggcagtggagagcgcgccgtgccgtgtgctgcgatctgggatccaaccggccgccgccggctgcgcgcgttgcggcactagctagctatcctatacgacccgagctttgtcttgtcgaccggccatgagggtggtggtgtcgggcgcgacggggttcatgggcggccgcctgtgcgcggcgctggccgacgccggccacgacgtgcgcgcgttcgcgctccgcggcgtcgacgcctccggcctccctccctccgtcgaggtggtctacggcgacgtcaccgacgaggagtcgctcgccgccgccttccgcgggcgcgacgccgtgttccacaccgccgcggccgtcgaggcgtggctccccgacgcctccgttttccacaccgtaagatgacctacttcgtaacgtgtttttccacattctcgacacgtacccatgcatcatacaccgacgaattttttttcctagttgacaaacacagtacattaggtcctagtagtcttgtactattacacaactgttctgtcttttttttcctacaaaaaaaaactaaccggcaggagagcctgagcttcagtaaatatagaagcgccagaaatttacagagaagttcatgctcaataattttttattgaatcttgcgtcatgcttatacgcaataatttcaagttcttggcatgctgactagtgactagtggcgtcatagcgacctcacagtcggttggttgccccgctgtctctttctatgaagttgctttgtccgtttcacgctattttatgacattttaattttctttcctcctttgactccgacgtgccactgtatcttgacgtgctacatcatgatcaggacatttcattgcacggtttctatgaggcgtcatctttgatatttcaattgataaatgaaactagatccctaataatgcatggaaacagtgagcacctatttcatccagatgaaactgctcgcatctatttcctcataatttttttgtcacgtcacatatgagctgatgtgacccatcaattaaatactatgagtacttggcacatgattgatgttcctcgtctttatgacaaaataaaacttattggtggttgttgtctttattacgcattactgcatcatcttgctaatgtattttatataaataaaaatgtgagaccgaagccggcgatcagaggggtgaatgagagccgatcaaaatttcttctgaaattcaaaccgtcggcctatatcccgaaaatcacccaagccctcaagcgttctggccaaagtttggaataactattgaaaagctaaaccaacacaaaaggcctcgaacgaacgagtgaaaacccaaagtaattcggaagcgattcgggaaaacagctgatctgaacagccaggaccggtctgaccgt

SEQ ID NO: 27191 - protein, 88 aa, Panicum virgatum
  misc_feature: Ceres CLONE 1875441
  misc_feature: SWISSPROT Homolog: EC 5.1.3.2 UDP-glucose 4-epimerase
MRVVVSGATGFMGGRLCAALADAGHDVRAFALRGVDASGLPPSVEVVYGDVTDEESLAAAFRGRDAVFHTAAAVEAWLPDASVFHTVR

SEQ ID NO: 27192 - DNA, 644 bp, Panicum virgatum
  misc_feature: Ceres CLONE 1875441-R
agagaatggaaagcagtgctactcaaactcatacaggtgagccaaaccagccaaaacatgttgcgaacattcatttttcaatcaaatttgtatcaagcaatttttaatgccaggggttgaaaggttgtcatgctttacttagcaacgaggccaagcctatgccaaaagacaatcagaagcttaaagcactcgtttcagtcatgcacagccttgcccgggttctcacaagtgcaaagtgagccgtcccgaaagctcgatcagtgcgacaagcaattccacctggatcttttccatccatttccagaacagttcaagcaattttatcagatttagatcatttcaaatatgaattgctgaacgaaagaccacactagcatgaataagatagcaaagcatattaacacgccctaacatgctagtagccaaaacaggatgatcatattttcagattttcaaatcaaaatagcttaactcagatgatgtcatatacacaatggagcaaactatacatgatcaagtttaacaactcacactagcaggcactagaagatcatagcaatgtatacaagaatgctagtgcaagtgagacaatgcaaaatgcaaacatgtacaatgcatatgcacaatgcaactaccaaacccag

SEQ ID NO: 27193 - DNA, 1922 bp, Panicum virgatum
  misc_feature: Ceres CLONE 1875446
  misc_feature: Encodes the peptide sequence at SEQ ID NO. 27194
gcccaccgcagacacacggcccatgcctccaccgggagccatggcggcgttgctgccatcctcctcctcatcgcagctgctccgcctcccacgccgcttcctctcgctcacggcgactccctacccgctctactacgatctcatcgtccaccgccccgccgaccccaagccccccaagtcctcctccgacgccggcgccgaccgccagccgcagccaccccccgacgagcagccgctcgaccgcgccaagcgcaggtacctccgcaagcgccgcagccgcctcctcccggacccggatgccgccgccaagccctccgcgtcctcctcgtcggagttcgtggagctccggccggaggtggtggacttcccgcggctgcacgcgcgcgaggaggcgctctacttccacgacaccttcgccatgccgtgggagaaggacaagcactaccgcatgctctaccgcctcgagaagaagtacttcccccaccagtcgctggacaacgcattcgtccccgccgacgccgggccggccaccgacgccgacaggagcctcgtcttcttcgacgatgagaagaaggaagatgacggagaggaccgggtggccaataacaaggacggcgacagcgacaaaggggaggtgctggagaggaaggtggaagacttcttcaggtctctgaggaagccccccggcgaagccagcacaaaggccaagagaccggcggcagtcggagcggaaccgcggcaggtgaagcgcgaggtgccaagggaggaggagcgcccgcagccgtatctcgtgaccaggacgacggacctgccgccgaggtgggacggaccgactgggaccgtcgtgctcattgacaagcccaaaggatggacttcatttactgtttgtggaaagttgaggcgcttggtgaaagtgcaaaaggttggacatgctggtactctggaccccatggcaactggagtgttgattgtttgtataggaaaagcaaccaaaatagtcgatagctaccaaggaatggttaaaggctatagcggtgtttttcgacttggagaagccacatcaacctgggatgcagattcaccagttatccagagggaaccatggcaacacatcaaagatgaagacattagaaaggcagcagcatcattcaagggtgagatatggcaagttcccccgatgttttctgccattaaggttggtggtgaaaagatgtatgacaaagcaaggaggggtgaaacagtagagctttcaccaagacgcatatcgatataccagtttgacattgagcgcagtttagaagacagacagaatttgatgtttcgggttacttgctcaaaagggacatatattcggtccctgtgtgcagacttggggaaagcacttggaagctgtgctcatttaactgccttgcggagagactcaataggtgaatactcagtcaatgatgcttggaacttcgatgagcttgaagaacaaattaccaaggcatatttatgagcactctccaaatcatgccttctggaagatgccagtgagctaggttacatgcagcttacaaccatttcccaggcaccattagaaattaagtctacagtgaagtgctaccttgagtagatgttcgtgtagaatctggaaatgggtgggcagccattcattcccaaggctgtcagcgcggattgggtggagctgaagaaatgtgctctcgttcagttcatcggcatagatgaggaacgcaaaattagtcacagatacatgagctagcttgcatttatctgaattgttgattttctgaaccgaacccccaattctcaattgagggggacaccatagtcttgtctctgagctgactatccaaaggatggagagaatcagttttttcttatttttttggaagtgaaggaaacagacagttttgttgact

SEQ ID NO: 27194 - protein, 485 aa, Panicum virgatum
  misc_feature: Ceres CLONE 1875446
  misc_feature (287)..(437): Pfam Name: TruB_N Pfam Description: TruB family pseudouridylate synthase (N terminal domain)
MAALLPSSSSSQLLRLPRRFLSLTATPYPLYYDLIVHRPADPKPPKSSSDAGADRQPQPPPDEQPLDRAKRRYLRKRRSRLLPDPDAAAKPSASSSSEFVELRPEVVDFPRLHAREEALYFHDTFAMPWEKDKHYRMLYRLEKKYFPHQSLDNAFVPADAGPATDADRSLVFFDDEKKEDDGEDRVANNKDGDSDKGEVLERKVEDFFRSLRKPPGEASTKAKRPAAVGAEPRQVKREVPREEERPQPYLVTRTTDLPPRWDGPTGTVVLIDKPKGWTSFTVCGKLRRLVKVQKVGHAGTLDPMATGVLIVCIGKATKIVDSYQGMVKGYSGVFRLGEATSTWDADSPVIQREPWQHIKDEDIRKAAASFKGEIWQVPPMFSAIKVGGEKMYDKARRGETVELSPRRISIYQFDIERSLEDRQNLMFRVTCSKGTYIRSLCADLGKALGSCAHLTALRRDSIGEYSVNDAWNFDELEEQITKAYL

SEQ ID NO: 27195 - DNA, 731 bp, Panicum virgatum
  misc_feature: Ceres CLONE 1875452
  misc_feature: Encodes the peptide sequence at SEQ ID NO. 27196
aaacccatttccttcctgcctccacgacccagcccaggcccggcggtgcctctccctctcgtctccggatcggcaagagcccagctgctgccggattcacacgacacctcgtcgtctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcgtcgccctcgccggcggtgttcgacaagccgcggccggcggccgcccctcccgccgtgtggccgccgttccccgcggccgccgaccggcccccggcgggccccgcggagtccccctccaaggcgccccggacgtcgtcgtcggtcaaccggtgccacagctgccagaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagctggggagcaccggaggagaccacgcagctcagctccacgccgatcgtcgatccatctcccgcg

SEQ ID NO: 27196 - protein, 168 aa, Panicum virgatum
  misc_feature: Ceres CLONE 1875452
  misc_feature (109)..(149): Pfam Name: zf-AN1 Pfam Description: AN1-like Zinc finger
MAQRDKKVEEPTELHAPELTLCANSCGFPGNPATKNLCQNCFLAASASVSPPSPSSSSSPSPAVFDKPRPAAAPPAVWPPFPAAADRPPAGPAESPSKAPRTSSSVNRCHSCQKRVGLTGFRCRCGELFCGAHRYSDRHDCGYDYKGVARDAIARENPVVRAAKIVRF

SEQ ID NO: 27197 - DNA, 573 bp, Panicum virgatum
  misc_feature: Ceres CLONE 1875455
  misc_feature: Encodes the peptide sequence at SEQ ID NO. 27198
cccgtgtcagttgtcacacgagccggagaaaatgcgcgcgtcgatccccaccccctcgctcctcgtcgccccgagcccgccgcgggtccgatccctgtacactgccgcggctcccacctcccgtcaccacgcctgcggaggaggacgtcctcgcacccgcctgcgcgtggcggcgccaccgtccgcccccggtgaagcggcggaggagcaggcggagccgagcgcgtgggcgccccagtccggcgagaagttctcatggagggaccactggtacccagtttccctcgtcgaggacctcgaccccagccgccccaccccgttccagctcctcaaccgcaaccttgttgtctggaaggaccccaagcccggcgagtgggtcgagctcgacgaccgctgcccccaccgcctcgctccgctctcggaggggaggatcgaggacacggcgtgcttgcacagctcttaccgcgcctggtcattcaacggctccggcgcctggaccaggatccctcaggccatgcccgagggtcccgaggcccgggcaatgcggtcggcgaacgcgggggcaaccaattt

SEQ ID NO: 27198 - protein, 180 aa, Panicum virgatum
  misc_feature: Ceres CLONE 1875455
  misc_feature (79)..(177): Pfam Name: Rieske Pfam Description: Rieske [2Fe-2S] domain
  misc_feature: SWISSPROT Homolog: EC 1.13.12.14 Chlorophyllide-a oxygenase
MRASIPTPSLLVAPSPPRVRSLYTAAAPTSRHHACGGGRPRTRLRVAAPPSAPGEAAEEQAEPSAWAPQSGEKFSWRDHWYPVSLVEDLDPSRPTPFQLLNRNLVVWKDPKPGEWVELDDRCPHRLAPLSEGRIEDTACLHSSYRAWSFNGSGAWTRIPQAMPEGPEARAMRSANAGATN

SEQ ID NO: 27199 - DNA, 699 bp, Panicum virgatum
  misc_feature: Ceres CLONE 1875466
  misc_feature: Encodes the peptide sequence at SEQ ID NO. 27200
atccaccctcatcggaagctccccaactccaagcctccttccagcagcgaagaagcgaagagccagccggagagcggcgatcgagcagcgtcgcgacaccagccaggcggatccaggcgatcccatggcgcccagaaggtcaccgtcgccggccgggagcagcggcagcggcggcgccgggtgcgcgccggcggcggcggcggcggggcagccgccgagggtccgaggcgtgcggaagcgggcgtggggccggtacgcgggggagatccgcgaccccgtacgcaaggggcgcgtgtgggtggggaccttcgacacgcccgaggacgccgcgcgcgcctacgacgacgccgcgcgccggctccgcgggccacgcgccgccaccaactacccggcccgggacccgaaggccgcggtggcggacgctccggcggcgagcgggagcgggagcgcggtgctgtacgaggacgcctcgtcctcgtcctcgtcctcctgccgggacttgccgctggaagtgacggtggccgtcgcggcgcacccgtcgctggacgtgggcctgggcctggcgctaccggacatggcggccacggcgacatcgctcctggtgttggtggacccggccgcgacgatggtggccgtggcgccggagctgctgcaggtcctgccgcgcaagatcgaggaagagcagaacttctcatcgtc

SEQ ID NO: 27200 - protein, 191 aa, Panicum virgatum
  misc_feature: Ceres CLONE 1875466
  misc_feature (31)..(82): Pfam Name: AP2 Pfam Description: AP2 domain
MAPRRSPSPAGSSGSGGAGCAPAAAAAGQPPRVRGVRKRAWGRYAGEIRDPVRKGRVWVGTFDTPEDAARAYDDAARRLRGPRAATNYPARDPKAAVADAPAASGSGSAVLYEDASSSSSSSCRDLPLEVTVAVAAHPSLDVGLGLALPDMAATATSLLVLVDPAATMVAVAPELLQVLPRKIEEEQNFSS

SEQ ID NO: 27201 - DNA, 569 bp, Panicum virgatum
  misc_feature: Ceres CLONE 1875481
  misc_feature: Encodes the peptide sequence at SEQ ID NO. 27202
acgtacgttctccccggaacactagctagcaccggtcacagcaccaaccgtaccgccatggcctccctcgccgccgtctccgtgcagccggtcgccgtaaagggcctcgccggcagctccatctccggcaggaggctcgccgccgctaggccgtcgcgcgccggcgcctgccgctccgccgtggtggccaagtacggcgacaagagcgtctacttcgacctcgacgacatcggcaacaccaccgggcagtgggacctctacggctccgacgcgccctcgccctacaacccgctccagagcaagttcttcgagacgttcgcggggccgttcaccaagaggggcctgctgctcaagttcctgctgctgggcggcgggtcgctgctggcctacgtcagcgcgtcggcgtcgccggacctgctgccgatcaagatggggccgcagcagccgccgcagccggggccgcgtggcaagatctaagctcagttgttccttctcctccatctgtctctactagctgcttgcttgtaccaccactggctcgggacgccatggatcgtcgtccctgctgg

SEQ ID NO: 27202 - protein, 139 aa, Panicum virgatum
  misc_feature: Ceres CLONE 1875481
  misc_feature (5)..(139): Pfam Name: PSI_PsaH Pfam Description: Photosystem I reaction centre subunit VI
MASLAAVSVQPVAVKGLAGSSISGRRLAAARPSRAGACRSAVVAKYGDKSVYFDLDDIGNTTGQWDLYGSDAPSPYNPLQSKFFETFAGPFTKRGLLLKFLLLGGGSLLAYVSASASPDLLPIKMGPQQPPQPGPRGKI

SEQ ID NO: 27203 - DNA, 635 bp, Panicum virgatum
  misc_feature: Ceres CLONE 1875512
  misc_feature: Encodes the peptide sequence at SEQ ID NO. 27204
acccccaccgcggcgacgcatcatcatccactcccctcccaaaaccaccacctcagctcagctcattcctcccaggctcccaccactagtaccacctgatcaacgacgacgacgacgatgccgccgaggccgtggcgaccggtgctggcgtcggccaccaagtgctgcgcggcggaggacgcggcggtggcgcccgacggcctggcgcgctgccgcccgcagcagtcggagctctcgcgccggctggcctccttccggcgcctctcgtcgctggccaacagcccggcctcgggcgccgccgccggcaagggcggcggcgaggcggaggcggaggcggaggcggcggccgccggggagatggcgggcccgctgcagctgcactcgttcgggctgggcgagctccgcggcgtcacgcacgacttctccgccagcttcctgctgggcgagggcggcttcggcgccgtgtacaagggcttcgtcgacgccggcatgcgcccgggcctcgccgcgcagcccgtcgccgtgaagcagctcagcgccggcgggttccagggccaccgcgagtggctcgccgaggtcatcttcctgggccagttccggcacccgcacctcgtcaggctgctgggctactgttg

SEQ ID NO: 27204 - protein, 172 aa, Panicum virgatum
  misc_feature: Ceres CLONE 1875512
  misc_feature: SWISSPROT Homolog: EC 2.7.11.1 Non-specific serine/threonine protein kinase
MPPRPWRPVLASATKCCAAEDAAVAPDGLARCRPQQSELSRRLASFRRLSSLANSPASGAAAGKGGGEAEAEAEAAAAGEMAGPLQLHSFGLGELRGVTHDFSASFLLGEGGFGAVYKGFVDAGMRPGLAAQPVAVKQLSAGGFQGHREWLAEVIFLGQFRHPHLVRLLGYC

SEQ ID NO: 27205 - DNA, 719 bp, Panicum virgatum
  misc_feature: Ceres CLONE 1875523
  misc_feature: Encodes the peptide sequence at SEQ ID NO. 27206
agaggcaccaccgcagcagccaccaccaccaccaccaccacgaggatgatgtcggcagcagtaaagcttccttgttgcatcgccctgcagtcgaattcgaagagcgacagtggaagctacctgcgctacgtccacgagagcggggagaactacaagcggctgcagatcaacggtaaggacgccaacagcccctacaccaggtacgatgtggaagcgtcgctgctccaccaaggtctggtgcacatccgatgccgctacaaccgcaagtactgggtgcctcgtcggcggggcgacggctggtggatcgtcgccgacgccgacgagcgggaagaagacctgaccaggcccaactgcacgctgatcaaaccgatcattggtgtcaccacccgcaccaccggtggtgatggcggtgaagcggaatcagtgatgaccgtcaggttcgtccacgcggggcagcagcttgggaagggcgcgcgcatgatcatgaccacgccgtcgacgaaagaaggcggcgagggcaacagtactagcgccagaggtgcctatatgcgcgtcgtcggcgacgttgtcgaagccgagcacaagggcgccgtcgaagatgtaggcttcaccgtcctcaacctgtccaagagcaagaggaacctgcctaaatttgtggtgttcaggcaagctcaggacgagaggtacctgagtgcggtcgtggtcgataaccaactttt

SEQ ID NO: 27206 - protein, 224 aa, Panicum virgatum
  misc_feature: Ceres CLONE 1875523
  misc_feature (6)..(151): Pfam Name: Agglutinin Pfam Description: Agglutinin
MMSAAVKLPCCIALQSNSKSDSGSYLRYVHESGENYKRLQINGKDANSPYTRYDVEASLLHQGLVHIRCRYNRKYWVPRRRGDGWWIVADADEREEDLTRPNCTLIKPIIGVTTRTTGGDGGEAESVMTVRFVHAGQQLGKGARMIMTTPSTKEGGEGNSTSARGAYMRVVGDVVEAEHKGAVEDVGFTVLNLSKSKRNLPKFVVFRQAQDERYLSAVVVDNQL

SEQ ID NO: 27207 - DNA, 707 bp, Panicum virgatum
  misc_feature: Ceres CLONE 1875524
  misc_feature: Encodes the peptide sequence at SEQ ID NO. 27208
agcgtagtggtcacaactcggaaggatccaaagacgataagcccgaccgcttcttcggagacggaaccatggcgacagcgggtgagatcgcggcggtgggcgtgatcggcgcggggcagatgggctcggggatcgcccagctcgcagccgccgccggctgcgccgtcctcctcctcgacgccgactccgccgccctctcccgcgccgttgcctccatctccgcctcgctccgccgcctcgccgccaagggccagctctcccaggcagcgtgcgaagactccatcaagcggatacggtgcgtctccaccgtgcaagatctcagggacgcggatcttgtgattgaggccatcgttgagaacgaagatgtcaagaagaagctgtttgtggagctggataagatcacgaagccctccgccattctagcgtccaacactagctccatctccataacccgcctggcttcagctaccaaacgcccctctcaggtcataggcatgcacttctttaaccctcctccgataatgaaattgatcgagattatccgaggagctgatacctcagatgaggtgtttgctgcagtcaaatctttttccgagaggctcgggaagactgtcatatgctcacaagattacccaggattcattgtgaaccgcattctcatgccgatgatcaatgaggctttctgggcgctgtacaccggagtggcc

SEQ ID NO: 27208 - protein, 212 aa, Panicum virgatum
  misc_feature: Ceres CLONE 1875524
  misc_feature (9)..(188): Pfam Name: 3HCDH_N Pfam Description: 3-hydroxyacyl-CoA dehydrogenase, NAD binding domain
  misc_feature: SWISSPROT Homolog: EC 1.1.1.157 3-hydroxybutyryl-CoA dehydrogenase
MATAGEIAAVGVIGAGQMGSGIAQLAAAAGCAVLLLDADSAALSRAVASISASLRRLAAKGQLSQAACEDSIKRIRCVSTVQDLRDADLVIEAIVENEDVKKKLFVELDKITKPSAILASNTSSISITRLASATKRPSQVIGMHFFNPPPIMKLIEIIRGADTSDEVFAAVKSFSERLGKTVICSQDYPGFIVNRILMPMINEAFWALYTGV

SEQ ID NO: 27209 - DNA, 731 bp, Panicum virgatum
  misc_feature: Ceres CLONE 1875557
  misc_feature: Encodes the peptide sequence at SEQ ID NO. 27210
acacaaaaactggagcacgagcagctccggtgaggattcattcgttcagcagcaggggaggaggaggaagaagaagagagcaagcggctccgttcccaaccatatcccatggcgcagttcgccgtcctccgcgcgtctccggtggccgccgccaccgcggcgccgtccttctcctcctgcatgtccggacgtgcagcatgttcactgcgcgtcacctccagcaagaggcgcgtcttctccaggaccggcagggcgctgtccatccggtgcgagcagagcgcgaagcagggcggcggcggcgccgacgtgtggctgggccgcgccgccatggtcggcttcgcctcggcgatctccgtcgaggtggccaccggcaaaggcttcctccagaacttcggcgtggcgacgccggcgccgacgctggcgctggtcgtgtcggggctcgtcgtcggcctcgccgtcttcttcctgctccagtccggctcgcgagactgaacgccggtgaacgagcagtcgaacatctgcagggttcagtgctgaaggttcgtcgtcggaggctgctctgcaaacgcatccagtttgttcctcgatcgtcacattttcccttgtaccatcgtctatgtaatgtagtaactgacaatcatctacagttatttcaaaaaaaaaacaatcatctacagaatgctgctgaaaaagacaatcatctacagaatgagccctcttaagttttggtg

SEQ ID NO: 27210 - protein, 127 aa, Panicum virgatum; identical to SEQ ID NO: 12775
  misc_feature: Ceres CLONE 1875557
  misc_feature: SWISSPROT Homolog: EC 4.99.1.1 Ferrochelatase

SEQ ID NO: 27211 - DNA, 1977 bp, Panicum virgatum
  misc_feature: Ceres CLONE 1875561
  misc_feature: Encodes the peptide sequence at SEQ ID NO. 27212
atttatgacgcgctcagtcattccaccagtctcctccctcacctccccggcggcgccccacgatgggaaaacgcgggcggctagcggcggccgtggcgccgcccgcgctcgtgccgttccccgtcgtcctcgccgccttcgttctctccgtcgcggcccctgcgctgggtcggagcccgtcatgtcctgagggttggcaaatcagccctgttcagaacaaatgtttcatgtacatatcggcctccctttcttgggagagatctgaggctctctgccgtaaccgcactgggcatctggctgctttttcatcagttcaggagctaaacttcacaaagtctctctgcggatcaacctcaggatgctgggttggagggcatcactacaacactagtactggtagtggttggaaatggtctgatgattcacctgttgggaatgagcccctcttccctgttgagccgttgcatgcaaactgcagtggtactgcatgcggtgtagccaccagcaatgatttgtgcactttggtgaccaatagccatgcttcactagctggaaaaaggtgcagtgagtcccatggtctgatttgtatgatggatgtaaacagatgctaccatgatcactgccacaaggaatatttcatagccctcattgctgtgagtggtttcattctggcaaccactttagccgttgtggtttggctgcttgtctacaggcgaagcaagaaaagaagaagatcgcgagaagcattaggttcttctgctgctgcattggtggcgccgcaatggaaagtattcaccagtgaagaacttagatcattcacaaagaatttcagtgagggaaaccggcttcctggtaatgcaaagacaggcggaacctacagtggaatcttgccggatgggtccaaagtagcaatcaagagactgaagagatccagcctacaaaggaaaaaggacttctactctgagattcggagagtcgcaaagctttatcatcctaatttggtggctgtaaaaggatgttgttatgaccatggtgatcggtttattgtctatgagtttgttgcaaatggtcctttggatgtgtggctgcatcatattcccagaggtgggcggagccttgattgggcaatgagaatgagagctgccacaactcttgcccagggaatagcatttttgcatgacaaggtgaagccccaggtggtgcaccgtgacattcgtgcgagtaatgtcttactcgatgaggaatttggtgcacatctgatgggggttggcctttccaagtttgtgccatgggaagtaatgcatgagaggacagtcaaggctgcatcctatggctaccttgctcctgagttcatatacaggaacgagctgacaacaaagagcgacgtctacagctttggcgtgctgctcctagaaattatcagcggccgtaggcctgcacagtcggttgagtctgtcgggtggcagaccatatttgaatgggcgactcctctagtccagtcacaccgctatcttgatctgctagacccactcatacaggacttgccggatgtgggggtcgtccagaaggttgtcgatcttgtctactcctgcacccagcatgtcccttcagtgcgcccaaggatgtcgcatgttgtgcatcagctacagcagcttgagatgaagtctgcagcttctgagcagcagctgaggagtgggacaagcaccagcgcgacatcgcctatgttaccattggaggtccggactcctcgctgaaatccattgccggaaatcaagagcatcatcttagttccattgtcattgagcatccgtactcagtaggtagcacattccctggagcgtatggtgactcagggccagaggccaccgttatctgtaatcagtagtttagttctgccccaatgctgagggagtgaggggacaagttgtatccatttgtactcaggttgatttctaatctactattttatggttggcc

SEQ ID NO: 27212 - protein, 563 aa, Panicum virgatum
  misc_feature: Ceres CLONE 1875561
  misc_feature (272)..(528): Pfam Name: Pkinase_Tyr Pfam Description: Protein tyrosine kinase
  misc_feature (60)..(177): Pfam Name: Lectin_C Pfam Description: Lectin C-type domain
  misc_feature: SWISSPROT Homolog: EC 2.7.11.1 Non-specific serine/threonine protein kinase
MGKRGRLAAAVAPPALVPFPVVLAAFVLSVAAPALGRSPSCPEGWQISPVQNKCFMYISASLSWERSEALCRNRTGHLAAFSSVQELNFTKSLCGSTSGCWVGGHHYNTSTGSGWKWSDDSPVGNEPLFPVEPLHANCSGTACGVATSNDLCTLVTNSHASLAGKRCSESHGLICMMDVNRCYHDHCHKEYFIALIAVSGFILATTLAVVVWLLVYRRSKKRRRSREALGSSAAALVAPQWKVFTSEELRSFTKNFSEGNRLPGNAKTGGTYSGILPDGSKVAIKRLKRSSLQRKKDFYSEIRRVAKLYHPNLVAVKGCCYDHGDRFIVYEFVANGPLDVWLHHIPRGGRSLDWAMRMRAATTLAQGIAFLHDKVKPQVVHRDIRASNVLLDEEFGAHLMGVGLSKFVPWEVMHERTVKAASYGYLAPEFIYRNELTTKSDVYSFGVLLLEIISGRRPAQSVESVGWQTIFEWATPLVQSHRYLDLLDPLIQDLPDVGVVQKVVDLVYSCTQHVPSVRPRMSHVVHQLQQLEMKSAASEQQLRSGTSTSATSPMLPLEVRTPR

SEQ ID NO: 27213 - DNA, 723 bp, Panicum virgatum
  misc_feature: Ceres CLONE 1875574
  misc_feature: Encodes the peptide sequence at SEQ ID NO. 27214
cctcattgctgtaaatgacgggattatccttcgcaatcatatttcacggatccttcaacgccacttcaaaggaaagccctattatgttgatctcattgatttgttcaatgaggttgagttcaagactgcttcagggcagttgttggatcttatcactactcatgagggtgaaaaggacctaagtaaatataacttgacgattcaccgacgcattgttcagtacaagacagcctactattcattttatctccctgttgcatgtgcactgctgctggctggtgagaacttggataactttggtgatgtaaagaacattcttgttgaaatgggaacatattttcaagtccaggatgattatctagattgttttggtggtcctgaattcattggcaagatcggaactgatattgaagactacaagtgttcttggttagttgtgcaagctcttgaacgtactgatgaggaccaaaagaaaatcctatttgaaaattatgggaagtccgatccagcatgtgttgcaaaggtgaaagacttgtacaaagagcttaatctggaggaggttttccatgagtacgagagggagagttacaacaagctgccggccgacatcgaggcccagccgaacaagacggttcagaccgttctgaagtccttcctgcacaagatctacaagagggacaagtagagctcagctgcgtgtgtggagaaccttttccacctatg

SEQ ID NO: 27214 - protein, 227 aa, Panicum virgatum
  misc_feature: Ceres CLONE 1875574
  misc_feature (1)..(190): Pfam Name: polyprenyl_synt Pfam Description: Polyprenyl synthetase
  misc_feature: SWISSPROT Homolog: EC 2.5.1.67 Chrysanthemyl diphosphate synthase
  misc_feature: Functional homolog of the protein sequence given in SEQ ID NO 51086
  misc_feature: Useful for making plants with modulated salt sensitivity
LIAVNDGIILRNHISRILQRHFKGKPYYVDLIDLFNEVEFKTASGQLLDLITTHEGEKDLSKYNLTIHRRIVQYKTAYYSFYLPVACALLLAGENLDNFGDVKNILVEMGTYFQVQDDYLDCFGGPEFIGKIGTDIEDYKCSWLVVQALERTDEDQKKILFENYGKSDPACVAKVKDLYKELNLEEVFHEYERESYNKLPADIEAQPNKTVQTVLKSFLHKIYKRDK

SEQ ID NO: 27215 - DNA, 1383 bp, Panicum virgatum
  misc_feature: Ceres CLONE 1875575
  misc_feature: Encodes the peptide sequence at SEQ ID NO. 27216
gcgagctgctcctgctcctcctcttcttccctccactcgcctccaaattttctctctcttcctcggcagaaccacaccccctcctcctcctcctcctcctccctctctttctctctacctctccaggtgcgcggctgaagtgaaggtcaggaccatgcaggcggcggcggtgaatggcgggggcgacgtgcagaagccacagcagcagccgcagccggtggtggtgggggcgccgcatccgccggcggcggcagtggtgccgccccattgggtggccatgccgttcacgccgccgccaggggccgcggccatggtgatgccgccgcaccagatggcgccgccgccccagttcgcgcccgcgcacttcgtcccgttccacgccgtcgcgccgccgccgccgccgccgccgcgggcggcgcccgtggcggccgtcgccctgggctcccccgcgccgcatcaggccgggcaggaggagaacaagaccatctgggtcggcgacctccattactggatggacgagaactacctccacagctgcttcggctacaccggcgaggttgtggccattaaagttattcgcaataaacagactggacagtctgaaggatatggatttgttgagttctacagccatgctgcagctgaaaaagttcttgaaggtttttctggtcatataatgccaaatactgaccaaccttttaggttaaattgggcatcatttagcatgggagataggcgctcggatgttgcttcagatcattccatattcgtaggcgatcttgcttctgatgtcaatgatgctacacttctggagactttctccagcaggtactcctctgtcaaaggtgccaaagttgttattgatgctaacactggcagatccaagggctatggtttcgtgagatttggagatgacagtgagaagacacatgccatgactgagatgaatggtgtatattgctcttctaggcccatgagaattggccctgcaactcccagaaaatcatcaggtacttctggatcaaatggttcatctgcccgttcagatggaggagacttgacaaacacaactgtatttgtcggcgggctcgacccaaatgttagtgaagaggaccttaggcagaccttctcccagtatggcgaaatatcttctgtaaagattccagtcggtaaacaatgcggcttcgtgcaatttgctcagagaaagaatgcagaggatgcattgcaaggactaaacgggagcaccattggcaagcagaccgtgcgcctttcatggggccgcaacccaacaaacaagcagtttagggggcgacacgggaaccagtggaaacaacgggatgtactacgcggcgtccccgttctacaacggctacggctaccctg

SEQ ID NO: 27216 - protein, 409 aa, Panicum virgatum
  misc_feature: Ceres CLONE 1875575
  misc_feature (307)..(372): Pfam Name: RRM_1 Pfam Description: RNA recognition motif. (a.k.a. RRM, RBD, or RNP domain)
  misc_feature (204)..(276): Pfam Name: RRM_1 Pfam Description: RNA recognition motif. (a.k.a. RRM, RBD, or RNP domain)
  misc_feature (111)..(182): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MQAAAVNGGGDVQKPQQQPQPVVVGAPHPPAAAVVPPHWVAMPFTPPPGAAAMVMPPHQMAPPPQFAPAHFVPFHAVAPPPPPPPRAAPVAAVALGSPAPHQAGQEENKTIWVGDLHYWMDENYLHSCFGYTGEVVAIKVIRNKQTGQSEGYGFVEFYSHAAAEKVLEGFSGHIMPNTDQPFRLNWASFSMGDRRSDVASDHSIFVGDLASDVNDATLLETFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPTNKQFRGRHGNQWKQRDVLRGVPVLQRLRLP

SEQ ID NO: 27217 - DNA, 165 bp, Panicum virgatum
  misc_feature: Ceres CLONE 1875575-R
tacacgatctagcgcctagcgccaccaagagtccgagacacctattgattggccaccactgtctgtcggattcaacggcaaaaaaagaatttttgatgacctggagctgtatgcgaccttgaagcagaacaataaagctaatgaaatccttgtgtctgctacttc

SEQ ID NO: 27218 - DNA, 705 bp, Panicum virgatum
  misc_feature: Ceres CLONE 1875581
  misc_feature: Encodes the peptide sequence at SEQ ID NO. 27219
ttttttccctcaccaattgacctccacaatacatcagatttatataactgggggtctctttgttctttgtttttcagtctctccatctttggcgtttctttttctcacttctcatcgggatcatctgtcattggcaggcatcaacatggcgaattcgtcgtctggaatggcagtggatgacgagtgcaagcttaagttcttggagctaaaagcaaagaggaattacagattcattgtgttcaagatcgaagagaagatccaacaggtgatgatagaaaaactcggtagtccagaagaaacctatgacgatttcactgccagtttgcctgctgatgagtgccgatatgctgtgtttgacttcgatttcacaactgatgagaattgccagaaaagcaagattttcttcattgcatggtcgcctgaaacatcaagggtgaggagcaagatgctctacgccagctcaaaagacagattcaagagagaattggacggcattcaagtcgagctgcaagccactgatcctagtgagatgagcatcgatatcataagaggacgagcactctaatcagtcaaacctccaatgcctactctcgatgatcttgagccccgccacatcatttttctttgtagcgtgctcgttttcttctttgatggtccgtcatgcatgtaccattctactgaagggaaactagcatccatttagtc

SEQ ID NO: 27219 - protein, 139 aa, Panicum virgatum
  misc_feature: Ceres CLONE 1875581
  misc_feature (12)..(139): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MANSSSGMAVDDECKLKFLELKAKRNYRFIVFKIEEKIQQVMIEKLGSPEETYDDFTASLPADECRYAVFDFDFTTDENCQKSKIFFIAWSPETSRVRSKMLYASSKDRFKRELDGIQVELQATDPSEMSIDIIRGRAL

SEQ ID NO: 27220 - DNA, 731 bp, Panicum virgatum
  misc_feature: Ceres CLONE 1875585
  misc_feature: Encodes the peptide sequence at SEQ ID NO. 27221
aagaagagcaccctctcctccggctcttcttctccaccaccaccagtccaccacctcctcctcctagcgctgccgcgcgccgcccccctgagcaccaccacaccgcggcaatggcgggcaacgggctgatcgtggagaacgacccgctcaactggggcgcggcggcggcggagctggccgggagccacctggacgaggtgaagcggatggtggcgcaggcgcgggagcccgtggtcaagatcgagggctccaccctccgcgtcggccaggtggccgccgtcgccgccgcccgggacgcgtccggcgtcgccgtcgagctcgacgaggccgcccgcccccgcgtcaaggccagcagcgagtggatcctcgactgcatcgcccacggcggcgacatctacggcgtcaccaccggcttcggcggcacctcgcaccgccgcaccaaggacgggcccgcgctccaggtcgagctgctcaggcatctcaacgccggcatcttcggcaccggccgcgacggccacacgctgccgtcggaggtggtccgcgcggcgatgctggtgcgcatcaacaccctcctgcagggctactcgggcatccgcttcgagatcctcgaggccctcgccaagctgctcaacaccggcgtcagcccgtgcctgccgctccggggcaccatcaccgcctcgggcgacctcgtgccgctctcctacatcgccgggctcatcacgggccgcccc

SEQ ID NO: 27221 - protein, 206 aa, Panicum virgatum
  misc_feature: Ceres CLONE 1875585
  misc_feature (41)..(206): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Functional homolog of the protein sequence given in SEQ ID NO 51139
  misc_feature: Useful for making plants with altered cell wall content and/or composition
  misc_feature: Functional homolog of the protein sequence given in SEQ ID NO 50787
  misc_feature: Useful for making plants with altered lignin content
MAGNGLIVENDPLNWGAAAAELAGSHLDEVKRMVAQAREPVVKIEGSTLRVGQVAAVAAARDASGVAVELDEAARPRVKASSEWILDCIAHGGDIYGVTTGFGGTSHRRTKDGPALQVELLRHLNAGIFGTGRDGHTLPSEVVRAAMLVRINTLLQGYSGIRFEILEALAKLLNTGVSPCLPLRGTITASGDLVPLSYIAGLITGR

SEQ ID NO: 27222 - DNA, 726 bp, Panicum virgatum
  misc_feature: Ceres CLONE 1875593
  misc_feature: Encodes the peptide sequence at SEQ ID NO. 27223
gagctgagagcagcaagccatggcgcctcccgtctcctccctgtcccgcatggcgtccagcccaatcccgtcgacgcagctccccaagcccagcagaaggacgctcgccgtcgcgccctgcagctccgcctcgtcccctccgggccacgccgccgcgcctcaggcggcgtcggcgggtcggagggggatgctggcgctgggcgcggggttcctggcctcggctgcgcttctgggtccggccggggacgccggggcgacgcgcatcgagtactacgcgactgtcggggacaagctctgcgacatggacctcgtcaagtcggggctcgcgtactgcgacgtcgaggttggcaccggcgcccagcccccgcgcggcgagctcatcaatgttcactacactgcgagatttcctgatggtacagtgttcgacagcacctacaagcgcggcaggccactgacaatgcgtatcggcgcagggaagatcctccgtgggcttgaacagggaatcagtggaggtggaggtgtgccgcccatgcttgttggtggaaagcgcaagcttatgatacctgcaactctggcgtacgggcctgaaccagcaggctgcttctcaggagattgcaacattcctggaaactccacacttctatatgaccttttcctcgtcgggatttacaagtgagcatccgatgagatggcaaggaacattcatgaattagaacagacaagagt

SEQ ID NO: 27223 - protein, 218 aa, Panicum virgatum
  misc_feature: Ceres CLONE 1875593
  misc_feature (110)..(214): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MAPPVSSLSRMASSPIPSTQLPKPSRRTLAVAPCSSASSPPGHAAAPQAASAGRRGMLALGAGFLASAALLGPAGDAGATRIEYYATVGDKLCDMDLVKSGLAYCDVEVGTGAQPPRGELINVHYTARFPDGTVFDSTYKRGRPLTMRIGAGKILRGLEQGISGGGGVPPMLVGGKRKLMIPATLAYGPEPAGCFSGDCNIPGNSTLLYDLFLVGIYK

SEQ ID NO: 27224 - DNA, 716 bp, Panicum virgatum
  misc_feature: Ceres CLONE 1875607
  misc_feature: Encodes the peptide sequence at SEQ ID NO. 27225
acggccgcctcgccttcctccccaccccggccgccatgctggccttcttcctcttcctgccgctcggcgtcatcctctccgtcatccgcatcaacatcggcatcgtcctcccttacaagatcaacttcgtcgccgccgccatcttcggcatccgcttccgcacctccggcctccgcgccccgccggccgacggcgagcggcgccggggcgtcctctacgtgtgcacgcaccggacgctggtggaccccatcatgctcaccacggccctgcagaagcccgtgcccgccctgacctacagcctcagccggctgtccgaggcaatcgcgcccatcaagacggtgcggctgacgcgcgaccgcgcgcgggacgccgagaccatgtcgaggctgctgcggcagggcgacctggcggtgtgccccgagggcacgacctgccgcgagccctacctgctgcggttcagcccgctgttcgcggagctcgcggacgacatggagcccgtggcgctggacgcgcaggtgacggcgctctacggcacgacggcgagcgggcacaagtggctggaccccgtggcgttcttcgcgaacccggtgccgtcgtaccgggtggagttcctgggcgccgtgccgcgggagtggacgcgcgccgggggcaggacgggcgtcgaggtggccaactgggtgcagcggcgcctcggcgaggcgctggggttcgagtgc

SEQ ID NO: 27225 - protein, 237 aa, Panicum virgatum
  misc_feature: Ceres CLONE 1875607
  misc_feature (51)..(169): Pfam Name: Acyltransferase Pfam Description: Acyltransferase
  misc_feature: SWISSPROT Homolog: EC 2.3.1.15 Glycerol-3-phosphate O-acyltransferase
GRLAFLPTPAAMLAFFLFLPLGVILSVIRINIGIVLPYKINFVAAAIFGIRFRTSGLRAPPADGERRRGVLYVCTHRTLVDPIMLTTALQKPVPALTYSLSRLSEAIAPIKTVRLTRDRARDAETMSRLLRQGDLAVCPEGTTCREPYLLRFSPLFAELADDMEPVALDAQVTALYGTTASGHKWLDPVAFFANPVPSYRVEFLGAVPREWTRAGGRTGVEVANWVQRRLGEALGFE

SEQ ID NO: 27226 - DNA, 678 bp, Panicum virgatum
  misc_feature: Ceres CLONE 1875635
  misc_feature: Encodes the peptide sequence at SEQ ID NO. 27227
ctccccacaggccacagcaccaccaccggagcacagagagagcagagcgccacaggccgtccgatcctccgcgcgaagcagatcagatggctctcgctctctccggctcctccgcgctccgcgccgcgctggcctcgctggcccccgccaggggctacgcggcgtcggcggcgtccggggccatgcggcgcgcggcggccgcggcggagggcgccgccgcgggggaggccaaggaggccgggcgcggcgccgcctccgagatctcctgggtccccgaccccgtcacgggccactaccgccccgccaactgggccgccgccgccgaccccgccgacctccgcgccgcgcacctcgcccgggcgtgagccccgcgcccgcccgcccccacccgtctgacataacataccaacaaagggaaaggtggggtggaggttcgtctggcgtcgtcgtccgccgcgcgcgcgcgcgctcgctccgtcacggcggcgggccggcatggccgggaagtcgtctcggttggtcgctgtgggacgctcgacgccgctgcatcatctcggcctcggccaatcgggagatacggtacagggaggagcggaggagcggccgctggtcgccgtggcgtgcgtgcgtgcgtggtgtggactggacgccctgttctagcttctcgctggtgctctc

SEQ ID NO: 27227 - protein, 92 aa, Panicum virgatum
  misc_feature: Ceres CLONE 1875635
  misc_feature (1)..(90): Pfam Name: LEA_3 Pfam Description: Late embryogenesis abundant protein
MALALSGSSALRAALASLAPARGYAASAASGAMRRAAAAAEGAAAGEAKEAGRGAASEISWVPDPVTGHYRPANWAAAADPADLRAAHLARA

SEQ ID NO: 27228 - DNA, 767 bp, Panicum virgatum
  misc_feature: Ceres CLONE 1875636
  misc_feature: Encodes the peptide sequence at SEQ ID NO. 27229
attcggtagcagcacctggcctattacctatagcttgctttgtcttagcactacgtaggcaactaggcactgcactgcacgtgctacttaatgcagtatatatacatatacagtacgtcatacgtgatccatccaagctacatcatatcgagcttccattcatggccaccaccaccgcacgaccaacgccgccggcgaccaacttactgcggctgttcctgacgctatcgccggcgagcagggtgatccccaagcagcaagggcagggcggtggctgcagggcaacgcggctggacggcgccggcgagttccggtgccgcacctgcggccgagcgttcgccacgttccaggcgctgggaggccaccgcaccagccacaagctcccgcgggtgcgcgccgacgggctcgacctcctgctcggcgcgaggcccggcaagggcgccgccgccagcgatgtccaccggtgcgacacgtgcggcgtcgtgttctccaccggacaggcgctcggcggccatatgcgacgccacaggtcgccgccggcgaccatcaaattcgtcgccttgtctgatgatggagaggatgacgatgcgagccacttgtccaccgccacgtcgttcatcaagttcatatgaattattgaacgatccatcagtatatatatgtcatcaacgttagttaatctggccagccggggtggtttcttcgtccaataactaatatgcatgtaataatacgccacaagaggattattttattttaatttgttg

SEQ ID NO: 27229 - protein, 156 aa, Panicum virgatum
  misc_feature: Ceres CLONE 1875636
  misc_feature: The sequence is a functional homolog of SEQ ID NO 1288 in the 10/666,642 US patent application
  misc_feature: The sequence is a functional homolog of SEQ ID NO 622 in the 10/374,780 US patent application
  misc_feature: Functional homolog of the protein sequence given in SEQ ID NO 51241
  misc_feature: Useful for making plants with modulated biomass
  misc_feature: The sequence is a functional homolog of SEQ ID NO 2200 in the 10/374,780 US patent application
  misc_feature: The sequence is a functional homolog of SEQ ID NO 250 in the 10/714,887 US patent application
  misc_feature: The sequence is a functional homolog of SEQ ID NO 250 in the 11/435,388 US patent application
  misc_feature: The sequence is a functional homolog of SEQ ID NO 558 in the 10/666,642 US patent application
  misc_feature: Functional homolog of the protein sequence given in SEQ ID NO 51242
  misc_feature: Useful for making plants with modulated salt sensitivity
MATTTARPTPPATNLLRLFLTLSPASRVIPKQQGQGGGCRATRLDGAGEFRCRTCGRAFATFQALGGHRTSHKLPRVRADGLDLLLGARPGKGAAASDVHRCDTCGVVFSTGQALGGHMRRHRSPPATIKFVALSDDGEDDDASHLSTATSFIKFI

SEQ ID NO: 27230 - DNA, 498 bp, Panicum virgatum
  misc_feature: Ceres CLONE 1875647
  misc_feature: Encodes the peptide sequence at SEQ ID NO. 27231
attactccggctagtccgcacaccgcggcccccaaccaacccggccagcccacgagcgaagccgcgagcccatccgccgaaacgcccggctgccgagctactactaccgagctgacgagacaaggcggcggcggcgggggcggcgttggcagcagcggctgccgcggaaggtctcgacctacccccggcgctcgcggaggcggccggccggcgaatgcgataggaggggggggggatggggtccaagtacacgcgcgggtgctgcgggtggctgatcgtggcgctccttgcggcgctggtggccacggcggcgatgttcgccatcatgaaccggaagcccggggggagggggcgccacatgaagccgctccccgtgccggggccgccgggggccatcgactccaagtaccgagacgcgctcggggtcgcgctccagttcttccaggtccagaaggcggggaagctggaaaacaatccgatgccgtgggcgggggactg

SEQ ID NO: 27231 - protein, 87 aa, Panicum virgatum
  misc_feature: Ceres CLONE 1875647
  misc_feature: SWISSPROT Homolog: EC 3.2.1.4 Cellulase
  misc_feature: Functional homolog of the protein sequence given in SEQ ID NO 50939
  misc_feature: Useful for making plants with altered cell wall content and/or composition
MGSKYTRGCCGWLIVALLAALVATAAMFAIMNRKPGGRGRHMKPLPVPGPPGAIDSKYRDALGVALQFFQVQKAGKLENNPMPWAGD

SEQ ID NO: 27232 - DNA, 2181 bp, Panicum virgatum
  misc_feature: Ceres CLONE 1875665
  misc_feature: Encodes the peptide sequence at SEQ ID NO. 27233
gtgcgacgcgacgccaggccaggccggtccccgaccccaatcctgctgtgcctgccaccctgtgagtctctgtgacccatcgattgctttgcccgcccggccgcccccagcaccaggccgctgccggctgcccactgccggtcttccgcagctgcaggtgaatccgcttggcatctcgccttgctttgcccgccactttctcctccccacgtcctcgtagcgctctcgtttcccaggacgaaagcccagagcctcgcgatgcggcggcttctcgcgctggcggcgtccctgctggcgctgcgggcggcgctggccaccgacccctacgccttcttcgactgggacgtctcctatgtcaccgcggcgccgctcggcatcaagcagcaggtgataggcatcaacggcaagttcccgggccccgtcgtgaacatcaccaccaactggaacgtcgtcgtcaacgtgctcaacgacctcgacgagccgcttctcatcacctggaacgggatccagcaccggaagaactgctggcaggacggggtgctgggcaccaactgccccatcccgtccggctggaactggacgtacgagttccaggtcaaggaccagatcggcagcttcttctacttcccctccaccggcctgcagcgcgccgccggcggctacggcggcatcgtcgtcaacaaccgcgacgtcatcgccgtgcccttcggccgccccgacggcgacatcaccatcctcatcggcgactggtacaacaagaaccacacggacctgaggaagatgctggacaaagggaaggacctggggatgacggacggcgtgctgataaacggcaagggcccgtaccggtacaacgacagccttgtgccggccggcatcgagtacgagaccttcaatgtgcatccgggtaatcgattgttcaggcccctcgtgaggctcgtgttaccactgtactactgcattaatccgtaagactgacgggcgggcaagtggaggagaactggagcaggttgcatggcttttgagttgtgcagagcgagagtattgttttctcttaggacaagaatcttgacaccctgtttcatagtactaacttagtaactttccaggtataaaaataaggggtggtcactcacctttagtctgtagagtgttaagacatgttaacttcagagttttcttgctgacttcagtcctctctggtggtgcagtactctgtcctgttagttctgaactgacactatacactaccatcatatcagtcctgcacagtccacgccatcttactgtagtcttatcatccagtgacagaaatgtttggtagataacagtgacagaagcttgggagcaagaggtcgttagattgcagagtgctgacatgctgccacaatataacccaaaaaaaaaactcccttgatcccttcaactattgtgccgttcaacttacggcacaatctttcgagagagaaaaaatggcacaaaaaatgattcattcatcattcaagcatcaatgccagtcagtataggtatatagttctgttaccacgcaaatagcttccagttgataaagtagctgacaatgggaaactgaaaggtacacaacgaactgaagacggagatccgaagtgactgtatactgaaatctctgcatttttcgttcgtgacagggcggatccagggaataaaaattaggggaggctggctattatagcccactcatcaacacatgtcttattcccaaaatatgttaacgaaatagtctagaatagtttcatgtgaaaacatagaaaaagtacatcacaagaaaaagtaaaaatgacatatatgaattccgatccataccagactaatggataatcctatgcctatttccattagtcgtgttcttcacgaggagtaatctacacaagggacattaaattagtgacatggagaacaataactttaaaaactcttaaattcagatagaggtaatcataccactacttttttgttaggcactagcatgcggtgttttttcatctcttcaaaacattgtatgattttatcattactgatgcttctaaatatctctttcttttaggaaaagtatatactcggtacatccaaactatgtaagtagtcttatttatgtcctaggactaaactttaaccctcttatttggatgactattagaacgg

SEQ ID NO: 27233 - protein, 237 aa, Panicum virgatum
  misc_feature: Ceres CLONE 1875665
  misc_feature (29)..(145): Pfam Name: Cu-oxidase_3 Pfam Description: Multicopper oxidase
  misc_feature: SWISSPROT Homolog: EC 1.10.3.3 L-ascorbate oxidase
MRRLLALAASLLALRAALATDPYAFFDWDVSYVTAAPLGIKQQVIGINGKFPGPVVNITTNWNVVVNVLNDLDEPLLITWNGIQHRKNCWQDGVLGTNCPIPSGWNWTYEFQVKDQIGSFFYFPSTGLQRAAGGYGGIVVNNRDVIAVPFGRPDGDITILIGDWYNKNHTDLRKMLDKGKDLGMTDGVLINGKGPYRYNDSLVPAGIEYETFNVHPGNRLFRPLVRLVLPLYYCINP

SEQ ID NO: 27234 - DNA, 1307 bp, Panicum virgatum
  misc_feature: Ceres CLONE 1875691
  misc_feature: Encodes the peptide sequence at SEQ ID NO. 27235
aaccagtccaccacaccgaaggcacacgaagcaaaaggagagagaaaggaaaaaaaaaggcgcagaagacaggcgaggaggcagcgggcgaactcccaaccaaaatccccaaatccacgagctcccgccccgatctcgatctcaccggccgccgccgccgccgccgccccccgccgcgatgatggatccggagatgctgcggctggcgcaggagcagatgcgccgcatgtcgccggacgacctcgccaggatgcagcagcagctgatgtccaaccctgacctcataaggatggcgtctgagagtatgaagaacatgaaagctgaggatttaaggcgagcggcacagcagatgaatcaaacaagaccagaggacatgcgtgatatgactgagaaactcgccaacactacgcccgaggagtttgctgctctgaaggctcaagcagacgctcaaatgtcgtatgctatatctggtgccaagatgctaaagaagcagggaaacgagcttcataacctgggacagtatgcggatgctgccaccaaatacaaactggccaaggataatttaaaaaacataccatcgtctgcggcgcatactctgcaattgcaatgtacccttaatctaatggcttgttatttgaagacggggcaatttgaagaatgcataagcgaaggttcagaggttctagcctatgattcaagcaatgtcaaagcatattatcggaggggtcaagcatataaagaacttggaaaattggaggccgctgtttccgacctgagtaaagcccatgaaatttcccctgaggatgaaactattgctgaggttctcagagatactgaagacaaacttgcacgggaagggggaggactgaacatgcgaaaaggtgttgttattgaagaggttgtagaagatgatacttcgcagccatcgagcagtcaaagaagttctcctgggtatactgtttcacagccacctgaaagccatcaagcagtcaggccatcccaaaattatgtttccaagagcgatagtgaaggcttatcgaagttaggagttgaaggaatgtcacctgaacttgtcaaaactgccaccaacatgattggcacaatgaaaccagaagaacttcagaaaatgttcgaagttgcttcttcaatgaatggcactagctccattggtcccaatatgggacccaatatgccagaaatgtcacctgatatgcttaagatggcatctgatatgattgggaagatgtctcctgatgaactacaaaatatgatgaattttgcttctcagatgggtgagcctggtggtg

SEQ ID NO: 27235 - protein, 376 aa, Panicum virgatum
  misc_feature: Ceres CLONE 1875691
  misc_feature (176)..(209): Pfam Name: TPR_1 Pfam Description: Tetratricopeptide repeat
  misc_feature: SWISSPROT Homolog: EC 5.2.1.8 Peptidylprolyl isomerase
MMDPEMLRLAQEQMRRMSPDDLARMQQQLMSNPDLIRMASESMKNMKAEDLRRAAQQMNQTRPEDMRDMTEKLANTTPEEFAALKAQADAQMSYAISGAKMLKKQGNELHNLGQYADAATKYKLAKDNLKNIPSSAAHTLQLQCTLNLMACYLKTGQFEECISEGSEVLAYDSSNVKAYYRRGQAYKELGKLEAAVSDLSKAHEISPEDETIAEVLRDTEDKLAREGGGLNMRKGVVIEEVVEDDTSQPSSSQRSSPGYTVSQPPESHQAVRPSQNYVSKSDSEGLSKLGVEGMSPELVKTATNMIGTMKPEELQKMFEVASSMNGTSSIGPNMGPNMPEMSPDMLKMASDMIGKMSPDELQNMMNFASQMGEPGG

SEQ ID NO: 27236 - DNA, 659 bp, Panicum virgatum
  misc_feature: Ceres CLONE 1875691-R
catgagaaactctatgaaagaccctgcaatgcggcaggtaagaaatccttagccagagaaaattatgttttgacttttgaatcatgatgccaggaaaattcatgctttgacttttaacatctcttgggccttttttcttatctaacatctcctgtgccttttttttttctatttaacagatgatggcaaacatgatgaagaacatgagccctgagatgatggcaaacatgagcgagcaatttggaatgaaactgtcaaaggaggatgctgcaaaagctcaacaagccatgtcatcattatcccccgaggatttggatagaatgatgagatggatggagcgagcacagagaggggtagaagttgcgaagaagacaaagaactggcttttgggccggcgaggcttgatcctcgctattgtcatgctgatcctggcattcatccttcaccagctcgggtttatcggcacgtgatggtgtgatcttgtctctgcgtgtggcaaataatttgttcgatagtgatggagtttctccttgctcacaactgttttggagcacccgggaaattccgaatacgagaattctttgagtctgtatctgttttagaagtgtaactgtgtaactttgtttataagcaataacattcatcatgtttcttcaagc

SEQ ID NO: 27237 - DNA, 633 bp, Panicum virgatum
  misc_feature: Ceres CLONE 1875697
  misc_feature: Encodes the peptide sequence at SEQ ID NO. 27238
ttttatcaatgatgctggggccgatattcctgatgaggatgttgttaggggctcaagacgtcattcgatgcctatgagggatgaagaagaggacattgatgagattgagagacaagtacgggagagatatgcaagatccactcatattgagtatggtgaggaagctgcagaagtggaacaacaagctctgttgccttctgtgaaggatcctaaactatggatggtcaaatgtgcgattggacatgagagagagactgcgatttgtctgatgcaaaagtacatcgataggtcagatcttcagataaagtctgtcgtggcgttggatcatctaaaaaattatatttacgttgaagctgaaaaggaggcccatgtcaaagaggcttgcaaaggtctacgaaatatttatgcttcagcaaaaataaccttagttccaataaaagaaatggcagatgtcctctcggttgagagcaaatctgttgatctttcaagggattcttgggtccgaatgaagttgggcatatataaaggtgaccttgctaaggttgttgatgttgacaatgtacgccaaagagtggatgtaaagctgatccctagaatagatctacaagctttggctagtaagctggaagggag

SEQ ID NO: 27238 - protein, 210 aa, Panicum virgatum
  misc_feature: Ceres CLONE 1875697
  misc_feature (113)..(160): Pfam Name: Supt5 Pfam Description: Supt5 repeat
  misc_feature (37)..(81): Pfam Name: Supt5 Pfam Description: Supt5 repeat
  misc_feature (163)..(194): Pfam Name: KOW Pfam Description: KOW motif
FINDAGADIPDEDVVRGSRRHSMPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEG

SEQ ID NO: 27239 - DNA, 1474 bp, Panicum virgatum
  misc_feature: Ceres CLONE 1875710
  misc_feature: Encodes the peptide sequence at SEQ ID NO. 27240
gacacggccactggatctggagtcacctcaccagatagctataagctatactctccagatccgcgtagcgctcgttgccgtgcatcactccactgctctctagatcgccggcgcgatgctcgctgcctcgtccggccaaatggtcgggctctgcttcccgcgccgctctccgtccccgctcctcagcccccgccgccgcctcctccctcggcgccccgccgcgaggccgcgcggcggcctgccccggtggcggtgctcgtccgccgcctctccgccgcccccgtccgccgactccgcgcttgaacatccacttcgtagaaagtgctctcctctacttgagagtgttctattacctggtggaagtgacttgaacgtgcatgaatggaaggcagttccagatatctggaggacagcagcagagaaatatcctgacctcgtagctgtaatagatccttatcatgaaccgccgacagaatggacatatacacagcttgaacaagaaatattggatttttctcaaggtctaagggccattggcgttgctccagatgaaaagctagctctatttgctgacaactcatgtcggtggttagttgcagatcaaggaatcatggctactggtgcaatcaatgttgttagaggaacaagatcttccgatgaagaattgtttcaaatatacactcattcagaaagcattgcagttgttgtggacagtcctcaattctttaaccggcttgcagaatctttcatatcaaggattaatgcaagattcattgtgctactttggggagacaaatcatgcatagatagcaaagctgtgaaggatataccactttatgactacaaggatatgactaaacttggccgggagagtcgtaatactctgcttctttctggccaccaaggtcagcaagaagtcttcgaaactattgctccagaagatgtggcaacacttatatatactagtggaacaagtggcatgccgaaaggtgtaatgctgacccaccgaaatctcttgcatcagataaagaatttgtgggacattgtaccagcagaacctggtgataggttcgtaagcatgcttccaccatggcatgcttatgagcgtgcttttgagtacttcatcttcacttacggaatccagcaagtttacactaccgtcaagtacctgaaggaagatttgcagcgttaccaacctcagtatattatatcggtaccacgggtctatgaaactttgtacagttccattcataggcagatttcttccagttcggctgctcgaaaaatcattgctctttcacttatcaagataagcttactatatatggagaccaagaggatctatgagggaacagttttatcgaacaatcctgttcaaccatcattcattgtctatatggtcaagtggatatgggcaagatttattgccacatttttgtggcctttgcataatctggcaaagatactagtctac

SEQ ID NO: 27240 - protein, 452 aa, Panicum virgatum
  misc_feature: Ceres CLONE 1875710
  misc_feature (122)..(452): Pfam Name: AMP-binding Pfam Description: AMP-binding enzyme
  misc_feature: SWISSPROT Homolog: EC 6.2.1.3 Long-chain-fatty-acid--CoA ligase
MLAASSGQMVGLCFPRRSPSPLLSPRRRLLPRRPAARPRGGLPRWRCSSAASPPPPSADSALEHPLRRKCSPLLESVLLPGGSDLNVHEWKAVPDIWRTAAEKYPDLVAVIDPYHEPPTEWTYTQLEQEILDFSQGLRAIGVAPDEKLALFADNSCRWLVADQGIMATGAINVVRGTRSSDEELFQIYTHSESIAVVVDSPQFFNRLAESFISRINARFIVLLWGDKSCIDSKAVKDIPLYDYKDMTKLGRESRNTLLLSGHQGQQEVFETIAPEDVATLIYTSGTSGMPKGVMLTHRNLLHQIKNLWDIVPAEPGDRFVSMLPPWHAYERAFEYFIFTYGIQQVYTTVKYLKEDLQRYQPQYIISVPRVYETLYSSIHRQISSSSAARKIIALSLIKISLLYMETKRIYEGTVLSNNPVQPSFIVYMVKWIWARFIATFLWPLHNLAKILV

SEQ ID NO: 27241 - DNA, 620 bp, Panicum virgatum
  misc_feature: Ceres CLONE 1875710-R
  misc_feature: Encodes the peptide sequence at SEQ ID NO. 27242
gtgccatagttgttccaaacagtgatgaagttctggcagaagcaaaaaggaagtctctcgttgatgagaatggcgaagtggcgaaagataaggtcataaacatgctatatgatgagctgagaacctggaccgcacattgctctttccgcatcggccctatcatgatcgtcgatgaaccatttacaattgacaacggactgatgacacccaccatgaaaacaagacgggacaaagtgactgcaaaataccaaacagagatcgaagcgttgttcaagtgagatatggagtgttggtgcgtgcgagtgcagacagcagctgcaataagaagatatatagagaacgatgcgtccatctgatagaaacaatgctgttgcatttaataataaataaatatactaatagatgtatagtacatgctaacgttccgacctttcagcaatcaaacatgtacttaagacatgaaaagaaacaatgtgtgtactaaggccctgtttggattttaggggtaaagatttacccaaaggtaaatgttttacacctcacatttgcctctaactaatttaccccatgtgatgtttggatttaggggtaacatgaggataaaagtagttgaaaatagc

SEQ ID NO: 27242 - protein, 91 aa, Panicum virgatum
  misc_feature: Ceres CLONE 1875710-R
  misc_feature: SWISSPROT Homolog: EC 6.2.1.3 Long-chain-fatty-acid--CoA ligase
AIVVPNSDEVLAEAKRKSLVDENGEVAKDKVINMLYDELRTWTAHCSFRIGPIMIVDEPFTIDNGLMTPTMKTRRDKVTAKYQTEIEALFK

SEQ ID NO: 27243 - DNA, 350 bp, Panicum virgatum
  misc_feature: Ceres CLONE 1875716
  misc_feature: Encodes the peptide sequence at SEQ ID NO. 27244
tttccgcgctgcgcttgtagacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccttcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaagaactcaaccacttcgtgcttcacaaacaagaaaggccggttcaggggg

SEQ ID NO: 27244 - protein, 101 aa, Panicum virgatum
  misc_feature: Ceres CLONE 1875716
  misc_feature: SWISSPROT Homolog: EC 1.14.13.77 Taxane 13-alpha-hydroxylase
  misc_feature: Functional homolog of the protein sequence given in SEQ ID NO 50272
  misc_feature: Useful for making plants with modulated oxidative stress sensitivity
MVYALLLVALAAVAAAAVLRHYLPLLRGGLPKGSFGWPFIGETIGFLHAHPSNTAGGFLKEHVARYGTVFKSHLFGSPAVVSCDEELNHFVLHKQERPVQG

SEQ ID NO: 27245 - DNA, 667 bp, Panicum virgatum
  misc_feature: Ceres CLONE 1875720
  misc_feature: Encodes the peptide sequence at SEQ ID NO. 27246
cacttcttcctcgagaaaaacagtttgcatccaccgcaagaaagaggcggctggggtgctggagagcgagcagctcgggcgggcatggcggagaggctgacgccggagcaggccgacgagtgcaaggagatcttcgacctgttcgacgccgacgaggacggcaaggacgccgcacccgcctcacgcgcgcctagctctctctgccgccacgcacaaaaaaactaatcttttctccgtctccttggcaacacccccgctgcaggtcgcatcgccacgggcgagctcgtgacggcgctgcgctcgctgggccagaacgtggacgaggccgaggcgcggcgcttcctggtggacgcgggcgtccccgcgggcgccgccgccatcgacctcgcggcgttcctggccatggcggcgcgcaggatgggcgccgggccgtcggcggagcgcctcgccgagtgcttcgacgtgttcgacgacgcccgcagcgggtccatccccgcggagcagctgcggcaggtgatggtgagccacggcgaccggctcacggaggaggaggccgacgcgatgctccgcgaggccgacccccgaggcgagggccgcgtcgagtacaaggagtacgtcaaggtgctgctcagggacaggaaatgatccggtggcccgtcgccgccgg

SEQ ID NO: 27246 - protein, 80 aa, Panicum virgatum
  misc_feature: Ceres CLONE 1875720
  misc_feature: SWISSPROT Homolog: EC 3.4.21.105 Rhomboid protease
MAARRMGAGPSAERLAECFDVFDDARSGSIPAEQLRQVMVSHGDRLTEEEADAMLREADPRGEGRVEYKEYVKVLLRDRK

SEQ ID NO: 27247 - DNA, 906 bp, Panicum virgatum
  misc_feature: Ceres CLONE 1875737
  misc_feature: Encodes the peptide sequence at SEQ ID NO. 27248
ggccttgcctcgatttggaactgccccgtgcacgtgcgccgccgcgatccgcaccctccccgcctcgcctcggggatcccgccgccgttccacccgcctctgcttccagagagagagagagagagagagagagagatggccaaggccaggtcgtcggcgaagcagtcgcgcgcgcaggcgccggcgcagcagcagaacggcgcccacgcgctctcctccaagctcgcgaggtacctcgacccggaggccacctgggacaaggaccagctgctggacgcggtgcactggatccgccaggcggtggggctcttctgcggcctgctctggggagccgtccccctcgtcggcgccgtctggatcgcgctatttatggctatttcgacgggcattatttattggtactacgcatacgttttgaagattgacgaggaggaatatggaggccatggggcgctacttcaggagggactttttgcttctttcacccttttcctgctttcgtggactctagtatacagtttggctcacttttgagaagctcctttgctgcacataccatgcgatctttgctcaccgtgtcagcagaagaaactcaccaggaaagtgtagattaaggagcatttagaacaagcattgtatcaaaatgggtcggagttgtaatgttatttcccaaccccagtgtaattttggtactatgggtttagctcagtgcgaggtagaacactgccaatgaagtcttcaatcggaggagaaaatgttgatcactgagtttgcagtcgaacactattcagttgcccaagccatgaattcgatgtacaacatttaacgcatcattgttctaagttttttatatgtgatgttgggtgaactatcagaaagcttattttgtcagatgaaccatactag

SEQ ID NO: 27248 - protein, 132 aa, Panicum virgatum
  misc_feature: Ceres CLONE 1875737
  misc_feature (19)..(132): Pfam Name: Rab5ip Pfam Description: Rab5-interacting protein (Rab5ip)
MAKARSSAKQSRAQAPAQQQNGAHALSSKLARYLDPEATWDKDQLLDAVHWIRQAVGLFCGLLWGAVPLVGAVWIALFMAISTGIIYWYYAYVLKIDEEEYGGHGALLQEGLFASFTLFLLSWTLVYSLAHF

SEQ ID NO: 27249 - DNA, 619 bp, Panicum virgatum
  misc_feature: Ceres CLONE 1875753
  misc_feature: Encodes the peptide sequence at SEQ ID NO. 27250
gtggcggaggtggactcggcactgccgtggttttaaaagcagagcaatcccccctgccccgtgcccacctcgatttgcccaatccaaggtcgcggtcgcgcgcatcgatctcgctcggggagttggggatctcaccttcccccgtcgatctcgacccccatccattcaccccgcgtagcgcaggagagccgcggcggcggatatgtccaaggtctacaccctcgaggaggtcgccaagcacaactccaaggacgattgctggctcatcatcggcggcaaggtgtacgatgtgacaaagtttttggaagaccacccaggaggtgatgatgttctgctgtcctcaactgccaaggacgcaactgatgattttgaagatgtcgggcacagcaccactgcccgtgcgatgatggatgagtacctgttgggtgaaatcgactcatcaacgatccctgctaggacgaagtatgtcccccccaagcaaccgcactacaaccaggacaagaccccggagttcattatcaagatcctccagttcttggttcccctggcaatcctgggcttggctgttgccgttaggatctacaccaagtcagagtctgcttagctttgttgcccttgc

SEQ ID NO: 27250 - protein, 133 aa, Panicum virgatum; identical to SEQ ID NO: 14686
  misc_feature: Ceres CLONE 1875753
  misc_feature: SWISSPROT Homolog: EC 1.7.1.1 Nitrate reductase (NADH)

SEQ ID NO: 27251 - DNA, 547 bp, Panicum virgatum
  misc_feature: Ceres CLONE 1875762
  misc_feature: Encodes the peptide sequence at SEQ ID NO. 27252
ctctcgaaaccctagtcccgctccaccccaccccccccccgccgcagctcccccgtctcgccccccacctccggctccttcgcgaaccgcctcctcaaccggcgggagagagagaagagatggcgggccagggcgaagggccggcgatcggcatcgacctcggaacctcctactcgtgcgtcggcgtgtggcaacacgaccgcgtcaagatcatcgacaacgaccacgggaaccccaccaccccctcgtacctcgccttcaccgactcgcaccgcctcatcagagatacctccaagagccacggctccttgaaacccatccactccccctgaaatgcggattgtcccaacaactgaagggtgtcggtgacattctatgcagaaaagttttcaacagctaggcattaatggtcggctgtgtagacgacacatgactcccgagggtgggaacaaatataaaccttaaattttctcaacaaccttgaaaagtaaccgtgctcgaatgaatagaaaccaaccctactttttccttttgagggggaataaaa

SEQ ID NO: 27252 - protein, 70 aa, Panicum virgatum
  misc_feature: Ceres CLONE 1875762
  misc_feature: Functional homolog of the protein sequence given in SEQ ID NO 50336
  misc_feature: Useful for making plants with modulated heat sensitivity
MAGQGEGPAIGIDLGTSYSCVGVWQHDRVKIIDNDHGNPTTPSYLAFTDSHRLIRDTSKSHGSLKPIHSP

SEQ ID NO: 27253 - DNA, 538 bp, Panicum virgatum
  misc_feature: Ceres CLONE 1875784
  misc_feature: Encodes the peptide sequence at SEQ ID NO. 27254
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcggcggcggctacggtggcggcgggggcggctacgggcgccgccagggcggcggtggctactctggcggcggtggctgcagtggccgtggaggctccgggatctgcggcggctacgg

SEQ ID NO: 27254 - protein, 147 aa, Panicum virgatum
  misc_feature: Ceres CLONE 1875784
  misc_feature (10)..(81): Pfam Name: RRM_1 Pfam Description: RNA recognition motif. (a.k.a. RRM, RBD, or RNP domain)
  misc_feature (48)..(147): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYGGGGYGGGGGGYGRRQGGGGYSGGGGCSGRGGSGICGGY

SEQ ID NO: 27255 - DNA, 736 bp, Panicum virgatum
  misc_feature: Ceres CLONE 1875797
  misc_feature: Encodes the peptide sequence at SEQ ID NO. 27256
atctcgccactgctcctgccacactgcgaccagcagctagcagctccgcatcaagcgcgcaagggcagagggcgccatggcgcgggagcaggcgctgctgtcgacggagatcgtgaaccgcggcgtggagccgtcgggcccggacgccgggtcgccgaccttctcggtgcgcgtgcgccgccgcctgccggacttcctgcagtcggtgaacctcaagtacgtgcggctcgggtaccactacctcatcagccacggcgtgtacctggccaccatccccgtcatcgtgctggtgtgcggcgccgagctgggcagcctcagccgcgacgagctctgggccaaggtgtggggggaggccacctacgacctcgccaccgtgctcgccttcctcgccgtcctcgccttcaccatctccgtctacatcatgtccaggcccaggcccgtctacctcatcgacttcgcgtgctacaagcccgccgacgagctcaaggtgtccaaggcggagttcatcgagctggcgcgcaagtcgggcaagttcgatgaggagagcctggcgttccagtcgcggctgctggccaagtccggcatcggcgacgagtcgtacatgcagcgctgcgtgttcgagcccaacgccaactgcgccaccatgaaggagggccgcgcggaggcctccacggccatgttcgcggcgctggacgagctcttcgacaggtgccgcgtcccgccccagggacgtggg

SEQ ID NO: 27256 - protein, 219 aa, Panicum virgatum
  misc_feature: Ceres CLONE 1875797
  misc_feature (114)..(219): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREQALLSTEIVNRGVEPSGPDAGSPTFSVRVRRRLPDFLQSVNLKYVRLGYHYLISHGVYLATIPVIVLVCGAELGSLSRDELWAKVWGEATYDLATVLAFLAVLAFTISVYIMSRPRPVYLIDFACYKPADELKVSKAEFIELARKSGKFDEESLAFQSRLLAKSGIGDESYMQRCVFEPNANCATMKEGRAEASTAMFAALDELFDRCRVPPQGR

SEQ ID NO: 27257 - DNA, 659 bp, Panicum virgatum
  misc_feature: Ceres CLONE 1875803
  misc_feature: Encodes the peptide sequence at SEQ ID NO. 27258
aagtaatcaacgccatctacgagccaaccatccttgttagggccttaatcaatgcgaaattaagagaccagccatcaccagcgcagcagcgctggtatacatgacctcaggcagcagctccatgccagcttaacgcggcggcagggcaggcagccatggagaaggaggcagcgccggcggcggagcttgagatcctcggggagtgccagtacaccggcgagccggcgttggtgcggccgagccggcccacgccgcggcacacgctgcacctctccaacctcgacgaccagcggttcctccgcttctccatcaagtacctctacgtgttcgccgccgccgtgcccggcgacgccctgcgcgcggcgctcgccagggtgctcgtcgactactacccgctcgccggccgcctccgccccagcgacgacgacgaggggaagctcgtcgtggactgcaatgccgagggggcgctcttcgccgaggcctgcctgccggggctcaccgccgccgagttcctccgcggccgcgccaggccgcacaagtcctggaggaagctgctctacagggtggaggcgcagagcttcgtcgccgtgccacctctcgtcgtccaagtcacccggctgggctgcggcggcatgatcctctgcacggccatcaaccca

SEQ ID NO: 27258 - protein, 167 aa, Panicum virgatum
  misc_feature: Ceres CLONE 1875803
  misc_feature: SWISSPROT Homolog: EC 2.3.1.162 Taxadien-5-alpha-ol O-acetyltransferase
MEKEAAPAAELEILGECQYTGEPALVRPSRPTPRHTLHLSNLDDQRFLRFSIKYLYVFAAAVPGDALRAALARVLVDYYPLAGRLRPSDDDEGKLVVDCNAEGALFAEACLPGLTAAEFLRGRARPHKSWRKLLYRVEAQSFVAVPPLVVQVTRLGCGGMILCTAIN

SEQ ID NO: 27259 - DNA, 715 bp, Panicum virgatum
  misc_feature: Ceres CLONE 1875810
  misc_feature: Encodes the peptide sequence at SEQ ID NO. 27260
cttcttccacctcggcctccactccctgccgccgagctcaagttctaccccgccgatgacgtgaaaccgcgcaagcccagcacccgcaagccgaaacccaccaagctcaggtcgtccatcactccgggcaccgtactgatcctgctcgctgggaggttcatggggaagagagttgttttcctcaagcagctcaaatccggcatgctccttgttactggacctttcaagatcaacggagtcccaatccgccgtgtgaaccagacctacgtcgttgcaacctcaacgaagattgatgtctctggtgttaacgtgaagaaatttgatgacagctactttgccagggaaaagaagaagaaggcaaagaagaccgagggtgaacttttcgagaaagaggaggcgaccgaggacctgccgcagttcaagaaggatgaccagaaggctctggatgctgcgctgatcaaagctattgaggccgtgccagatctgaaaacctaccttggtgcacggttctctctcagggatggtgataagccacatgagatggttttctagaatagttggcgctaggtgcgaagctcaatagtcactttgcttggtctacctgagagagctcttgaattttgtacctgaccggtgaacctttggtttctgtttgattcattgtcaaatctttaatgaagtcattgctccttaagttagcattgctttgcacagt

SEQ ID NO: 27260 - protein, 183 aa, Panicum virgatum
  misc_feature: Ceres CLONE 1875810
  misc_feature (77)..(183): Pfam Name: Ribosomal_L6e Pfam Description: Ribosomal protein L6e
LLPPRPPLPAAELKFYPADDVKPRKPSTRKPKPTKLRSSITPGTVLILLAGRFMGKRVVFLKQLKSGMLLVTGPFKINGVPIRRVNQTYVVATSTKIDVSGVNVKKFDDSYFAREKKKKAKKTEGELFEKEEATEDLPQFKKDDQKALDAALIKAIEAVPDLKTYLGARFSLRDGDKPHEMVF

SEQ ID NO: 27261 - DNA, 703 bp, Panicum virgatum
  misc_feature: Ceres CLONE 1875870
  misc_feature: Encodes the peptide sequence at SEQ ID NO. 27262
aatccgtttgcttcttggtatgctcaaaccttgaagaacacagcagcatggtcctctgttcttgctttcttccgtccttgctctgttttgcacagtaaagtacagaggagataggatttaggccttccttttctttcctccgcctcctttccttttgttccattttgcttggacttctctgttccctgatggattactgacatgtgccgtgcaaaattaacagggtcgtgatcgataacgatgcctccgacgacgcgacggtgatccgggtggacagcgtaaacagccacggcacgctgctcgccgtcgtccaggtcatcgccgacctcaacctcgtcatccgcaaggcctacttctcctccgacggcaactggttcatggacgtgttcaatgtcaccgaccgtgacggcaacaaggttgttgacgcctcaaccatcgcctacatccagaagacgctggaggcggacgactggtactacccagagacgcgcaacacggtgggcatcgtgccgtcggaggagtacacctccatcgagttgacgggcaccgaccggccgggcctgctctccgaggtgtgcgcggtgcttgtcgtcatgggttgcgcggtccagagcgccgagctgtggacgcacaacacgcgcgtcgccgccgtcgtgcacgtcaccgacgccgagtccggcggcgccatcgaggacgccggctg

SEQ ID NO: 27262 - protein, 108 aa, Panicum virgatum
  misc_feature: Ceres CLONE 1875870
  misc_feature: SWISSPROT Homolog: EC 2.7.7.59 [Protein-PII] uridylyltransferase
MDVFNVTDRDGNKVVDASTIAYIQKTLEADDWYYPETRNTVGIVPSEEYTSIELTGTDRPGLLSEVCAVLVVMGCAVQSAELWTHNTRVAAVVHVTDAESGGAIEDAG

SEQ ID NO: 27263 - DNA, 683 bp, Panicum virgatum
  misc_feature: Ceres CLONE 1875870-R
  misc_feature: Encodes the peptide sequence at SEQ ID NO. 27264
accgcgccgggcctgctctccgacatcacccgcatcttccgggagaacgggctcaccatccggcgcgccgagatctcgtccgccggcggcgaggccgtggacacgttctacctgtccgacccgcagggccaccccgtggaggccaagaccatcgaggccatccgcgcgcagatcggcgaggccacgctgagggtgaagaacaacccgttcgccgccggggacggcgcggcgagcaaggacgccggcgtcgcgggcgccggcgccggtgccggcacgacggcgttcatcttcgggaacctgttcaagttctaccggccgttccagagcttcagcctcgtcaagctctactcgtagactacctggttgatttctcaatcgcaggttctgtacatagatttcggttgattattggtctttcaggcatcactgtacatatggttatggccagttatgggtgtagattaagattcaaaagtagaaatttaggggagaaaatattggctcagctcccaaaagatttgtagcagataggaagtaagcaaagcagatggttactgtgtattactccttaggatttagggttaaagtactggggtgtgcaactgtctctgtaaatactcgtcttgtacatgtgctcatcacctcatgcatattcttgaggggagtaaatacaggagaaaaac

SEQ ID NO: 27264 - protein, 117 aa, Panicum virgatum
  misc_feature: Ceres CLONE 1875870-R
  misc_feature: SWISSPROT Homolog: EC 2.7.7.59 [Protein-PII] uridylyltransferase
TAPGLLSDITRIFRENGLTIRRAEISSAGGEAVDTFYLSDPQGHPVEAKTIEAIRAQIGEATLRVKNNPFAAGDGAASKDAGVAGAGAGAGTTAFIFGNLFKFYRPFQSFSLVKLYS

SEQ ID NO: 27265 - DNA, 1388 bp, Panicum virgatum
  misc_feature: Ceres CLONE 1875883
  misc_feature: Encodes the peptide sequence at SEQ ID NO. 27266
aatccctgtactttcccgggtccagccagaggcagaaaaagcagaaccgtgttctatgcttccaaggtccagggccttgggatcagcggcgcggcgcttgggcctggtcgcggctccagcccccgcgcgcgcgtcctcggcttcggcagcgcggcggccgtgcccgccgtccgacggcgacgaggccggggaggatgagcttcttcggccgccccacgggcagccgctggaggagcggcggtggcctcgccgcggagagcagcagcatcgggtaatgctccaaccaatcgtcgaggcgccatcaataattaacaaaacgacacgtgcgtatggggcagaggcgaacccaactactctactgttgccacgcaacacgataaggagagaattctcatttatcacaacagccgccaaagatcattctgtcttgacccagcaacttctagattcgcgacatgatacagtagatgaagtaggtaccatagtcacaaagttcctgggtcgaccgggtcgaggaacggggtcgagggtcgagggtcgtcactttataaaattgtggtacgaagggggtatacctctgcggaacaataaattattatgtggaacatgaccctgattcatccgggtcgatatttttgggtcgatgcgtctttaaaaagacaaaaactatatatgtgctactaatgaagaaactaatatgcacaaacatataagaaatgtataaaaagagtacatttagaccatagtacacgtactcggctcattatctaacaaaaaccacacccttaaccttcttatcccaattaaatctgctagtaatggggctgcgacccctctcaaaccgggacgcgatccaatcttgaatgggacactgaccctctttgaccccgaccctcgaatcggaacggcgttcccgggtcgtgggacgaagcatcgaccccgaatcctgtgactatggtaggtacagaacatgatccgttcattgagttgaaagcgaggttcatggacttcaaacagcgaaactatgtggaaaatttttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactccaggtagaaaatgtattggtggtaggtcacagccgatgtggtggcatccaggcactaatgagtatgaaagatgattcgacctctggaagctttattaagaactgggtttcaattgggaagagcgcaaggataagcacaaaagctgc

SEQ ID NO: 27266 - protein, 144 aa, Panicum virgatum
  misc_feature: Ceres CLONE 1875883
  misc_feature (35)..(144): Pfam Name: Pro_CA Pfam Description: Carbonic anhydrase
  misc_feature: SWISSPROT Homolog: EC 4.2.1.1 Carbonate dehydratase
MVGTEHDPFIELKARFMDFKQRNYVENFSNYQSLAQQQTPKFMVIACADSRVCPTSILGFQPGEAFTVRNVANLVPPYEHGGSETSAALEFAVNTLQVENVLVVGHSRCGGIQALMSMKDDSTSGSFIKNWVSIGKSARISTKA

SEQ ID NO: 27267 - DNA, 688 bp, Panicum virgatum
  misc_feature: Ceres CLONE 1875883-R
tcatggaggctactacaactttgtagattgcacatttgaaaaatggacattagtgtaccgtgaaggactcaaaggcggaagcaagtatgctataaagaacaggtcatcctggtcttgatcaatgaaggccttatttacttgggtaaatttcactctgccctctgctgttcagcatggttttgctttgccaccacgatgttcattttcattgcaccttgctccgttgtggtattgatgttctgcggaagggagtccctgtatcaaggaattgttacatggatggctgttgacgccgcccattgtcatgcatggcactgtgccactagcttgatacgcttgaactgtatgttgtatcgcagacgaacataaatgcatcgacattgtggcagttatttgatacagagactcgcaactgtagaaggacaaaatcacaatggagtgaggtgcaacacaatgaacaatatggtagcaaagtgagtctgtcgagctgccggggacacagtgaattttatctaactatttgtatgttgttttctgattgaaaccattaagtaattatgaataagctgcaagagtcggtcatagcacaaatgcatgtagtcatcgccacatttggcgtcaccgtgtgttattgtaacatttgtaccatttgttgtgtatcattgtaactgtgagatacaaatattat

SEQ ID NO: 27268 - DNA, 700 bp, Panicum virgatum
  misc_feature: Ceres CLONE 1875884
  misc_feature: Encodes the peptide sequence at SEQ ID NO. 27269
gcctggccgcttctgcttcccctcttcccttcccttctctgcggcagctgcaaccgtgctggcgaccccgctgtgacggagccccaaggaatggcggccctgtgactcgctgccgcgcgtagcttcgctggttccgggagcagcggccgcaatggcggcggttctggccctggcggtggcgctggcgctgctggcgcccgcggcggcgctcaacacggacgggctggcgctgctggcgctcaagttcgcggtgtccgacgacccggggggcgcgctcgccacgtggcgggacgcggacgccgacccctgcggctgggcgggggtctcctgcgccggcggcggcgggggccgcgtcgcgggcgtggagctcgccaacgcctcgctcgcagggtacctcccatccgagctctcgctgctgtccgagctccaggagctctcgctgccctacaaccgcctggcgggccagatcccggtcgccatcgccgcgctgcagaagctcaccgcgctcgacctcgcgcacaacctcctctccggccaggtccccgccgggatcgggcggctcctctcgctggcccgcctcgacctctcctccaaccagctcaacggctcgctgcccccggcggtcgcggggctcccgcggctctccggcgtgctcaacctcagctacaaccacttcaccggcgggatcccgccggagtac

SEQ ID NO: 27269 - protein, 182 aa, Panicum virgatum
  misc_feature: Ceres CLONE 1875884
  misc_feature (20)..(61): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAVLALAVALALLAPAAALNTDGLALLALKFAVSDDPGGALATWRDADADPCGWAGVSCAGGGGGRVAGVELANASLAGYLPSELSLLSELQELSLPYNRLAGQIPVAIAALQKLTALDLAHNLLSGQVPAGIGRLLSLARLDLSSNQLNGSLPPAVAGLPRLSGVLNLSYNHFTGGIPPE

SEQ ID NO: 27270 - DNA, 712 bp, Panicum virgatum
  misc_feature: Ceres CLONE 1875888
  misc_feature: Encodes the peptide sequence at SEQ ID NO. 27271
ccatgatcagctcctcaaagtgcaagataacatacctatctgcgcttccatcatcgggcagcacctggcgctttactcacttgaggctggacctgcgtggatcaaagaaagggtgaaagacttggtaagaaaccgagagctgcttgtggaggcgctgtctccactcggtgaggacaatgtcaagggtggggagggcgccatctacctctgggcaaagctaccggacaactgctcggacgattttgaagttgtcaggtggctcgcaaacaagcatggggtcgctgtgatcccagggagcgccagtggaggccctggatacatccgcgtctcctttggtgggctcaaggaggaagataccaggcttgctgcagagaggctgaggcgcggcttgcaggagttggtgactgatggaatggtacagtaaccacccattggtgtaagtaaaggcttaacattcaagttttacaggactccgattttccaatggtataaaaattcgtctgggattaatctgagagaagaaaatggcctattttcaagaatacattgttgaaaagggcaattggtggaacgagaactgggacagaataaaaggcatatcaatgcagcctgcagagtcacttacgttaaatagcatgttaccattgagtacttgtgctgtttgacttccagttttccatcttactgatgacagccattgtacacaataacc

SEQ ID NO: 27271 - protein, 140 aa, Panicum virgatum
  misc_feature: Ceres CLONE 1875888
  misc_feature: SWISSPROT Homolog: EC 2.6.1.1 Aspartate transaminase
  misc_feature: Functional homolog of the protein sequence given in SEQ ID NO 50929
  misc_feature: Useful for making plants with modulated nitrogen use efficiency
HDQLLKVQDNIPICASIIGQHLALYSLEAGPAWIKERVKDLVRNRELLVEALSPLGEDNVKGGEGAIYLWAKLPDNCSDDFEVVRWLANKHGVAVIPGSASGGPGYIRVSFGGLKEEDTRLAAERLRRGLQELVTDGMVQ

SEQ ID NO: 27272 - DNA, 727 bp, Panicum virgatum
  misc_feature: Ceres CLONE 1875900
  misc_feature: Encodes the peptide sequence at SEQ ID NO. 27273
gcgaccccaggtcagacgggatcacccgctgagtttaagcatataaataagacggaggagaagaaacttacaaggattcccctagtaacggcgagcgaaccgggagcagcccagcttgagaatcgggtagcctcactacccgagttgtagtctggagaggcgtcctcagagacggaccgggcccaagttccctggaaagggacgcctgggagggtgagagccccgtccggcccggaccctgtctcaccacgaggcgccgtcaacgagtcgggttgtttgggaatgcagcccaaatcgggcggtaaactccgtccaaggctaaatataggcgagagaccgatagcgaacaagtaccgcgagggaaagatgaaaaggactttgaaacctcttcggccatggcccggcgggtgtccctgctgcagcagctgctgctgggcgcgctggcggcctgctcggcggcggcggcggccagcttcgaccaggagttcgacatcacctggggcgacggccgcggcaagatccaggacggcggccgcctcctcacgctcacgctcgaccgcacctccggctccggcttccagtccaggcacgagtacctcttcggcaagatcgacatgcagctcaagctcgtccccggcaactccgccggcaccgtcaccgcctactacctctcctcccagggcagcgcccacgacgagatcgacttcgagttcctggggcacgtctc

SEQ ID NO: 27273 - protein, 110 aa, Panicum virgatum
  misc_feature: Ceres CLONE 1875900
  misc_feature (27)..(110): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 50904
  misc_feature: Useful for making plants with altered cell wall content and/or composition
MARRVSLLQQLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGHV

SEQ ID NO: 27274 - DNA, 391 bp, Panicum virgatum
  misc_feature: Ceres CLONE 1875910
  misc_feature: Encodes the peptide sequence at SEQ ID NO. 27275
gaaccagcagtacaagaagcacaagaaaaaacacttgtagccatcaacttcttcttcttcttcttcaccgtcatcaactcatcatcagctcagaccctagctagcgaccaaaaaaaaaaaaaatgagcccccccgcggaaccagctgatcagggcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttc

SEQ ID NO: 27275 - protein, 74 aa, Panicum virgatum
  misc_feature: Ceres CLONE 1875910
  misc_feature (15)..(74): Pfam Name: potato_inhibit Pfam Description: Potato inhibitor I family
MSPPAEPADQGGGGKTSWPEVVGMSIEEAKKVILKDKPDADIHVLPVGTPVTRDFRPNRVRIFVGTVAQTPHVG

SEQ ID NO: 27276 - DNA, 496 bp, Panicum virgatum
  misc_feature: Ceres CLONE 1875932
  misc_feature: Encodes the peptide sequence at SEQ ID NO. 27277
atccatccatccaatattccaatccatacatcctccgctcccgactcccagcccaagaaacaatctcggatcggatcaattcaaggacgccaccaccaccaccaccggctccgtcgacgtgaagaagatgggggatgccaacaatggcacgctcgggcggcacctggcgcgccgcctcgtccaggtgggcgtccgcgacgtgttcgccgtgcccggcgacttcaacctgacgctgctggaccacctcatcgccgagcccgggctgcgcctcgtcggctgctgcaacgagctcaacgccgggtacgccgccgacgggtacgcgcgcgcgcggggcgtgggcgcctgcgccgtgaccttcaccgtgggcggcctgagcgtgctgaacgccatcgccggcgcctacagcgagaacctccccgtgatctgcatggtgggcgggcccaactccaacgactacggcaccaaccgcattctccaccacaccatcggcctcccc

SEQ ID NO: 27277 - protein, 122 aa, Panicum virgatum
  misc_feature: Ceres CLONE 1875932
  misc_feature (7)..(121): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MGDANNGTLGRHLARRLVQVGVRDVFAVPGDFNLTLLDHLIAEPGLRLVGCCNELNAGYAADGYARARGVGACAVTFTVGGLSVLNAIAGAYSENLPVICMVGGPNSNDYGTNRILHHTIGL

SEQ ID NO: 27278 - DNA, 690 bp, Panicum virgatum
  misc_feature: Ceres CLONE 1875945
  misc_feature: Encodes the peptide sequence at SEQ ID NO. 27279
tgctctctcagaggtgggttggcttctccccctcttaccaagtcctcggttctagggtttagttggaaggggagatggcggcggcggatgtggagtaccgctgcttcctcggcggcctcgcctgggccaccgacaacccctccctccagcaggccttcccctcctaccgcgacctcctccactccaagggcctcaccgaccgtgagacggggaggtcccgcgggttccgcttcctcaccttctcaaccgagcagtccatgctccaccccctccaagccatgaacgggaaggagctcgacggccgcaacatcaccgtcaacccggcccaatcccgcggcggtggcggcggccgcggccgccgcggttaccgcggcggtcgccagggaggctaccgcggcggcggcggcggctaccgcggcggtcgccgtgagggcggctaccgtggcggcggctaccacggtggcggtggcggataccgcggcggtcgccgcgagggcggctaccgcggtggtggctaccgcagccgcggtgactccggtggcaactggaagaactaatggggtggccctcccgtgctggcagccaagttatcctatatatctattagtggtcgtgttaccatttgatccgagttaccccagaatttagtgtccgtgttacctgttggttcccatgttaccgtttccgagt

SEQ ID NO: 27279 - protein, 160 aa, Panicum virgatum
  misc_feature: Ceres CLONE 1875945
  misc_feature (10)..(81): Pfam Name: RRM_1 Pfam Description: RNA recognition motif. (a.k.a. RRM, RBD, or RNP domain)
  misc_feature (48)..(152): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFLGGLAWATDNPSLQQAFPSYRDLLHSKGLTDRETGRSRGFRFLTFSTEQSMLHPLQAMNGKELDGRNITVNPAQSRGGGGGRGRRGYRGGRQGGYRGGGGGYRGGRREGGYRGGGYHGGGGGYRGGRREGGYRGGGYRSRGDSGGNWKN

SEQ ID NO: 27280 - DNA, 450 bp, Panicum virgatum
  misc_feature: Ceres CLONE 1875946
  misc_feature: Encodes the peptide sequence at SEQ ID NO. 27281
acgagcgacagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggaggccgcgcccgcggcgtggcctcatccaacgccgcgtccggggctgcagttggggttgcgatttagtgctttacggcacccccactccaatacacttgatcagagagacggg

SEQ ID NO: 27281 - protein, 92 aa, Panicum virgatum
  misc_feature: Ceres CLONE 1875946
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRARGVASSNAASGAAVGVAI

SEQ ID NO: 27282 - DNA, 715 bp, Panicum virgatum
  misc_feature: Ceres CLONE 1875968
  misc_feature: Encodes the peptide sequence at SEQ ID NO. 27283
ttatctatcttgatttcaagacctccaatattcttctcgactcggagtacaatgcaaaattgtctgatttcggtttggcaaaagatggtccaagtggttatacaagttatactatccctactatgctcatggggacgaccttcacggggacaaacggatatgctgcccctgaatatattgcaacattcatggggacacacggatatgctgcccctgaatatattgcaacaggccatttgaccgcgaagtgtgatgtgtacagctacggtgttgttcttctggagttgctgtctgggcagcgtgctctggacaagaaccgcccacctggccagcacaggctggtggagtgggctaggccttacatcaccaacaagcggagggtgtcccgtttcttggactcgcagttggattcccagtattgccttcctgcggcgcagaagaccgcagccctagcactgcaatgcttgtcgatggacccacaatgcaggcctggcatggatcaggttgtgaccttgttagaaggccttcaagacaccaagagtgcattgaaatctggcaagtaggagaattgctagttacggttgtccttgcctctttgaaggatcgtcgtcttgtaggactccaatggagtaaaacggtgaacggatgagggatttcaggggcaactagcttctgacgagtgtataatattaatatatcttgctttgtgtattgc

SEQ ID NO: 27283 - protein, 186 aa, Panicum virgatum
  misc_feature: Ceres CLONE 1875968
  misc_feature (58)..(181): SWISSPROT Homolog: EC 2.7.11.1 Non-specific serine/threonine protein kinase
  misc_feature (1)..(59): SWISSPROT Homolog: EC 2.7.11.13 Protein kinase C
IYLDFKTSNILLDSEYNAKLSDFGLAKDGPSGYTSYTIPTMLMGTTFTGTNGYAAPEYIATFMGTHGYAAPEYIATGHLTAKCDVYSYGVVLLELLSGQRALDKNRPPGQHRLVEWARPYITNKRRVSRFLDSQLDSQYCLPAAQKTAALALQCLSMDPQCRPGMDQVVTLLEGLQDTKSALKSGK

SEQ ID NO: 27284 - DNA, 1163 bp, Panicum virgatum
  misc_feature: Ceres CLONE 1875986
  misc_feature: Encodes the peptide sequence at SEQ ID NO. 27285
agcgtccttcagagactgtctcgagaaccttcccgatccctcgcgccgcctccgccctcgccccgcgctcgccggcggcgagcttgttgtctgtggtctggtcaaccatgttcaagaaaccagttgatgtgaaaactgtacagcgcttatctggagcagacaaaaagaagttaagaagaactgccaaggaaaggtttccacaggcatctgatgctgatcttgatgccattcttcctcccaagggtgagataacactagctaagtacccaaatcatgctcttgtatatgcgatagagggggagttcccaatgatcttcaacattgatgcaagaggccacgacctgtttccaacagtttatgcactctggaaggtccctcatctgttgccagcttttacgcttaagggtggtgaggtttcacggtatgtgattggtggtgctgatctgatgtttcctggtatcagcatacccccagaagggtttcattcttttgaagctggtcaaccatgggcagtaaaagttcccggtaaccctgcgccaattgctgttgggatcacaactatgagcagtactgaagccttaaaggcagggctacgtggcaaggctttaaggattctacattactacagggatatgttatgggattcagctgatgctcgttatgtccctaatgaaggattttttgaagacattgttgttgaagatccaaattttgtttcaacatctcaatctcctgattcagctgaaggaactccagaagtcacacatgaaagtgaagatgcagcagttgatagttcagacactgctgatcctggcatccacaatgaagctacagaagagataactgatggtataaatgaactcaaactgcctgaagataaatccgccgaacaggcacctgatgaaaaggaacatcagactttgacaactgaagaaattgattctcttttggacaaatgccttctgcaagcactgtacacaagcataaaagaaaaagaccttcccatgccaggaagtacactatggtcaaatcacatactcccctgcaggcctccaggtgttactcttgatattaaaaagtcatcacacaaaaagctatcccagtggttgcaatcgaaatcttcatctggccttatttcagcaaaagaggataagtataagaag

SEQ ID NO: 27285 - protein, 351 aa, Panicum virgatum
  misc_feature: Ceres CLONE 1875986
  misc_feature (94)..(173): Pfam Name: PUA Pfam Description: PUA domain
MFKKPVDVKTVQRLSGADKKKLRRTAKERFPQASDADLDAILPPKGEITLAKYPNHALVYAIEGEFPMIFNIDARGHDLFPTVYALWKVPHLLPAFTLKGGEVSRYVIGGADLMFPGISIPPEGFHSFEAGQPWAVKVPGNPAPIAVGITTMSSTEALKAGLRGKALRILHYYRDMLWDSADARYVPNEGFFEDIVVEDPNFVSTSQSPDSAEGTPEVTHESEDAAVDSSDTADPGIHNEATEEITDGINELKLPEDKSAEQAPDEKEHQTLTTEEIDSLLDKCLLQALYTSIKEKDLPMPGSTLWSNHILPCRPPGVTLDIKKSSHKKLSQWLQSKSSSGLISAKEDKYK

SEQ ID NO: 27286 - DNA, 705 bp, Panicum virgatum
  misc_feature: Ceres CLONE 1875986-R
  misc_feature: Encodes the peptide sequence at SEQ ID NO. 27287
aagtgattcttgatgttacattatgcgatgcattgtacaaaggagctatcaagaagggttcagcatatccaactgagatccacaagaaggatttggggtcaacacttttaaaccgcatgcaagttcaccataaagtaacaagaggaactcaggaggtcatacgcaagggtgccataagaactattcagatcatgacagaaagaaggcaggggaacaagaagatgactcggctttctggactggaatgctttttaatggatcctgattccttggcgtctgaacttcagaagaaatttgcttgcagcaccaccacagctgagcttccaggtaagaaggggcagtatgaggtcttggttcaaggtggagtgattgacgatcttgcaaagcaccttgttgaccattacggcgtcccaaagagatacattgaggtttatgacaaaacaaagaggtaggaaaggaagctgatcagctgaagctttatcctgattgcccaatgcctctaggtgttccggcagtaccgacccgccttgtgcaaatgcataacgatcccacatgatactttttggagtcatatgtctaggaattattgtgacaatagtgttgagctcatatgtttcctttcacccacttctgcccttctattggtcgaaaacttttgtgcaagacatgaggcttgcttatgtaaccgaaaggttttggtgctcc

SEQ ID NO: 27287 - protein, 149 aa, Panicum virgatum
  misc_feature: Ceres CLONE 1875986-R
  misc_feature (55)..(139): Pfam Name: SUI1 Pfam Description: Translation initiation factor SUI1
VILDVTLCDALYKGAIKKGSAYPTEIHKKDLGSTLLNRMQVHHKVTRGTQEVIRKGAIRTIQIMTERRQGNKKMTRLSGLECFLMDPDSLASELQKKFACSTTTAELPGKKGQYEVLVQGGVIDDLAKHLVDHYGVPKRYIEVYDKTKR

SEQ ID NO: 27288 - DNA, 734 bp, Panicum virgatum
  misc_feature: Ceres CLONE 1875995
  misc_feature: Encodes the peptide sequence at SEQ ID NO. 27289
cttccctccctacagccgccgccgcctttcccagcctccgcgcctccgtcgccgccgccgcttcctcagccatgggtaaggtgcacggatcgttggcccgtgccgggaaggtccgcggccagacgcccaaggtggcgaagcaggacaagaagaagaagccccgcggccgcgcgtacaagaggatgcagtacaaccgccgattcgtcaccgccgtcgtcggcttcggcaagaagcgcgggcccaactcatccgagaagtaggcgccgcgccgcgccgcgcagccgccggctcgccccgctccggttcctcctttccgttctcagtatgcttatgctcttgttggtagtagtttcgttgtgcaagcaaaggaagaaccttttgtagtttcagattcgttgttcatgtgatgtgatgggaacttgagatggtaaaaaaaaaaaaaaaaaaaaagtacacacgttccctgccgctcgccttctctctctctctctctctctctacgccgcgcaaatcttaattcctccccccattgccattgcgttcgtcccgcttgcagcgggttcttcctccctgaacaaccgccgccgccgttcctgctgttttcgcactcaatccttccaagaaaaccaccccggatcccagaaaaagctgcgacctttgcacttgcacgtttcccagcccggaaccctcagccgcaagagcgcgttcatttcaatcccgtgatttccgaggct

SEQ ID NO: 27289 - protein, 62 aa, Panicum virgatum; identical to SEQ ID NO: 10043
  misc_feature: Ceres CLONE 1875995
  misc_feature (3)..(61): Pfam Name: Ribosomal_S30 Pfam Description: Ribosomal protein S30

SEQ ID NO: 27290 - DNA, 689 bp, Panicum virgatum
  misc_feature: Ceres CLONE 1876000
  misc_feature: Encodes the peptide sequence at SEQ ID NO. 27291
ataccgcaatgaggccactactgcttgtcctccctgtcctcctcttcgtcgtctccaccactgctgtgacggcatctccccttccccaccctctcgacccactctccgctacggagctcgccaccgtccgcgcagctgtgctttcctccccgtccgtgtcggcgcgcccgctgcacttccactacgttggcctcgacgagcccgacaagcaagacgttctctcctatgcccatggcacctcgaccacgatccttccgcgccgcgcgctcgtcatcgcacgagccggcgccgagtcccacgagctcgtcgtcgacgtcaccgacgcctccgcgccctccgtcgtttcccacgccatccaccgcggccccggcttcccgatgatcacgtcccaggaggagaccgcggcgatggcgctgccgccgaggtacccaccgtttgtggagtccgtgcggcggcgcggcctggacgtcggcgatgtcgcctgcggggtgctctccagggggtggttcggcagcgcccagccggcgtacggcggcgcccgggtggcgaagatgcagtgcgtggtgaccggcgacggggaggagacggccaacttctacgcgcgcccgctggagggcgtgacgctggcggtggaccttgaccggatggccgtcgtcgggtacgaggacagggtggtgcgcccggtaccg

SEQ ID NO: 27291 - protein, 226 aa, Panicum virgatum
  misc_feature: Ceres CLONE 1876000
  misc_feature (27)..(114): Pfam Name: Cu_amine_oxidN2 Pfam Description: Copper amine oxidase, N2 domain
  misc_feature (123)..(226): Pfam Name: Cu_amine_oxidN3 Pfam Description: Copper amine oxidase, N3 domain
  misc_feature: SWISSPROT Homolog: EC 1.4.3.6 Amine oxidase (copper-containing)
MRPLLLVLPVLLFVVSTTAVTASPLPHPLDPLSATELATVRAAVLSSPSVSARPLHFHYVGLDEPDKQDVLSYAHGTSTTILPRRALVIARAGAESHELVVDVTDASAPSVVSHAIHRGPGFPMITSQEETAAMALPPRYPPFVESVRRRGLDVGDVACGVLSRGWFGSAQPAYGGARVAKMQCVVTGDGEETANFYARPLEGVTLAVDLDRMAVVGYEDRVVRPV

SEQ ID NO: 27292 - DNA, 1157 bp, Panicum virgatum
  misc_feature: Ceres CLONE 1876015
  misc_feature: Encodes the peptide sequence at SEQ ID NO. 27293
gaacaaacccaaaaaattgtttcgagttccctgctgccaagtccacaataagctccccccttcaaccgcctcgtcaccgcgagctctgataggccatcctccaccttctctaccatcaccaacacagacccggcgtgctgcgtccctctagtaatattggagagaatcgagagtaacccctgcgacagagccagagggaaaacaccattgcacccaaagaaaagactttgccggccggccacgatggcgcctcaagcacttcaccccgtgaccgtcctggagcagtgccacgtctcgccgtcgccggcgccggcggcggggcagacacgcgcgctgctgctcacgttcttcgacctcgttttctggggcttcccgcccgtgcaacgtctcatcttctacgacaacgccgacctcctcagcgtctccgacttcacgctcggcgagctgccacggttcaagaagtccctcgccgccgcgctgcaccacttctacccgttggccgggaagctgacgtgcgaattggccgagggcgtggcgccggaggtcgtgttctcggacggcgactctgtcccgctcaccgtggccgtcagcggcgacgactttgaagacctcgccggcgaccacgcgcgcgacaccacgaggctccatccgctgctacccgcgctgcggacactcggtggctcccggtcgcaggacgtcttcgccgtccagatcactgtgttccctcgcgccggcatttgcatcggcacgacgctgcaccacgccgtggccgacggctccagctacgcgcacttcctcaggacgtgggctgagttccaccgcctcggccccgagtgcaggaagcaggtgctggagatggacgtgcccccgctgttcgaccgcagcgtcgtgcgcgacgacgccgggctccgggaggcgtttctgagcgaccaccgagctcttgcagcagccgtcgacaggcgcctcgacggctgggacctgagccttcgtcctggcgtagtgcttgcgacgttccggttcacggacaagcaactccgtgcgctcggggggcacatcgagtcggagacgtcggcgcggtgctcgccctacgcgctggcgtgcggcgccgcgtgggcgggcatcgtgcacgcgcgccgcggcggcagcggccggaacgt

SEQ ID NO: 27293 - protein, 304 aa, Panicum virgatum
  misc_feature: Ceres CLONE 1876015
  misc_feature: SWISSPROT Homolog: EC 2.3.1.153 Anthocyanin 5-aromatic acyltransferase
MAPQALHPVTVLEQCHVSPSPAPAAGQTRALLLTFFDLVFWGFPPVQRLIFYDNADLLSVSDFTLGELPRFKKSLAAALHHFYPLAGKLTCELAEGVAPEVVFSDGDSVPLTVAVSGDDFEDLAGDHARDTTRLHPLLPALRTLGGSRSQDVFAVQITVFPRAGICIGTTLHHAVADGSSYAHFLRTWAEFHRLGPECRKQVLEMDVPPLFDRSVVRDDAGLREAFLSDHRALAAAVDRRLDGWDLSLRPGVVLATFRFTDKQLRALGGHIESETSARCSPYALACGAAWAGIVHARRGGSGRN

SEQ ID NO: 27294 - DNA, 704 bp, Panicum virgatum
  misc_feature: Ceres CLONE 1876015-R
  misc_feature: Encodes the peptide sequence at SEQ ID NO. 27295
cgaaacgtggacggggaggccgcgtcccgcgcgcacttcgggttcgtgaccgggtgcaagccccgcgcgagcccgccgataccggcgaactacttcggcaactgcctgggtatctgccgcgttgaggccggagagcgcggcctcaccgcggcggccgcggcggcggccatatggcgtgtgatcgaggggctcgcggaggaagggcaggcgttccgggacgcgcgcgggtgggtgcgctccgtgcgggagtacgcgtcggcgcgggcagtgaccgtggccgggtcgccgaagctgcggctgtacgcggcggcggatttcggcggggcgtgggggcggccgaagaaggtggagatcgcgtcggtggaacggacgggcgcgctggcgctggcggagagcggccgcgacggggacggcggcggcatcgagctcgggctggcgctgccgcgcgcggagatggaggcgttccgcacgttttacctcgacctgttcgccagcctctgctagctgaatcgacggggagtgtggcggcgccgtgtaaacactgtaccatatcgtttagctgcgtgagatttccattgagtggcgaccttttttttttttaatggctgacgccgcagccttgagctagatagaggatccaagccctggcgtagcagctcgctcgcatcctactttgcatattaattaatggctttcttgtcggc

SEQ ID NO: 27295 - protein, 167 aa, Panicum virgatum
  misc_feature: Ceres CLONE 1876015-R
  misc_feature: SWISSPROT Homolog: EC 2.3.1.153 Anthocyanin 5-aromatic acyltransferase
RNVDGEAASRAHFGFVTGCKPRASPPIPANYFGNCLGICRVEAGERGLTAAAAAAAIWRVIEGLAEEGQAFRDARGWVRSVREYASARAVTVAGSPKLRLYAAADFGGAWGRPKKVEIASVERTGALALAESGRDGDGGGIELGLALPRAEMEAFRTFYLDLFASLC

SEQ ID NO: 27296 - DNA, 2438 bp, Panicum virgatum
  misc_feature: Ceres CLONE 1876028
  misc_feature: Encodes the peptide sequence at SEQ ID NO. 27297
cccttctctccacctccagcaagcaactcaccgcacccgcaccgcaccaccaccacactcctctctccattgctgctccctctagcttcttcctccccaccccctttcatggcaggaaaggctggggtgatgatgcccataagccatccaatttgacccatgccatcctggacctatatacatactgcccctgcgcgcacggcgcacactcgcaatctcaacttctctaccactgctgtgctagctcctctctctctctctctctctctctctctctctctctctctctctcttcctgcttttgcctgcctgctgcaagcttttgctttggtttaggtgcttcttttccactcctttactgttcccccacttttgcttgctttgtcacgcacacgaaaagctcctgcctttaccttctcggaccttatctccggcccgtagtgggatttggtgggagctgcgctgcttgcccctcgcgtttctttgctcaattgggggctcgcgggtgcgcgcgctcgtgctcggaattcgggttctttcggtggggattgcgtggtaccctgggcgattgcggacgcccgctgcagatctttgcgcaattccggcgagacggagatgaactgtgggccgcctgaccagctgccgccggcgtcggcgccggcgccgtcgtgcttcctcaacctcaactgggaccagtccatggccgccgccgcggccggcgaccacctcgacccggcgctcagctcgatggtctcctccccggcgtccaactcgacggccgccgcggcgactgatggcctcgctctgcacgggatctcgccgcagccgcagtacggcggcacgcctctcagctcgccccctaagctcaacctctccatgatgggccagttccaccactaccaggcgccgcaagtcggtggcggcggacccggcggcttgccaatcctggagaacttgatgccgatgggacacctggaccagttcctcgccgaccccggtttcgccgagcgcgcggcgaggctttccggctttgatggccgccccggtggaagcggctatggcggcgccgtgccgggacagttcggcctcccggacgcgggccctgtcggtgcattgaaggagctggagctcgggagcggccgggatgagtcatcggtgtccgatccagcgtcggccagcgcggagatggcgttgaaaggtccttccgacggcaatgcaaagaagcggaaggccagcgggaaggggaaaggcaaagacggccctgggtccaccgccgcaaaggatcccgccaaggaggaatccagtgggaagcggtgcaaatcggcggacgagagcaatggcgcggaggacaactccggcaaggggaaggccgcgcagagcaacagcgagaatggtggcaagaagcaggtgaaggactcatcgaagccccccgagccgccccaggactatatccatgtccgggcgaggcgcggtgaggcgactgacagccacagcctcgctgagagggtgagaagggaaaagatcagccagaggatgaagctgctgcaggatcttgtgccgggttgcaacaaggtggttggcaaggcagtcatgctcgatgaaatcataaactatgtgcaatccttgcaacggcaagtcgagttcctgtccatgaaattggctactgtgaatccccagctggacttcaacaatttgcctaacctccttcctaaagatatacaccagtcctgcggcccgatgcagaacttgcattttccactggagacctctggtgcaccgctgccataccttwaccagtctcaccaggggagccctctaggttgcagcctaaccaatggcatggacaaccaaagtaatatgcacccacttgacccagcattttgccggcagatgaattctcaacatccttttctcaacggagttagcgatgtggcctcgcaggttgggactttctggcaagatgatcttcaaagtgttgttcatatggatattgggcaaggtcaggagattgcggccacctcttcgaacagctacaatggttcgttgcaaacagtccacatgaaaatggagctttgacatagctgaaattcagtccaaagctcgatgcccgtgtatataaagacgagagatcagcttgcagcggaagcactctgagattcaaactaacaacgttgggccctagcagtgttttagcttctaattttccccttggtgtaatcattctttgaacaaaatgtgaagagcaccatgaatgacggttggttacgcctttgcctgtttagctgcaagatcgcacgcaacgaaatggtgcctgccgtacatgctcaatcagacccttatcctctcaagcgagagggaagacctgtaatatcatttgtattgccattatatttgtagctgataaatatatatataaatttaagatccctattactgtc

SEQ ID NO: 27297 - protein, 486 aa, Panicum virgatum
  misc_feature: Ceres CLONE 1876028
  misc_feature (288)..(338): Pfam Name: HLH Pfam Description: Helix-loop-helix DNA-binding domain
  misc_feature: The sequence is a functional homolog of SEQ ID NO 1930 in the 10/374,780 US patent application
  misc_feature: Functional homolog of the protein sequence given in SEQ ID NO 51243
  misc_feature: Useful for making plants with altered lignin content
  misc_feature (393)..(393): Xaa is any aa, unknown, or other
MNCGPPDQLPPASAPAPSCFLNLNWDQSMAAAAAGDHLDPALSSMVSSPASNSTAAAATDGLALHGISPQPQYGGTPLSSPPKLNLSMMGQFHHYQAPQVGGGGPGGLPILENLMPMGHLDQFLADPGFAERAARLSGFDGRPGGSGYGGAVPGQFGLPDAGPVGALKELELGSGRDESSVSDPASASAEMALKGPSDGNAKKRKASGKGKGKDGPGSTAAKDPAKEESSGKRCKSADESNGAEDNSGKGKAAQSNSENGGKKQVKDSSKPPEPPQDYIHVRARRGEATDSHSLAERVRREKISQRMKLLQDLVPGCNKVVGKAVMLDEIINYVQSLQRQVEFLSMKLATVNPQLDFNNLPNLLPKDIHQSCGPMQNLHFPLETSGAPLPYLXQSHQGSPLGCSLTNGMDNQSNMHPLDPAFCRQMNSQHPFLNGVSDVASQVGTFWQDDLQSVVHMDIGQGQEIAATSSNSYNGSLQTVHMKMEL

SEQ ID NO: 27298 - DNA, 721 bp, Panicum virgatum
  misc_feature: Ceres CLONE 1876031
  misc_feature: Encodes the peptide sequence at SEQ ID NO. 27299
gatgcgatgcgatgcgaggggatgacccgccggcgacggcgccggggagcgcagcgcagtggactcccatccgtctccactgctggattgagaaatttctcgccggatctcccccctgccctcccctttctgcctgggcctggggagaggacggccagccatggccatggcccctcgatctctcgccgctctcctcctgctcctcctcttcgccgccgccgtctacccctccacccgcgccgccgccaccagcagcagcagcaaggacgaggaggaggacctccagtacctcatcgacgacgccggtgacatccccgacaacggccctgacggcgacggcgactacgacgacctcttcgaggaccaggacctcccggaccagcagccgcagatcgacgagacccacgtcgtcgtcctcaccgccgccaacttctcctccttcctcgccgccacccgccacgtcatggtcgagttctacgccccctggtgcggccactgccaggagcttgccccggactacgccgccgccgcctcccaccttgcggcccaccacagccagagccacctcgccctcgccaaggtcgacgccaccgaggacacggacctcgcccacaagtacgacgtccagggattccccaccatcctcttcttcatcgacggcgtccccaaggactacaacggcgccaggaacaaggatgccatcgtcgagtggatcaacaag

SEQ ID NO: 27299 - protein, 186 aa, Panicum virgatum
  misc_feature: Ceres CLONE 1876031
  misc_feature (82)..(186): Pfam Name: Thioredoxin Pfam Description: Thioredoxin
  misc_feature: SWISSPROT Homolog: EC 5.3.4.1 Protein disulfide-isomerase
MAMAPRSLAALLLLLLFAAAVYPSTRAAATSSSSKDEEEDLQYLIDDAGDIPDNGPDGDGDYDDLFEDQDLPDQQPQIDETHVVVLTAANFSSFLAATRHVMVEFYAPWCGHCQELAPDYAAAASHLAAHHSQSHLALAKVDATEDTDLAHKYDVQGFPTILFFIDGVPKDYNGARNKDAIVEWIN

SEQ ID NO: 27300 - DNA, 721 bp, Panicum virgatum
  misc_feature: Ceres CLONE 1876032
  misc_feature: Encodes the peptide sequence at SEQ ID NO. 27301
atcgcccgtgccctcgaccccgctccaatcccctcctctcccgactccaatgggaatcaccgccgccgccgccgccccgtccccgtctcgcctcctcctccaccaccacgccgccgttggctccgaccgccgccaccagcaccagctcaggtaccccgcaacccagcacgctctcccgctgcgctgcggctccggccggcgcgaggcggcggccggggcgctgctgcccgaccgcgtcacccccttctcctacggcgtggacgaggacgccgatgaccacccgcgcgaggagtgcggcctggtgggggtcgccggcgacccggacgcgtcgtcgctgtgctacctcggcctgcagaagctgcagcaccgcggggaggagggcgccggcatcgtcgccgtgggcggggacggcaagctgaagtccgtgaccgggctgggcctcgtggccgacgtgttcggggacccctccaggctcgcctcgctcccgggccccgccgccatcgggcacgtgcgctactccaccgccggcgccgccgcgtcgctgcgtaacgtgcagccgttcctggcgggctaccgcttcgggcaggtcgccgtcgcgcacaacggcaacctcgtcaactaccaggcgctgcggaacaagctcgaggcccggggctccatcttcaacacctcctcggacaccgaggtcatcctccacctcatcgccacgtcgctgtcgcgg

SEQ ID NO: 27301 - protein, 223 aa, Panicum virgatum
  misc_feature: Ceres CLONE 1876032
  misc_feature (82)..(223): Pfam Name: GATase_2 Pfam Description: Glutamine amidotransferases class-II
  misc_feature: SWISSPROT Homolog: EC 2.4.2.14 Amidophosphoribosyltransferase
MGITAAAAAPSPSRLLLHHHAAVGSDRRHQHQLRYPATQHALPLRCGSGRREAAAGALLPDRVTPFSYGVDEDADDHPREECGLVGVAGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLS

SEQ ID NO: 27302 - DNA, 588 bp, Panicum virgatum
  misc_feature: Ceres CLONE 1876043
  misc_feature: Encodes the peptide sequence at SEQ ID NO. 27303
gacatctccgaccatccttctcacgtcctccacctccggagcagccacggggaacccgctggtttcccgcgccggcaacgggggcggcggcggcggccgaggacgcggcgccgcgggaacccacattgcccgccgcgggtgccgccggcggcggcggggcggcggtggggatcaactcccactcggtgctggtggcgctgctggactcgatctactcggagctggcggagctggtggagaaggcgctgctcctgcagacgctcgaggaccccgtcgggaggcacaacgtcaccatcttcgctccgcggaacgaggcgctggagcgggacctgcacccagagttcaagcgcttcctcctccagccccgcaacctcaagtcactccaggtgctgctcctctaccacgtcctccacgctcgcctcctctccgactcctgacccgccgcctcccaccccacactctccggggaagaggtcgagctcgccgccgccgccggcatgcgcgaccgccacgccgccgtcacgcgcccggacgcggcgctccgccccgatggggtcatcgacggaatccagcgcctcctcgtgcccc

SEQ ID NO: 27303 - protein, 144 aa, Panicum virgatum
  misc_feature: Ceres CLONE 1876043
  misc_feature: Functional homolog of the protein sequence given in SEQ ID NO 51244
  misc_feature: Useful for making plants with altered carbohydrate content
HLRPSFSRPPPPEQPRGTRWFPAPATGAAAAAEDAAPREPTLPAAGAAGGGGAAVGINSHSVLVALLDSIYSELAELVEKALLLQTLEDPVGRHNVTIFAPRNEALERDLHPEFKRFLLQPRNLKSLQVLLLYHVLHARLLSDS

SEQ ID NO: 27304 - DNA, 1963 bp, Panicum virgatum
  misc_feature: Ceres CLONE 1876047
  misc_feature: Encodes the peptide sequence at SEQ ID NO. 27305
acctggcctgactattcttccgttcgtaaaacctcgcgcccgcccaccaataaagtccacatcaaatctctttccccaattccatcagctcaccagaccaagcaagcacgagggggggaggaaaaaaaaagttcggtgctctgctgagctgtgcctgtcctcggagcggagcggggagccgtagccatggagcgagcgggggaggtgtcggccgccgccggcaacggcaacggcgccgtgcggaggtcgccgtcgacggcgccgtcggcgcgggtgtcgatctgggagtcggtgcgcgcgtgcgggatatgggggaaggaggtggacaaggccgagctgcggaggcaggtcgtcatgccgctccacctccgccgcgctgtcgcggcggcagtcgcggccaaggacgaggccgccggcgtggcggcggcgtcggcggcgaaggagggggcgggggatggggaaaaagaaggaggggccaacagtggcgcccctggtcgtgttcgtcaactcgcggagcggcgggcgccacgggcccgagctcaaggtgcggctgcacgagctcatcaccgaggagcaggtcttcgatctttctgttgtgaagccttcagattttattcactatggtttgagttgtttggaaaggttagctgaccaaggtgataactgcgcgaaagctgctcgtgaaaaaataaggattgtggttgctggaggtgatggcacagttggttggatgcttggttgtctctcagatctttataagatgaaaagggaaccagttccacccacaggaatcattccacttggtacgggaaatgatcttgctagatcatttggatggggtgggtcttttccctttggttggcgctcagctgtaaagcgttatctcagcaaggctgccactggtcccatttgccgtcttgacagttggcaaactgtaattcagatgccagaaggagaaataaaagagtcgccatattcgcttaagaaagtggaacctgcagatcgattggagatcagccaggcgaatggcactgagttatctgaaaaggcttcctgctataaaggagtattctacaactaccttagcattgggatggatgctcaggttgcatatggtttccaccatcttcgtgatgaaaagccatatcttgcacaaggaccagttgcaaataagttgatttatgctggatatagctgcactcaggggtggttctgcacaccttgtacagcaagtcctcagctaagggggcttaagaacattttgcgactttatattaaaaaggttaattgttctgagtgggagcaagttcaaatgccttcaagcgttagatccctagttgtcctgaatttatacaactatggcagtggaaggcatccatggggtgatcttaaacctgaatatcttgaaaagagaggttttgttgaagctcattcagatgacggtttgcttgaaatatttggtctgaaagaaggttggcatgcttcatttgtaatggctgagcttataaaagcaaagcacattgcccaggccgcggctatcaagtttgaaatgaggggtggccagtggaatcgagcatatgttcaaatggatggagagccatggaaacaaccgctcatccaggaccagtcaaccattctggaaataaacaaagttccatatcattctcttatgatcaacggggagcaatgatatttcccatgtcaatcagggttgcattcttagatcgttagattgtgtacagttcaggagcagcgcgccctagattcttagaactgggtcgactgcagcgaggatgcatgttcgctggccttttgtcatgccatggtcaagtcatggccagcgcatgataaggcaccatgcattgttgtattgtatcatatctgtaatctgttgttgtatcctgatttcttttgaagagaaagaaacaagcttaatttaatttgtagtgtttcgttgtgtgtc

SEQ ID NO: 27305 - protein, 411 aa, Panicum virgatum
  misc_feature: Ceres CLONE 1876047
  misc_feature (12)..(158): Pfam Name: DAGK_cat Pfam Description: Diacylglycerol kinase catalytic domain (presumed)
  misc_feature (205)..(382): Pfam Name: DAGK_acc Pfam Description: Diacylglycerol kinase accessory domain
  misc_feature: SWISSPROT Homolog: EC 2.7.1.107 Diacylglycerol kinase
MGKKKEGPTVAPLVVFVNSRSGGRHGPELKVRLHELITEEQVFDLSVVKPSDFIHYGLSCLERLADQGDNCAKAAREKIRIVVAGGDGTVGWMLGCLSDLYKMKREPVPPTGIIPLGTGNDLARSFGWGGSFPFGWRSAVKRYLSKAATGPICRLDSWQTVIQMPEGEIKESPYSLKKVEPADRLEISQANGTELSEKASCYKGVFYNYLSIGMDAQVAYGFHHLRDEKPYLAQGPVANKLIYAGYSCTQGWFCTPCTASPQLRGLKNILRLYIKKVNCSEWEQVQMPSSVRSLVVLNLYNYGSGRHPWGDLKPEYLEKRGFVEAHSDDGLLEIFGLKEGWHASFVMAELIKAKHIAQAAAIKFEMRGGQWNRAYVQMDGEPWKQPLIQDQSTILEINKVPYHSLMINGEQ

SEQ ID NO: 27306 - DNA, 1474 bp, Panicum virgatum
  misc_feature: Ceres CLONE 1876074
  misc_feature: Encodes the peptide sequence at SEQ ID NO. 27307
gcaactctgcaatttttttctctctccattttccccattccccgtgccgccgagcccggcatttccctgctctccccatccccgaccaccgtccccgtcttcgccggccatctcatccgcagccggggaccaaaccctaacccagtgcaaccgcgtctcagccgatatccgctcgcctccctgcccgatctaccctccggacgcggggccgtggggctgagtccgagacggatgccagcgccccgcggttgcgcgctccgaggccgtggagggcagcggcagaggaatccggtcgccgagccacgagccgcgaggtctctggtgctatagccgcagccgcagtaacagcagcagcagcagcagcagtgcgaagaggacgagcaggagggagggggaggcgaagggatggacgacttcgacagcggcggccggagcggggacaaggcaggcgccggcgcgggcgacgacgggggcgccccgccgctgccccagacggtacaaattggaaattcaccaacctataagcttgaaaggaagcttggaaagggaggatttggacaagtatatgttggtcgacgtatttctgcccctcgtctcagtgaccggaaccctggttcaaatgctttagaggttgcactgaaatttgaacatcaaaccagcaaaggatgcaactgtggagctccttatgagtggcaagtttacaacactcttagtggaaaccatggtgtcccacgggtacactacgaaggaaagcaggccgagttttatatcatggttatggatatgctgggaccaagcctatgggatgtttggaataacaattcccactcaatgtctgttgagatggttgcttgcataggcatagagggaatctccatactcgagaagatgcactctaaagggtatgtccatggtgatgtgaaacctgagaacttcttgcttggtcctcctggtaccccagatgagaagaagctttttcttgttgacctcggactggcaactaaatggaaggatgctggtacggggcaccatgtcgaatatgatcagagacctgatatctttaggggtactgttcgctatgctagtgtgcatgcccacttgggaaggactgggaccaggagagatgaccttgaatccctcgcatacacacttatttttcttctccgtggtcgcctcccttggcaaggataccagggagagaacaaaggttttcttgtctgcaagaaaaagatggcgacatctccagagtctttgtgtggaatttgcccacaacctttccggcattttgttgagtatgttgtgaacttgaaatttgacgaagaaccaaactatgcaaagtgtatttctctttttgatggcattgttggcccaaatccagacataagaccgataaacacagatggtgctcagaagctaatataccaggttggccagaagagaggccgcttaatagtggatgaaaatgatgatgagc

SEQ ID NO: 27307 - protein, 356 aa, Panicum virgatum
  misc_feature: Ceres CLONE 1876074
  misc_feature (39)..(316): Pfam Name: Pkinase Pfam Description: Protein kinase domain
  misc_feature: SWISSPROT Homolog: EC 2.7.11.1 Non-specific serine/threonine protein kinase
MDDFDSGGRSGDKAGAGAGDDGGAPPLPQTVQIGNSPTYKLERKLGKGGFGQVYVGRRISAPRLSDRNPGSNALEVALKFEHQTSKGCNCGAPYEWQVYNTLSGNHGVPRVHYEGKQAEFYIMVMDMLGPSLWDVWNNNSHSMSVEMVACIGIEGISILEKMHSKGYVHGDVKPENFLLGPPGTPDEKKLFLVDLGLATKWKDAGTGHHVEYDQRPDIFRGTVRYASVHAHLGRTGTRRDDLESLAYTLIFLLRGRLPWQGYQGENKGFLVCKKKMATSPESLCGICPQPFRHFVEYVVNLKFDEEPNYAKCISLFDGIVGPNPDIRPINTDGAQKLIYQVGQKRGRLIVDENDDE

SEQ ID NO: 27308 - DNA, 738 bp, Panicum virgatum
  misc_feature: Ceres CLONE 1876074-R
gcccggtgcaaataatggcagctctctggtgatcatgtcaagaggaacgcagtatgcacagcagtcctacaaagtaagcgattcatttcccttcaaatggataaacaaaaaatggaaggagggcttttatgttacggctatggcaacggctgggagccgatgggcagctgtcatgtcccgcaatgctggtttcagtgctcaggtagtggagcttgacttcttatatccaagtgagggcatccacatgcgttgggacaatggttatcgcatcacggccacggctgccacgtgggaccaggcggcctttatcttgagtgtccctaggagaaagcctactgatgaaacacaggagaccctgagaacatctgccttccccagccagcatgtgaaggataaatggtccaagaacctctaccttgcttccatttgctatggaagatccgtatcgtgaagcccgttttctcatgtaagatactaatatgaaccacaggtggttctatgataagagatgggattttgaatctcaaaactttgctaacctacttacccgcagctaacaaaaggtaacctatatgagagaaagaaaagctgctgaaccgttgtgtcggtccctgaaaaatttgaagtactaaattttttgtcggttgtgtataaattatccaaagcattagagtgtgttgtaaagaatgtataggtgtacctgctgaaccgttgccatgtacagaaagttagctttac

SEQ ID NO: 27309 - DNA, 2766 bp, Panicum virgatum
  misc_feature: Ceres CLONE 1876079
  misc_feature: Encodes the peptide sequence at SEQ ID NO. 27310
accgcgagcggagcgaccaccaccatcgcggcgaggcttcgtcgtctcgtcccccatccggccacggccaggccatccatcccgtgccttgtcttccccgcacccgcatgcaccaatctccaccctgcgttcgttgccccctccacatccatcggaaagctacgcctccccaaccgcctctctctctggccgcgccggcgatgcgcgccctcagctgaggtttcatcggaccctcggaggagtcagactggtggggggcctcgcccatggctatggcggcggcggtcgccaagaggtgcatgaacccggcctgcggcgcgcccgccacgggagccggaggggactggaggaagggctggccgctgcgatccggcgccttcgccctgctctgcgacaagtgcgggttggcatatgagcagtttgtattttgtgatatatttcaccaaaaggaatcaggatggagagactgctcattttgtgggaagcgtctccattgtggatgtgttgcttctaaaaactcttatgatctacttgatagtggaggagttcaatgtgtcacttgcatgagaaattcagcagctcagtctgcctctggtcaagtggttccaaagctttttccatgtcaaaataatccgcacattttcagtagaagtgacgagctattgtctggtagaaaatttgaacaatcaccctcccttgtgttggattccagaaatgatgatctagctattgtaaataagagcaaccacccattcatggtgaaaagcatagaggttgggcaaagcagtagcatcttgaggcaaaaagagatagagaatggttcaaggcagatcaaatgggaacagccaacccttagtatcggggacatgggaatacctttcttaactaggtctcagagcgcactagagtcaccccaatgtactcggagagatgacaataaggatccaactacagatagcacaacaagtgagtctatttcagaggcatgtctcagcatgagcttgggtattgctaataatggaaacaagatggaggctacttcaacagtggaaagacctatactatcaccaacgacagccattgctgaaggaagagaacttacgactgcactatctccctttcagcatgcacaaagggctcggcatttcctgaccagaccaccaagggttggtgaaggtgctgtttttgatccaacgagagatatttttccacatcttcgtgttgctagacctcccgctgagggaaggggccgcaatcaattacttccacggtattggccaagaataacaaaccatgagctgctacagatatctggagattcaaattccacaatcgttccattgtttgagaaggtcctgagtgcgagtgatgcaggccgcatagggcgccttgttcttccaaaagcctgtgctgaggcatatttccccccaatttctcaaccagaaggtcgccccttgacaattcaagatgcaagaggaaaagaatggcattttcagtttaggttttggccaaataataacagccgcatgtatgtcttggagggtgttacaccatgcatacagtccttgcaattacaagctggtgatacagtgacctttagtcggatagaacctggagggaaacttgttatgggcttccggaaggcaacaaatactgtcagtctgccagactcacagatctcagctattgcgaatggttcccttctcagcgagacactcttttctactgcaaatgacaacttaggagtagtaagtggttatcctggatttcttcagtcaataaaggggaatgcagatcttcatccaagctctctatatgatcatcatatgaactcagctgatggggatgttagttggcttaaggcagataaattcggtagcaggccagatgaggggtctttgcagtttttacaaaaacgaagtcgcaatattggttccaaaagcaggaggttcctaattgatgctgaagatgccatggaactaaagcttacctgggaggaggctcaagagttgttgcgtcctgctcccacttcaaaaccaactattgtgatgattgaggactatgaattcgaagagtatgatgaaccccctgtctttgcaaagagatcaattttcaccatccgtgcaacaggggaacaagatcaatggattcaatgtgacaattgctcgaaatggcgtcggttgcctcttactgttgttattgcttccaaatggacatgcactgaaaactcatgggacccaaaaagttgctcctgttctgcgcctgaagaattgaccccaaaagagttgcaaagtgttctgcagcagtatgaagaaatgaggaggcgaaagggcaactacggtctgaagctgaatgtggcggaaatggatgcatccaaccttgatgccttggccactgctgcggtgtttggtgatgtcgggaaccaaggtacagcttcagtcgcgacaaccacaaagcacccccggcaccgcccgggctgcacatgcatcgtgtgcattcagccacccagcggcaagggccccaagcacaacccttcgtgcacatgcaacgtctgcatgaccgtcaggcgtcgattcaagacgctgatgatgcggaagaagcaacggcaatcggagcgagaggaggccgaggcgagcaagaaggtcgcctggatgaacagagacgagcccgaggggagcaacctgtcgagatccccgcagacactggacaccactcgagacagcagtgatgtggccatgtttgacaaggtggccgacatgaacaagg

SEQ ID NO: 27310 - protein, 833 aa, Panicum virgatum
  misc_feature: Ceres CLONE 1876079
  misc_feature (359)..(462): Pfam Name: B3 Pfam Description: B3 DNA binding domain
  misc_feature (625)..(670): Pfam Name: zf-CW Pfam Description: CW-type Zinc Finger
MAMAAAVAKRCMNPACGAPATGAGGDWRKGWPLRSGAFALLCDKCGLAYEQFVFCDIFHQKESGWRDCSFCGKRLHCGCVASKNSYDLLDSGGVQCVTCMRNSAAQSASGQVVPKLFPCQNNPHIFSRSDELLSGRKFEQSPSLVLDSRNDDLAIVNKSNHPFMVKSIEVGQSSSILRQKEIENGSRQIKWEQPTLSIGDMGIPFLTRSQSALESPQCTRRDDNKDPTTDSTTSESISEACLSMSLGIANNGNKMEATSTVERPILSPTTAIAEGRELTTALSPFQHAQRARHFLTRPPRVGEGAVFDPTRDIFPHLRVARPPAEGRGRNQLLPRYWPRITNHELLQISGDSNSTIVPLFEKVLSASDAGRIGRLVLPKACAEAYFPPISQPEGRPLTIQDARGKEWHFQFRFWPNNNSRMYVLEGVTPCIQSLQLQAGDTVTFSRIEPGGKLVMGFRKATNTVSLPDSQISAIANGSLLSETLFSTANDNLGVVSGYPGFLQSIKGNADLHPSSLYDHHMNSADGDVSWLKADKFGSRPDEGSLQFLQKRSRNIGSKSRRFLIDAEDAMELKLTWEEAQELLRPAPTSKPTIVMIEDYEFEEYDEPPVFAKRSIFTIRATGEQDQWIQCDNCSKWRRLPLTVVIASKWTCTENSWDPKSCSCSAPEELTPKELQSVLQQYEEMRRRKGNYGLKLNVAEMDASNLDALATAAVFGDVGNQGTASVATTTKHPRHRPGCTCIVCIQPPSGKGPKHNPSCTCNVCMTVRRRFKTLMMRKKQRQSEREEAEASKKVAWMNRDEPEGSNLSRSPQTLDTTRDSSDVAMFDKVADMNK

SEQ ID NO: 27311 - DNA, 604 bp, Panicum virgatum
  misc_feature: Ceres CLONE 1876079-R
ggacgatcatcaggggcagcacggcacgcagcagccccggccggtgagcatgatgggcctgatggaagttgcgagccggcccctggacaactacatgaagcagaacggcctgacgagcctggccggggatcaagggggcggtagctccagcacggccacggtcccgccagctccagtggagagcgaggagcggacctcaaacgaggtccgtgtcgcgtcggtggagagggagcgggaacctgacgccatggctgtcgacgaggtcggcgacaaccagaaccagcaggacaagtctgccgtcgacgatgctgctgctacctgacagcgtgcgtgattgatggtgttgtcagtgtgtgttgacgtgcatatcttatcggctcctcttggtttttttcaggaacagctggtgagttttgttgtgaaagagtaaattactgttgggttccatcgtgttgcttctcctggagtaacttacgtgaacgtatgaggctgtgcaaccgcagattgtatgttgtaaaagtctgtaacctcggtgctggttggtgttgtacctaacgcctaaacctttggatttaatagctcacacatacctgatttgtactgt

SEQ ID NO: 27312 - DNA, 570 bp, Panicum virgatum
  misc_feature: Ceres CLONE 1876081
  misc_feature: Encodes the peptide sequence at SEQ ID NO. 27313
gtgggaacgaaggcggcgccggcgccggcgatgaattacaggaatacgaagccatggtggtccggatccggctggcgcggctcgggtgccgtacccgccctttctaccgcgagatggccgccgacagccgctccccgcccgacgtcgagcacctccaggtcctccgctactactacccgctcccatggcaagatggtggcaatacgatgggcctgaaattctcctgggtgaagtattggctctctgttggggcaccaccatctgatccggttcaccgtcttctgtttcgggctggacttcttcctccacctccactgctatccatggcacgtaagggccggccccgagatacgcgccccattcctcccatgactggggaacccttggatcttgatggtgtcacgataattcatgactccactgctcctcgaggcgatgctgaacaacctatagatgaggtggcttcataagtcttttgctttaccatgtgaaaatgatgctaaattttctatcttagcatatgcaccgatgctgcacgatacaacttgtttgttgttctcctgactaacc

SEQ ID NO: 27313 - protein, 138 aa, Panicum virgatum
  misc_feature: Ceres CLONE 1876081
  misc_feature (9)..(70): Pfam Name: Ribosomal_S16 Pfam Description: Ribosomal protein S16
MVVRIRLARLGCRTRPFYREMAADSRSPPDVEHLQVLRYYYPLPWQDGGNTMGLKFSWVKYWLSVGAPPSDPVHRLLFRAGLLPPPPLLSMARKGRPRDTRPIPPMTGEPLDLDGVTIIHDSTAPRGDAEQPIDEVAS

SEQ ID NO: 27314 - DNA, 613 bp, Panicum virgatum
  misc_feature: Ceres CLONE 1876092
  misc_feature: Encodes the peptide sequence at SEQ ID NO. 27315
atttgagcttcaataagttaactggtaacatcccccaatcaatctgcaacctcacaaacttgctggcgcttgacttatcaagcaaccatctaacaggctcaattccgtccgcgctgaacaatctgcacttcctctctaaattcaatgtttctttcaatgatctagaagggcctgtgccaaccacaggccagtttggtacattcacaaatgctagctttgatggcaacccaaaactctgtggtacttcacttattcaccattgcagttcagcagaagcatatttcacctccaagaaacaacataacaagaagttcatttttgcagttgcatttggtgtattttttgggagtatcgtaatcctattcatgttagctcgtctcctccttttgtttcgtggtacaagtttcaggaacaaaaacatgagcgatgatagcaatatggaagtgttatcattcaactccaattcagagaattcattggtgatgatgccaggaagcaagggagacgaaaccaagctcacattcacggacattgtgaaggcaacaaataactttggcaaggagaacgtcatcgggtgtggaggctatggactagtattcaacgccgagctacc

SEQ ID NO: 27315 - protein, 203 aa, Panicum virgatum
  misc_feature: Ceres CLONE 1876092
  misc_feature: SWISSPROT Homolog: EC 2.7.11.1 Non-specific serine/threonine protein kinase
LSFNKLTGNIPQSICNLTNLLALDLSSNHLTGSIPSALNNLHFLSKFNVSFNDLEGPVPTTGQFGTFTNASFDGNPKLCGTSLIHHCSSAEAYFTSKKQHNKKFIFAVAFGVFFGSIVILFMLARLLLLFRGTSFRNKNMSDDSNMEVLSFNSNSENSLVMMPGSKGDETKLTFTDIVKATNNFGKENVIGCGGYGLVFNAEL

SEQ ID NO: 27316 - DNA, 516 bp, Panicum virgatum
  misc_feature: Ceres CLONE 1876104
  misc_feature: Encodes the peptide sequence at SEQ ID NO. 27317
gaaccagcagtacaagaagcacaagaaaaaacacttgtagccatcaacttcttcttcttcttcttcaccgtcatcaactcatcatcagctcagacccatcgatcgatccgcagctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaattaaaggtgaataaagcatcgattgtgtgtagcctt

SEQ ID NO: 27317 - protein, 74 aa, Panicum virgatum; identical to SEQ ID NO: 18697
  misc_feature: Ceres CLONE 1876104
  misc_feature (15)..(74): Pfam Name: potato_inhibit Pfam Description: Potato inhibitor I family

SEQ ID NO: 27318 - DNA, 406 bp, Panicum virgatum
  misc_feature: Ceres CLONE 1876114
  misc_feature: Encodes the peptide sequence at SEQ ID NO. 27319
aataccctcagtagccgctcccgcgaacaccggaccggagttccgggaacctccctggccggcgagatgcaaatcttcatgaagacgctgaccggcaagaccatctccctcaaggtcgagagcaccgacgccgtcggtaatgtcaagcccaacatctatgacaaggaaggaatcccgcccgaccagcagcgtgtgatcttccccgggaagcagctggaggatggccgcactctggcggactacaacatccgaaaggagtacccgctccacctcgtgctgcggctccgtgatgcgattattgagccctcgctgcaggtggtgccccgggagtagctgcgggactagatgatctgcctcaaatgctacgcaaccctgcctctcacggacgtcggctggcgcgcgaaga

SEQ ID NO: 27319 - protein, 88 aa, Panicum virgatum
  misc_feature: Ceres CLONE 1876114
  misc_feature (6)..(74): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFMKTLTGKTISLKVESTDAVGNVKPNIYDKEGIPPDQQRVIFPGKQLEDGRTLADYNIRKEYPLHLVLRLRDAIIEPSLQVVPRE

SEQ ID NO: 27320 - DNA, 698 bp, Panicum virgatum
  misc_feature: Ceres CLONE 1876115
  misc_feature: Encodes the peptide sequence at SEQ ID NO. 27321
aagccaagctccactaacttttagttttatgccttgccactgccaccgccgccgccgtccttcatctcttggaggttggagctttcccctccctcctcgcgtccatatcctattaattattccctttgctagctccctccccgccggttcctttcctcgatcgcattgtctgtcttgtgttgctttcttccttcatctatcctctcgctgggcctgcctcaatccatcgtattgctcctctgctgctgatgcgcttccttctcggagcagggccgcaaattaaagcaggcgcaacttgatgatcagcagaggctagcttctcaggttcagatttcttgattgatctcacatcggtcgcagccatggatcctgagttcggagtaggcacggcgccccgaaagagggagtcatggcgcacgacgctgctgctggcgtaccagagcctcggggtggtgtacggcgacctcagcatctcgccgctctacgtgtacaagagcaccttcgccgaggacatcaagcactcggacaccaacgaggagatcttcggcgccctctccttcgtcttctggacgctcaccctcatccccctcatcaagtacgtcaccatcgtcctgcgcgccgacgacaacggcgaaggaggcacgttcgcgctctactccctcatctgccgccacgccaatgtcagcctcctccccaac

SEQ ID NO: 27321 - protein, 111 aa, Panicum virgatum
  misc_feature: Ceres CLONE 1876115
  misc_feature: Functional homolog of the protein sequence given in SEQ ID NO 50430
  misc_feature: Useful for making plants with modulated biomass
MDPEFGVGTAPRKRESWRTTLLLAYQSLGVVYGDLSISPLYVYKSTFAEDIKHSDTNEEIFGALSFVFWTLTLIPLIKYVTIVLRADDNGEGGTFALYSLICRHANVSLLP

SEQ ID NO: 27322 - DNA, 1765 bp, Panicum virgatum
  misc_feature: Ceres CLONE 1876144
  misc_feature: Encodes the peptide sequence at SEQ ID NO. 27323
gcattagccgaaacttctcggctcctcccgctgccctgtgagattcctctgaaaatatctagctctagaatcgtctaccctgtcgtggccgccggttttcatgcgccccgacgctgcgcgcggcatcctccgagcggacctgcctctctagttcctacccattcaccggaggcgccggcgccgatctcatactccgcgcggagctcctcggcatgcaacaagaaccgcgtcgggagggcgagatttggcggggtcgcgagaggcggcacgggagacgagatcaagacgtggaggtgaggttcaggctgctgcaaagaggacaacgacctaggcaagggatggcaccttgggcacggtgctagcagaattaattgtgaccttggatcaacagtcctgaggaaatagagattcaatttggccaagatttttgcttgtcaaatgatattcagtacggtggttaaaccatgcagtcgacaagatatggcctatctgtatggagaagatcactttacaacttctatggcgggaaactctttgaaggttgtccgttctgtattttttcccttactgagaaatagctggtccaatattgaggagagacctcctattgcgtatatggagcttgagattttagaaggaaacgacattgaatcatttgctataaatggactagcggactcttatgtgaaaagttgtcttggtccattcaaattccaaacacagatagaggaaaacactatcacactatcccgtaagtggtttgaagagtttaaaataccaatcacatcgtgggaggcatcaaaggcatcaaatgaacttttcatggaagttcgtgataaggaccccatgtttgatgacttgcttggagaatgtaccattgatttacatgaactgagaggtggacaacgacatagcaagtgcatatcattgaataatatcaagaaaggaaggattcacttggcggtaacagttaaaaatgtatctgaggacaaatgtgcttcatttttggacgaaccattgaggaaagctgatgctgaactaccattatcaacctcacttgacagcacgtttgatgctgctgaactgcctgaagaaaaagtcttcatggatgaaatggagcagatagatagtgatggacaagaacaatctggagggttatatgttcatcgccctagcctggggttccaaagccatgggaatctcgaaaaggacgagcacgtaacccaggcacacagatttaccaataggttgaaaagtcgacggaaatccccacaccaataagcagtgggcaagggggtctgtttaacctaggctcctttttcggaagaactcaaaaggggagtctaaatcccagcctttctactacttcgggttctcagagtgtgacagaccttgatccaaagctccccaaaacaccacatcccaacctgaagatgcagcaaagtttgtccaggaaaaaaaaaaagaagcagtccaaccaggcacatcactaacaagcacattgagcaggtattttcccaggaagagagccatcaacattacttttggcagctgttttcattagataaagtttctaattatgaacatgcaggtctccaagcagtctcacaaatgttttatggtttcagtatatgtcaatgtacgtccatatctttccatcatgtactactactcatatgcaaatattcatatatatatatatatatatgtgtgtgctatgtatgtttacgcgtatgtacatatatataaatgcaacttttactgc

SEQ ID NO: 27323 - protein, 266 aa, Panicum virgatum
  misc_feature: Ceres CLONE 1876144
  misc_feature (46)..(132): Pfam Name: C2 Pfam Description: C2 domain
MAYLYGEDHFTTSMAGNSLKVVRSVFFPLLRNSWSNIEERPPIAYMELEILEGNDIESFAINGLADSYVKSCLGPFKFQTQIEENTITLSRKWFEEFKIPITSWEASKASNELFMEVRDKDPMFDDLLGECTIDLHELRGGQRHSKCISLNNIKKGRIHLAVTVKNVSEDKCASFLDEPLRKADAELPLSTSLDSTFDAAELPEEKVFMDEMEQIDSDGQEQSGGLYVHRPSLGFQSHGNLEKDEHVTQAHRFTNRLKSRRKSPHQ

SEQ ID NO: 27324 - DNA, 385 bp, Panicum virgatum
  misc_feature: Ceres CLONE 1876162
  misc_feature: Encodes the peptide sequence at SEQ ID NO. 27325
aggcaaatcctcgcaatggcgtcgctgctgcgcctcccctctctcctctcgccgtccaagcccctgctccggcgccggctgccggcggcgaggctcgcggccgccgccgcgtacaggggccaggcctcggaggccgtgggcgcggcggcgccggcggccgcggagacccgcggaggggacagggaggggcaggtgacgccccgctccgtggacttcaacgcctggtacaccgacgtcatcgccgccgccgagctctcgaactacgggcccgtaaggggcaccatgggcatccgtccctaccgatacgccatctggtaggccaccccggattaactgaatgttaaattccaacaaaaagggcacaccaacatgcacctacctcact

SEQ ID NO: 27325 - protein, 100 aa, Panicum virgatum
  misc_feature: Ceres CLONE 1876162
  misc_feature: SWISSPROT Homolog: EC 6.1.1.15 Proline--tRNA ligase
MASLLRLPSLLSPSKPLLRRRLPAARLAAAAAYRGQASEAVGAAAPAAAETRGGDREGQVTPRSVDFNAWYTDVIAAAELSNYGPVRGTMGIRPYRYAIW

SEQ ID NO: 27326 - DNA, 1819 bp, Panicum virgatum
  misc_feature: Ceres CLONE 1876171
  misc_feature: Encodes the peptide sequence at SEQ ID NO. 27327
ctccacctccactccccgtctccaccttagcgccacgttgctgtcgctagccgcccgctcgcctgctcttccccagcgccgacgtctccagtcggccgctgctggatccccaccgagacaagtaagggcgagggcgagattgtcggcgctggatctgacgactacgtgaaggactccactgccgtacaaaagatccagtagtggctgctcgacctccacctgcaaggccacgaagaagaacgctccaccatcgtctaccaaagcaattgccgctgcttgaagaaagctccaacaaagaaggctgctggggatttatgtgttgatttgtattctgttttgggtgggatttgtcggggacgaggcacccgtcgggtatctgatccccgctcggggacggggacagggaaaatcctccccccgcgagcggggacggggattgaaatggggaaattttgatgtgtcggggagaggaacgttccgcaggtccccggcggggatagccccgttgccatccctactcctgtcccactcgcgccgctgcaccaccctctaccctgccccctccgcgccgccgccggaggcgcctcgatccagatccagtagacatgcctcgctatgatgatcgttatgggaacacacgcttgtatgttggcagactgtcctcccgcactcgtacccgtgatctggaatatcttttcagcaaatatggaagaatacgagaagtggagttgaagcgcgactatgcatttattgaattcagcgatcctcgtgatgctgatgatgcacaatacaacctagatggcagggaagttgatggcagccgcattatcgttgagtttgctaaaggggttcctcgtggttctggtggctcacgcgagtacatgggaagagggcctccgccagggacaggtcgctgttttaactgtggaactgatggtcactgggcaagggattgcaaggctggtgactggaagaacaaatgctaccgttgtggagaaaggggccacatagaaagaaattgccagaacagtccaaggaatctcaggcgtgagagaagttattcacggtcaccatctccacgcagtggacgggggcgcagccggagctacagcagaagccggagctatagccgttctagatccccatctggatctcccaggggtggacgccgagaccgtgatgagaggagatcaaggagtcttagctacagcaggagccccaggcgttctgcttcaccaagtgcaaaggaaaaggagcgcagccccacaccttacaacggtaggagcccaaggagtcccagcccaagggatcagatgagcccgccaccaaaggacaatggtgaacgcaacggttcagaccgtggtgacagccctgtgaggagggagaacagcaggagcaggagccgtagcccatctgatggctaccgtagccctgcagccaatgggcgcagcccgagccctagagatgaccggagccctagtcccaaaggcaatgctggtgatgatgatggcggccggggttcaccaagaggaagccagcccccctgaaaaccttccatcccagtttgagatgcagtgtgccgattcagttgtaatagttacattttcagctttaagacagaactgtatttgccacccattttctcgacgacttgtgcttttgtgagccagaaacttttgtaaggatctgttgccctcgggctatccctgctttgtaacgttgatatttgaacttcttagaccgctaaatttggatatttgccagataatttgccctcgtggcagccacatattggcaatatgatattgcagttgaagcg

SEQ ID NO: 27327 - protein, 313 aa, Panicum virgatum
  misc_feature: Ceres CLONE 1876171
  misc_feature (13)..(76): Pfam Name: RRM_1 Pfam Description: RNA recognition motif. (a.k.a. RRM, RBD, or RNP domain)
  misc_feature (102)..(119): Pfam Name: zf-CCHC Pfam Description: Zinc knuckle
  misc_feature (124)..(141): Pfam Name: zf-CCHC Pfam Description: Zinc knuckle
  misc_feature: SWISSPROT Homolog: EC 5.2.1.8 Peptidylprolyl isomerase
MPRYDDRYGNTRLYVGRLSSRTRTRDLEYLFSKYGRIREVELKRDYAFIEFSDPRDADDAQYNLDGREVDGSRIIVEFAKGVPRGSGGSREYMGRGPPPGTGRCFNCGTDGHWARDCKAGDWKNKCYRCGERGHIERNCQNSPRNLRRERSYSRSPSPRSGRGRSRSYSRSRSYSRSRSPSGSPRGGRRDRDERRSRSLSYSRSPRRSASPSAKEKERSPTPYNGRSPRSPSPRDQMSPPPKDNGERNGSDRGDSPVRRENSRSRSRSPSDGYRSPAANGRSPSPRDDRSPSPKGNAGDDDGGRGSPRGSQPP

SEQ ID NO: 27328 - DNA, 710 bp, Panicum virgatum
  misc_feature: Ceres CLONE 1876180
  misc_feature: Encodes the peptide sequence at SEQ ID NO. 27329
ctcgctgacatctcggccttctgagatactaccggataggcagtcggcagctgtacaccactcgtcccggaaaggccacggacagcgaccgccggaacctgcgagccggcgcagccgcgcttcagggaaaatgacggcgctgacgaccacctcctccaccctctccgccacgctcccttcggttcccaggccgccgccccgtgcccccgttgcccgcctgcgcctccgctcccgccgccgcgccctgctgcgctgcgacgcggtgtccgagctcgccccggccgcctcagccgcctacggcgtactcctccttggcggtggcgtcttcgcatatgcgaggtctgggagtaaaggctccatctacggagggctagctggatctgcacttatgggcattacctattctctgatgcagtcacctgagacgaaggcggcaggtgacgctgttggatttggatctgcctttctatttgcctgcgtgtttggtatcaggttgtacaatagccgcaaactggtgccgtctggccttctcctcgccctttctcttggtgccttgggtactttctactccgcttacctgcaagacaaggtgtaaaccaatttggttctagcagcttatgaatcttgtaccatctgaagcttccttgaaggtttgctggctcatttagatgtacaatacaactctggacctactgtcggtgcaccttcct

SEQ ID NO: 27329 - protein, 154 aa, Panicum virgatum
  misc_feature: Ceres CLONE 1876180
  misc_feature (50)..(149): Pfam Name: TMEM14 Pfam Description: Transmembrane proteins 14C
MTALTTTSSTLSATLPSVPRPPPRAPVARLRLRSRRRALLRCDAVSELAPAASAAYGVLLLGGGVFAYARSGSKGSIYGGLAGSALMGITYSLMQSPETKAAGDAVGFGSAFLFACVFGIRLYNSRKLVPSGLLLALSLGALGTFYSAYLQDKV

SEQ ID NO: 27330 - DNA, 682 bp, Panicum virgatum
  misc_feature: Ceres CLONE 1876184
  misc_feature: Encodes the peptide sequence at SEQ ID NO. 27331
aaaaaaccccaagccgcgcctccaccgctcactcttcccctattccaccacctctcctggtctggtcgcctcgacccatcccaatcttgaggtttagtgttcaatggcagccttcaacaagcttggcagccttctaaggcacagtgctctgacaagcggtgcccctgccagctcgtctcctgctttgttcaatgttgctcggctaatgtccaccaagcttttcgttggtggtctttcctggggtactgatgagcagactttgagacaagcatttagcagcttcggagaggttaccgaagcaaggatcatcacagacagggatactggaaagtcaagaggctttggctttgtgaatttcagcaacagtgatgatgccaaggaggctatgagccaaatggatggtcaggaacttgaagggcggagtgtccgtgtgaacttcgctaatgacaggcctgcagggaaccgtggtggtggtggcggctttggtggaggtggctatggtagtggcggctttggtggaggcaaccaaagctatggttctggagggggcccagatggcttttaaaagttcgctaactataagaagtatttgaaataatggacttaagtacctgatgaacagcttatgtgaggctgtaatcatgttttactattttgtgttctgaagttgagtcgttgaacc

SEQ ID NO: 27331 - protein, 153 aa, Panicum virgatum
  misc_feature: Ceres CLONE 1876184
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50182
  misc_feature: Useful for making plants with modulated biomass
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
MAAFNKLGSLLRHSALTSGAPASSSPALFNVARLMSTKLFVGGLSWGTDEQTLRQAFSSFGEVTEARIITDRDTGKSRGFGFVNFSNSDDAKEAMSQMDGQELEGRSVRVNFANDRPAGNRGGGGGFGGGGYGSGGFGGGNQSYGSGGGPDGF

SEQ ID NO: 27332 - DNA, 724 bp, Panicum virgatum
  misc_feature: Ceres CLONE 1876188
  misc_feature: Encodes the peptide sequence at SEQ ID NO. 27333
ctctgcaaccgccacaccaaacgcgcacgcgctgctcgtttctcggccgctttctctgtcccccccccccttctacctcgcagatctccgcgggccgtgcggtttcttgattcggccttccccgggctgtccgatctccgcggcggcgggggatgggcaactgctgcgtgacggcggggggagccgccggcgagggcggcggcaagaacaagaagcccaaggagccgaagcagaagggcaagaagccgaaccccttctcgatcgagtacaaccgctccgcgccgccgggcgccgcgccgcggctggtggtgctgcgggagcccacggggcgggacatcgcggcgcggtacgagctgggcggggagctcgggcgcggcgagttcggggtcacctacctctgcacggaccgcgactccggggaggcgctggcctgcaagtccatctccaagaagaagctccgcacccccgtcgacgtcgaggacgtgcgccgggaggtggagatcatgcgccacctccccaagcaccccaacatcgtcacgctcagggacacctacgaggacgacaatgccgtgcacctcgtcatggagctctgcgagggcggggagctcttcgaccggatcgtggcgcgggggcactacaccgagcgcgccgccgccttggtcacgcgcaccatcgtcgaggtcgtgcagatgtgccataagcatggagtgatgcacagggatct

SEQ ID NO: 27333 - protein, 190 aa, Panicum virgatum
  misc_feature: Ceres CLONE 1876188
  misc_feature (66)..(190): Pfam Name: Pkinase Pfam Description: Protein kinase domain
  misc_feature: SWISSPROT Homolog: EC 2.7.11.1 Non-specific serine/threonine protein kinase
MGNCCVTAGGAAGEGGGKNKKPKEPKQKGKKPNPFSIEYNRSAPPGAAPRLVVLREPTGRDIAARYELGGELGRGEFGVTYLCTDRDSGEALACKSISKKKLRTPVDVEDVRREVEIMRHLPKHPNIVTLRDTYEDDNAVHLVMELCEGGELFDRIVARGHYTERAAALVTRTIVEVVQMCHKHGVMHRD

SEQ ID NO: 27334 - DNA, 444 bp, Panicum virgatum
  misc_feature: Ceres CLONE 1876191
  misc_feature: Encodes the peptide sequence at SEQ ID NO. 27335
aagaagagcagcaccaaccagctcttctccagcacaaagccactccaaatcagccggccatcacccacgcctgcttctgatctccgatctctcaagtctcacggcttactagtgcttccggttccacccccccccccccccccccgcaccttcgaaagggagtgcgagaacggccgcgtcgccaagggggactctgtgagcgtggcgacgccgcgcgccaacccgctcaactgggggaagggggaggaggacctcatgggcagccacctagaccaggtgaagaggatggcggccgaccaccccccgccggtggtgaagatcgagggcccccgcctccggattgcgcacgtggccgcagtgggcaacggacgcggggaggcccgagtccagctccaccaatctccgcgcgaccccgtcaagggcagaagcgactgggtgatgaac

SEQ ID NO: 27335 - protein, 147 aa, Panicum virgatum
  misc_feature: Ceres CLONE 1876191
  misc_feature: SWISSPROT Homolog: EC 4.3.1.5 Phenylalanine ammonia-lyase
KKSSTNQLFSSTKPLQISRPSPTPASDLRSLKSHGLLVLPVPPPPPPPRTFERECENGRVAKGDSVSVATPRANPLNWGKGEEDLMGSHLDQVKRMAADHPPPVVKIEGPRLRIAHVAAVGNGRGEARVQLHQSPRDPVKGRSDWVM

SEQ ID NO: 27336 - DNA, 701 bp, Panicum virgatum
  misc_feature: Ceres CLONE 1876205
  misc_feature: Encodes the peptide sequence at SEQ ID NO. 27337
gcaccacaccgccttcacccgtgccccccacccctgccctgcttcgacgggcggcggcgcagatcgaaggaaccaggagggaatgatggatctcggggacagccagcagcggctcatcgccggcgcggcgctgctgctggccaccgtcgccttcgtcaggctcctgctgggctcccgcgcccgcggcaagcgcctcccgcccaccatcccgggggcgccggtcgtcggcgggctcatcaagttcatgcgcgggcccatccccatgatccgggaggagtacgcccgcctcggcagcgtcttcaccgtccccatcctcagccgccggatcaccttcctcatcgggcccgaggtctccgcgcacttcttcaagggcaacgaggccgagatgagccagcaggaggtgtacaggttcaacgtgcccacctttgggccgggggtcgtcttcgacgtcgactactccgtcaggcaggagcagttccggttcttcaccgaggccctgcgtgccagcaagctccgcagctatgtcgaccagatggttgctgaggctgaggagtacttctcaaagtggggagaaagtggtaccgtgaatttgaagtatgagttggagcaccttatcatactgacagctagtcgatgcttgctgggaagggaggtgcgagagaagctctttgatgatgtatctgctctcttccatgaccttg

SEQ ID NO: 27337 - protein, 205 aa, Panicum virgatum
  misc_feature: Ceres CLONE 1876205
  misc_feature: SWISSPROT Homolog: EC 1.14.13.70 Sterol 14-demethylase
MDLGDSQQRLIAGAALLLATVAFVRLLLGSRARGKRLPPTIPGAPVVGGLIKFMRGPIPMIREEYARLGSVFTVPILSRRITFLIGPEVSAHFFKGNEAEMSQQEVYRFNVPTFGPGVVFDVDYSVRQEQFRFFTEALRASKLRSYVDQMVAEAEEYFSKWGESGTVNLKYELEHLIILTASRCLLGREVREKLFDDVSALFHDL

SEQ ID NO: 27338 - DNA, 1167 bp, Panicum virgatum
  misc_feature: Ceres CLONE 1876234
  misc_feature: Encodes the peptide sequence at SEQ ID NO. 27339
gcatcactactccccgcagtccccactcgccactcccccccaaagctcctctccctctttctctctccgccatggcctctccctccgcctcctcctagccccgtccggcgtccacgacacctcccagatcccgcccgcagtgcgccaccccccggcacaggcgcaacatgggagggtgccacgcgaagccgctcacccacgacgccgacacctcgccgccgcgcgccgcgccggcgaccccgcccccgggctgcgccaccccaaccaccccggggaagaagcattgggcggtctcccccttcttctcgttctccaccccgagcccgagccccgcgcaccacctcttcggcggctccgcggcgtccccgcgcaagtcctcccccgcgcacccgggcgcggcggccggctccgcgcccaccaccccggccaggcgcctgctgcggctgcccttcccgccgccgtcgcccgccaagcacatcagggcggcgctcgccaggaggcacggcccgccgcggccctccatccccgaggaagtcggcggcgagggggagggctgcggtggcggcagggggctggacaaggggtttgggttcaacaagggcttcgcagccaagtacgatatgggggatgaagtcggaaggggacacttcggttacacctgcgccgccacggttaagaaaggcgcgcgcaagggggaatccgtcgccgtcaaggttatccccaaggcaaagatgacaacatccattgctatagaggatgtccgaagggaggttaaaattttgaaagctttggcaggaaacaagaacttggttcaattttatgatgcctatgaggacaatgagaatgtatatatagtaatggagttgtgcgagggcggtgagctacttgatagaatactttccagaggtgggaagtactccgaggatgatgcaaaagctgtcctggtgcaaatattaaatgttgttgctttttgtcacattcaaggagtggttcatcgggatctcaagccggagaattttcttttcacttcaaaagatgagaatgcccatcttaaggctattgacttcggtttatcagattttgtaaaaccagatgagaggctaaatgacattgttggaagtgcttattatgttgctccagaagttctgcatagatgctatagcacag

SEQ ID NO: 27339 - protein, 333 aa, Panicum virgatum
  misc_feature: Ceres CLONE 1876234
  misc_feature (150)..(333): Pfam Name: Pkinase Pfam Description: Protein kinase domain
  misc_feature: SWISSPROT Homolog: EC 2.7.11.1 Non-specific serine/threonine protein kinase
MGGCHAKPLTHDADTSPPRAAPATPPPGCATPTTPGKKHWAVSPFFSFSTPSPSPAHHLFGGSAASPRKSSPAHPGAAAGSAPTTPARRLLRLPFPPPSPAKHIRAALARRHGPPRPSIPEEVGGEGEGCGGGRGLDKGFGFNKGFAAKYDMGDEVGRGHFGYTCAATVKKGARKGESVAVKVIPKAKMTTSIAIEDVRREVKILKALAGNKNLVQFYDAYEDNENVYIVMELCEGGELLDRILSRGGKYSEDDAKAVLVQILNVVAFCHIQGVVHRDLKPENFLFTSKDENAHLKAIDFGLSDFVKPDERLNDIVGSAYYVAPEVLHRCYST

SEQ ID NO: 27340 - DNA, 724 bp, Panicum virgatum
  misc_feature: Ceres CLONE 1876234-R
  misc_feature: Encodes the peptide sequence at SEQ ID NO. 27341
tagatgggagcaacatgcacgatctgcttatgaacattttgagaaggatggcaatcatgctattgtaattgatgaactagcatctgaattgggcctcagcccttcagtaccactgcatgtcgttctgcaagattggatcaagcatacggatgggaaattgagctttctcggatttgtcaagctattgcatggcatgtccagcaggtctctgtcaaagatgagatagctgttgataatctctaacgacagcacaagtttacaccaccctagcccctgccttcacaggcaaattaacagggcttaaagaactgttgattggagcttgcataccgtgggcgtctgagttctagcactgcgtgatctgccactaattttagtatagagacatagagttatgtttgtcgactgtcgtagcctgcctactgatcatttagttgataggaaaaaggaaaatctcacccatgcctgcaacatgtgatgtttctaacagtcttagagtaggtgtcatgttctgttgtgattttgggaacaaactttgtaatcctggaactggagcaagttagctgcggtcaccagggtggcgtctgaagcgtggacatattcacttactgccattgtcattgtgtcattgtactgactgatgaaagtgagtgatggtcatgttcatcaggttctccttcctgtatatattgcagtgatggaaatgtaccatgtttttagtttc

SEQ ID NO: 27341 - protein, 74 aa, Panicum virgatum
  misc_feature: Ceres CLONE 1876234-R
  misc_feature: SWISSPROT Homolog: EC 2.7.11.1 Non-specific serine/threonine protein kinase
RWEQHARSAYEHFEKDGNHAIVIDELASELGLSPSVPLHVVLQDWIKHTDGKLSFLGFVKLLHGMSSRSLSKMR

SEQ ID NO: 27342 - DNA, 693 bp, Panicum virgatum
  misc_feature: Ceres CLONE 1876257
  misc_feature: Encodes the peptide sequence at SEQ ID NO. 27343
aaaactccccctgggcaaccgtccattccccgtcccgccttatcctcccctgatcccgtacaaaagcgggctccctcacgctcccgcccgcccgctcaagctatccaccaccatagccgccgccccgccgccacactcttcttgctcacggctctagcccaccgagcgcaggaatggcgtcgttcgccgtggcaacggtcccgtcgctggcggccccggcggccaggaagaggtccggcggcgtcacctacgtcgagggcatgaacgcctacagcggcctcaaggggctcaacaaggtcaccatgctcgagctgcgcaagaccgccgactactccttcgccaagatcgtggcgtcgctcagccccgccggcaagacgcggcgcggcagcgcgttcggggctcagatgaacgccgcggcggagatcttcaggatcgccgccatcatgaacggcctcgtgctcgtcggcgtcgccgtcgggttcgtgctgctccgggtggaggccgccgtcgaggagtccgagtagggatggacgcgcgcccgcccgcccgccctgatagcagccactctgctgctgcctcttgcctcatataagccgtgatatataaaacgtaatgtgtgttttttattgaatttacttcaagtatgtatccatgacaattgatgaataccgtgcaaacgtgttttcggagtcg

SEQ ID NO: 27343 - protein, 116 aa, Panicum virgatum
  misc_feature: Ceres CLONE 1876257
  misc_feature (78)..(114): Pfam Name: PetM Pfam Description: PetM family of cytochrome b6f complex subunit 7
MASFAVATVPSLAAPAARKRSGGVTYVEGMNAYSGLKGLNKVTMLELRKTADYSFAKIVASLSPAGKTRRGSAFGAQMNAAAEIFRIAAIMNGLVLVGVAVGFVLLRVEAAVEESE

SEQ ID NO: 27344 - DNA, 1171 bp, Panicum virgatum
  misc_feature: Ceres CLONE 1876337
  misc_feature: Encodes the peptide sequence at SEQ ID NO. 27345
atcatcgaccaaagttccagaagcgcatcaccaaaaaaaaaaggagggcggtatcgcaaaagcgcataaaccccgcagccccccacgccgccgcgattcgatcgatcgatcatcgatccggcgcttctccgcggcgcacgtcttcggaacgagtcctcgagagggttcgaatccaccgtcgcgtcgtgggggaagagatggtgctgatcgagctggagccggagcccgagcccgagaaggcggcgcgcccctcaccgccggttcccgaggagcaggcgggggccgccgaggccggcggggaggcggcgcgcgcctcgtcgccgccggggcccggggagcaggcgggggccgcggccggtggggaggcgccgagggcggagcaggccgatgaggaggaggaggaggaggccttcgaggatgcgctcaccgacgagcagctgcgggagaaagctagaaaccaagcaaatgacgcaaaaacagaaggaaacaagctttttggtgctggacaatatgaggaagcattatctcaatatgaaattgctttgcaaattgctgctgagctggaatcttccgaggatatacgctctgcgtgccattcaaattgtgctgtatgcttcttgaagttggggaaacacgacgagacgattaaagaatgcacaaaagcactcgagctcaatccatcgtacatgaaagccttgctccggagagcagaagcgcatgaaaagcttgagcactatgatgaagctattgctgatatgaaaaaggtcattgaattggatccttcaaatcaacaagccacgaggtcactgctccggcttgagcccctggcagctgagaaaagggaaaagatgaaggaagaaatgattgcaaagctgaaagatctggggaattctgtgctggggcgcttcggaatgagcgttgacaatttcaaagctgtcaaagatccaaacacaggttcctactccattcaattccagaagtaacacatggtgaagaaatacacagatgaatatcgctgggaggcatatttcagttaatggactcactggattcttcgctgtaattgcccgaggcacttctgcatcacatacatggtccatgttcacatagaatcctgcacatcgatctgaacataagcgatccttgaatcttttgtttgcgctcattgcac

SEQ ID NO: 27345 - protein, 261 aa, Panicum virgatum
  misc_feature: Ceres CLONE 1876337
  misc_feature (130)..(163): Pfam Name: TPR_1 Pfam Description: Tetratricopeptide repeat
  misc_feature (164)..(197): Pfam Name: TPR_1 Pfam Description: Tetratricopeptide repeat
  misc_feature: SWISSPROT Homolog: EC 5.2.1.8 Peptidylprolyl isomerase
  misc_feature: Functional homolog of the protein sequence given in SEQ ID NO 50975
  misc_feature: Useful for making plants with altered alkaloid content
  misc_feature: Useful for making plants with altered terpenoid content
MVLIELEPEPEPEKAARPSPPVPEEQAGAAEAGGEAARASSPPGPGEQAGAAAGGEAPRAEQADEEEEEEAFEDALTDEQLREKARNQANDAKTEGNKLFGAGQYEEALSQYEIALQIAAELESSEDIRSACHSNCAVCFLKLGKHDETIKECTKALELNPSYMKALLRRAEAHEKLEHYDEAIADMKKVIELDPSNQQATRSLLRLEPLAAEKREKMKEEMIAKLKDLGNSVLGRFGMSVDNFKAVKDPNTGSYSIQFQK

SEQ ID NO: 27346 - DNA, 726 bp, Panicum virgatum
  misc_feature: Ceres CLONE 1876341
  misc_feature: Encodes the peptide sequence at SEQ ID NO. 27347
gaaaaaaagctgaatatatagaagtatagttggcgaaataaacaaccacacccagtgtcaaccaaaacagtccccctggcctattaggccactcagcaccaagaacagacaggcaagctcactcgcacctttatataaagcaacccaccagaagcatcagctttggtttcatctccttgtacatagcccattgcaaggcattctcaagcatagcctgtgcctttcccttcctctcctccgctctgtcttccagagctttgagatggctcagcagaaggtggtgctgagggttccaaccatgactgatgacaagatcaagcagaaggccattgaagctgttgcggacatttacggtattgactccatagcagcagatctgaaggagaacaagatgaccatcataggcgaaatggatgctgttgcaattgccaagaaattaaagaagattgggaagattgacattgtgtccattggacctgcaaaggaagaaaagaaggaagaaaagaaagaggagaaaaaagaagaaaagaaagaagagaagaaagaggagaagaaagaggaaaagaaagaagagaagaaatgataaaaatataaagcatatactatctatcattgtgtgacctctctcttatctgcagttgcaatagttttgagcctttgactttgtactgatgtttctatgtgaagttactatgtaaaatttatactacagagtacaaattagtt

SEQ ID NO: 27347 - protein, 106 aa, Panicum virgatum
  misc_feature: Ceres CLONE 1876341
  misc_feature (7)..(74): Pfam Name: HMA Pfam Description: Heavy-metal-associated domain
MAQQKVVLRVPTMTDDKIKQKAIEAVADIYGIDSIAADLKENKMTIIGEMDAVAIAKKLKKIGKIDIVSIGPAKEEKKEEKKEEKKEEKKEEKKEEKKEEKKEEKK

SEQ ID NO: 27348 - DNA, 651 bp, Panicum virgatum
  misc_feature: Ceres CLONE 1876352
  misc_feature: Encodes the peptide sequence at SEQ ID NO. 27349
aaacgttcgaaacccccattccgaactagaaaatccaaatcgctaagctccgaaaccctaaccctagtctctcctcccgccaccgcccgccccaatggcgaagccggtgaagtacgaggaggaggaggaggaggaggagatctcgtcctccgccgaggaggaggaggatgaccagtccgacgcggccggctccggatctggcgaggagggggacgaggacgaggacgaggaggacgccgcggcacctcccgcgggggaggaggaggaagctgagggagaggggcagcaggagttggaggaggaggtcgatgaggaggagatcgaggccgtcactaccggcgccggcgccgaggaggaggacgccggtgccgcggcccctgcggaaggcgacgacgagtcccagtccaccgaggacgacgaggctgccccgggcgacaacggcgacgagactgatgcaatggtcgggaagcgtgaaaaagccagggtaaaggagcttcataagatgaagaggcaaaaaatccaaaatatattggatactcaaaatgctgcccttgatgctgacgtgaacattaaagggaagggaggattgaaataccttcttcagcacacggaaatatttgcctcactttgaaaaaggaagtcaatcctaac

SEQ ID NO: 27349 - protein, 178 aa, Panicum virgatum
  misc_feature: Ceres CLONE 1876352
  misc_feature: The sequence is a functional homolog of SEQ ID NO 1582 in the 10/412,699 US patent application
  misc_feature: The sequence is a functional homolog of SEQ ID NO 1581 in the 10/412,699 US patent application
MAKPVKYEEEEEEEEISSSAEEEEDDQSDAAGSGSGEEGDEDEDEEDAAAPPAGEEEEAEGEGQQELEEEVDEEEIEAVTTGAGAEEEDAGAAAPAEGDDESQSTEDDEAAPGDNGDETDAMVGKREKARVKELHKMKRQKIQNILDTQNAALDADVNIKGKGGLKYLLQHTEIFASL

SEQ ID NO: 27350 - DNA, 736 bp, Panicum virgatum
  misc_feature: Ceres CLONE 1876360
  misc_feature: Encodes the peptide sequence at SEQ ID NO. 27351
atttagtagcaccttaggatggcatagccttaacgttaatggcgaggttcaaaagaggaaaggcttgcggtggatacctaggcacccagagacgaggaagggcgtagcaagcgacgaaatgcttcggggagttgaaaataagcatagatccggagattcccaaataggtaagaccgaccggaacggcgcccgccgcgcagacgcgaagaagaggaaggtactcgccgcctagggtttcctccgccgccgccgccacggccaccgccaatcaggtgggagtggggggaacctcgccgcgatgccacagtcggtgctggtggagcgcgcgacgagcgagtcgctaatcgggcctgattggtcgctcaacctcgagatctgcgacatcctcaaccacgacccctcgcaagccaaagatgtagtgaagactatcaagaaacggattgggcacaagaactcaaaggtccagcttcttgcattaacgttgctcgagaccttgattaaaaattgtggagattttgttcatatgcaagttgctgagaaggatatacttcatgaaatggtgaagatagctaagaagaagccggactatcatgttaaagagaagatactgattctgattgacacttggcaagaagcttttggtggttcccgtgcaagatatccacagtattatgcagcatatcaagagatgctgcgtgctggagctgtatttcctcaaaggccagagagttctgtg

SEQ ID NO: 27351 - protein, 145 aa, Panicum virgatum
  misc_feature: Ceres CLONE 1876360
  misc_feature (1)..(135): Pfam Name: VHS Pfam Description: VHS domain
MPQSVLVERATSESLIGPDWSLNLEICDILNHDPSQAKDVVKTIKKRIGHKNSKVQLLALTLLETLIKNCGDFVHMQVAEKDILHEMVKIAKKKPDYHVKEKILILIDTWQEAFGGSRARYPQYYAAYQEMLRAGAVFPQRPESS

SEQ ID NO: 27352 - DNA, 450 bp, Panicum virgatum
  misc_feature: Ceres CLONE 1876387
  misc_feature: Encodes the peptide sequence at SEQ ID NO. 27353
atatatccattcgagctcctcaaaccgcgagagctagcactgccacaccatgtccattgccatggcaagcttggcacagcagttcatgcttgagctgaagactccacgatcatggcttctgctacttgttcctctcttcctcttgctcgtgcgctactcgctgtccacgttcagtgccaagagagggaggccgaggcagcagcaggcatcagacaaccaccacccaccgccttccccgccggcgctgcccgtcctcgggcacctccacctcgtgggctcgctcccgcacgtctccctcaggaacctcgccagggagcacggctacgatgacctcatgctgctccgcctcggcgccatgccggtcgtcgtcgtgtcgtcgccgagggccgccgaggcggtgctgcgcacgcacgacctcaccttcgcgtcccggcccggctcccctgtctg

SEQ ID NO: 27353 - protein, 133 aa, Panicum virgatum
  misc_feature: Ceres CLONE 1876387
  misc_feature: SWISSPROT Homolog: EC 1.14.13.68 4-hydroxyphenylacetaldehyde oxime monooxygenase
MSIAMASLAQQFMLELKTPRSWLLLLVPLFLLLVRYSLSTFSAKRGRPRQQQASDNHHPPPSPPALPVLGHLHLVGSLPHVSLRNLAREHGYDDLMLLRLGAMPVVVVSSPRAAEAVLRTHDLTFASRPGSPV

SEQ ID NO: 27354 - DNA, 508 bp, Panicum virgatum
  misc_feature: Ceres CLONE 1876405
  misc_feature: Encodes the peptide sequence at SEQ ID NO. 27355
acggttgcacagccagagcccgagcacgacgcgactgcttttgcttcatcagtagcgagcctacgcgttgccgcccatcactttcttggtcgtgtctcatcgatcgggctgagctagctcccggcagcggaagggcaggaacaggacgaggatgagctcggtgtgcgcgaggcccgcgggcgcggggtgctacttcgtccgcgggcccacgggcccgcggcggacgcgggagcgggtggccgcggcggcggcggcggcggtggccgcgccggcgtcgagggcggcgacgatgtacgaggtgctggcggaggaggacacggcgaggcccgccgacatcctcgccgcgtaccggcgcgaaggacggccgtggcacccggacccgtgccccggcggcgccgaccgcttcatggccgcgcgccaggcccaccaggtgccgtcccacccggagcgcacgcgcgcctacgacatccccctccgctgcggccggttcggtcccgccggcgactct

SEQ ID NO: 27355 - protein, 118 aa, Panicum virgatum
  misc_feature: Ceres CLONE 1876405
  misc_feature (46)..(105): Pfam Name: DnaJ Pfam Description: DnaJ domain
MSSVCARPAGAGCYFVRGPTGPRRTRERVAAAAAAAVAAPASRAATMYEVLAEEDTARPADILAAYRREGRPWHPDPCPGGADRFMAARQAHQVPSHPERTRAYDIPLRCGRFGPAGD

SEQ ID NO: 27356 - DNA, 1825 bp, Panicum virgatum
  misc_feature: Ceres CLONE 1876412
  misc_feature: Encodes the peptide sequence at SEQ ID NO. 27357
accactgcgttagctagtttcttccgatcctatcgagtggcacgcagctgcgagggagggtcgagaaatggccggcggcgaggagggctcgccagctgcggcggtggcgctgctgttgccgccggcgcgggaggagaggagcagcagcaggaggcggcggtgccgcgaggggtgccccgggtgccggcaggaggaggcgagcaaggcgagggccggcgtcccctacctcgacttcttctacatctgggtcgtctgcctcgccgccgctctgccaatccagtcattgttcccgtatctgtacttcatgatcagggacttgaaaatcgcaaaagaagagcaagacattgggttctatgctggttttgttggggcaacttatttccttggaagaaccatcagtgctgtgccatggggcatgtttgctgataagtatggaaggaagccatgcattgtgattagcatcctcgcagtggttgtgtttaacacgctttttggccttagcacaacttactggatggcaattgtaactagggggttacttggattgctctgtggcatactggggccaatcaaggcctatgcttcagaagtctgcaggaaagagcaccaagctctaggaatatctcttgttacatcgtcacgagcgatcgctcttgttattggacctgctatcggaggctttcttgcacagccagcaaaaaagtaccccaatcttttctctgaagagtccatatttgggaggtttccatacttccttccttgctttgtcatatcagtactagcagctggatcttgtattgcatgcatttggcttccggaaacactgcactttcataatgatgacaaggtagaagctattgatgaactagaggcacaagctggtgactccgacttagatgctcaaaaggctaaagaatctagaggtgaatcaacaaagaatctgctaaagaattggcaattgatgtcagcagtaatcctgtactgtatcttttctctgcatgacacagcttatcttgagatattttcactttgggcagttagcagcagaaaatttcagggcctgagtttgacatcccaggatgttggaactgttctggccgtctcaggttttggtgttcttgtatatcaacttgcaatttatcctttccttgccaagtattttggaccaatcaagccatttcgtcctgcggcggtcttatccatacttctccttgcaacatatcccttcatgactaacctacatgggccggagctcaagatacttatcaacatagcatcgcttttgaagaacatgtttgctgctaccattactatcgcgtgcaacattctgcaaaacactgcagtgacacaagaacagagaggtgttgcaaatggcatctctgttactctgatgtcaatgttcaaagctgtcgctccagcagcagcagggattctgttttcatgggctcagaaacacataagcgggctgttcttaccaggtgatcagatcctgttcctgatgctaaacatggtgtccgtaattggtctagttctgacattcaagccatttttgtccctgccaaatgcgatgagcatgtgagtcgttcgtaaccctgtgtatatgaagtttgttagttgtgagttacattgggtgcactgttagattacagtcgtcggttttgaactgcaagagttcatgtattgtaatggttcatatttttcgccttatgtttagttaagtaatcagatgcgaagggctgtgaatttttgcatagaaattgaaggaccgaatgcttcattgatatcataaaatggaaatgagatactgcttgccatcttttgtgcc

SEQ ID NO: 27357 - protein, 503 aa, Panicum virgatum
  misc_feature: Ceres CLONE 1876412
  misc_feature (59)..(450): Pfam Name: MFS_1 Pfam Description: Major Facilitator Superfamily
  misc_feature: Functional homolog of the protein sequence given in SEQ ID NO 51012
  misc_feature: Useful for making plants with modulated flowering time
MAGGEEGSPAAAVALLLPPAREERSSSRRRRCREGCPGCRQEEASKARAGVPYLDFFYIWVVCLAAALPIQSLFPYLYFMIRDLKIAKEEQDIGFYAGFVGATYFLGRTISAVPWGMFADKYGRKPCIVISILAVVVFNTLFGLSTTYWMAIVTRGLLGLLCGILGPIKAYASEVCRKEHQALGISLVTSSRAIALVIGPAIGGFLAQPAKKYPNLFSEESIFGRFPYFLPCFVISVLAAGSCIACIWLPETLHFHNDDKVEAIDELEAQAGDSDLDAQKAKESRGESTKNLLKNWQLMSAVILYCIFSLHDTAYLEIFSLWAVSSRKFQGLSLTSQDVGTVLAVSGFGVLVYQLAIYPFLAKYFGPIKPFRPAAVLSILLLATYPFMTNLHGPELKILINIASLLKNMFAATITIACNILQNTAVTQEQRGVANGISVTLMSMFKAVAPAAAGILFSWAQKHISGLFLPGDQILFLMLNMVSVIGLVLTFKPFLSLPNAMSM

SEQ ID NO: 27358 - DNA, 2042 bp, Panicum virgatum
  misc_feature: Ceres CLONE 1876415
  misc_feature: Encodes the peptide sequence at SEQ ID NO. 27359
gtgttatatcctcgagccccccatcctgccgctgcgctccactctcctccgcttgaatccagtggctctgctttgttcgtcctcgtcgtctctctcgcgagcggggcaggcacttcggacagggtaagcggcatcgcgaatctgctccaattccctcgtcctttttctcttctgctttgctgggatttgagctcttcctcgcgctttcccttgcctttattgggatggaaccctacacatcgtgaactcctttttttagtgcccagtagcgacgctttcgccggagctccggtgagttcttggggtatttcagctccagtcgcgcgagcagctgcgtggctgtgttgaatcgagtaggggtaggagggatcagcagctcgtccatcaccgttcaagaagttcgtggagctggtgtgcagctccggtttgtttggctcggcgcactggtggttggaggctcgggaggaccggagaagtagattgtgttctcgccatggagcagcagaagggaggagcggtttctgcgccggcggccgccgccgccaacgggaccggggagctgatcgggtacgtcgacgtgcacgtgcggagcgcgcgggacatccagaacatctgcatctaccacaagcaggacgtgtacgcgcgggtgtctctgccgggggacggcgcgccggtggcgtccacgcaggtggttaacggcggcggccgcaacccggtgttcgaccagtcgctgcgcctcggcgtgcgcgcgggggacgtcgacgccgcgctccgctgcgaggtctggatgctcagccggatcaagaactacctggaggaccagctgctggggttcgcgctcgtgccgctcccggaggtcatcgccgccgacggcggcacgctcgcccgggagttcccgctcaccaccagcgacctcttccagacgccctcggggttcctccagctcgagctgtcctacatcggggtcgtgccggaggtcgtgcccatctctccgacgcccaagccggcgctggccgacccggaggaggtgccggggactaacgccggcgccaccgctgggagcgggaacgagtacgggaagatcgagttccccgacctgaatctcgtggaggagaaccagatcatggtgtccgagtacacggggctgccgtgcgcggccgtggaggcacagagctccgagagcctgctgacctcggagcacgaggacggcgccacgaccctaagccacgaagccggcgtgcgcctcgtggagagcttctcgacggaccagagcgctgccgactcggtgggcgcctcccggagcgatacgccggtcagcagcgtatccaccacggagtcccccgcctccgcggcggtcccggccaccccgcagtccaattccagctcggagccgtccgggaacgcccactcgtcggctgggcacaaggtgaaggcggcgcccgaggccgccgacgcggaggtcgactcgtcccgcaccgtccaggagagccccgcggcgaactcgcccggcgccgcgtcggaggccgcggtggacaagccggtgatcagcgtcaacatcgagcaggaggtgaaggtggacgggaaccagatcatggacatgtacataaagagcatgcagcagttcacggactccctggccaagatgaagctcccggccttggacctggacaacggcagcagcgagaagagcagccccgcggccgccgcctccgaggcagattacagcggcgccgactcgagtgcggccaagaagctgacggccggcgggcagcaggagaagccgtcgcccaaggtgttctacggcagccgggcgttcttctgatctccaccggatcaccacaagcgctggccagtggccacaaccaacaacgaagcaaagagatggcatttgcagtcgtctcaactgaaaatcttactagcgcagaggaataacaccaccttctcatgctcttgttctaggtttgtcagatcgggaattagttgctctgcctttaatgtatcagtcagtacttgatgaaaaatggtttggtttctctgtcttt

SEQ ID NO: 27359 - protein, 442 aa, Panicum virgatum
  misc_feature: Ceres CLONE 1876415
  misc_feature (27)..(116): Pfam Name: C2 Pfam Description: C2 domain
MEQQKGGAVSAPAAAAANGTGELIGYVDVHVRSARDIQNICIYHKQDVYARVSLPGDGAPVASTQVVNGGGRNPVFDQSLRLGVRAGDVDAALRCEVWMLSRIKNYLEDQLLGFALVPLPEVIAADGGTLAREFPLTTSDLFQTPSGFLQLELSYIGVVPEVVPISPTPKPALADPEEVPGTNAGATAGSGNEYGKIEFPDLNLVEENQIMVSEYTGLPCAAVEAQSSESLLTSEHEDGATTLSHEAGVRLVESFSTDQSAADSVGASRSDTPVSSVSTTESPASAAVPATPQSNSSSEPSGNAHSSAGHKVKAAPEAADAEVDSSRTVQESPAANSPGAASEAAVDKPVISVNIEQEVKVDGNQIMDMYIKSMQQFTDSLAKMKLPALDLDNGSSEKSSPAAAASEADYSGADSSAAKKLTAGGQQEKPSPKVFYGSRAFF

SEQ ID NO: 27360 - DNA, 1819 bp, Panicum virgatum
  misc_feature: Ceres CLONE 1876438
  misc_feature: Encodes the peptide sequence at SEQ ID NO. 27361
acccacaccctttgtcatcatcttctccccttcccctgcgcggccacccccaccccaccgctcggccgtgtttctcgcgtctcgtctcgctcccgcattcgcatcgcccccgcctcccatcgttcgttcaccggagcccagcgctcgtcggactccgccgcccgcgattccccctgcccctggcttttaatgggctttccctcccaccgacatggccggcgatccccacacccgcgccgccggtgaccgccccgcctccttcgccgcccccgctgcaggaggcggaccccgacccagacccagcctcggcccctccagcctcctgctccacctgctcctcctccactcgctcttatagccccatcaggcgccccgcgcgcgcccgcgtatggccgccgtcttcttccaccacgtcgtcggcgacctcaccgtcggcaagccggaggtcgcggagctccacgacaccgacgcgctcgatgacgccgcgcgcgccatcgcttccagccccgagggcgccgtgccggtctggcgcccgcgggccacgcccgacgacccgccgtccggggccaggttcatcgggatgatctccgcgctcgacatcgccgcgttcgtggccgccgcagggatcggggaccgggccatgcgagcggtcgtcggcgaggtcgttcagcccaatcccgagctgctcagggagatcgatccgggtaccaggctgattgatgcactggagctcatgaggcatggagtgaagcgcttccttgttcgcaagagtgggagctggaaaggcattaccaagaggttttcagtgctttataatggcaagtggctgaagaatatggaatcaacttctccaaatgcagccagcagcagcagacagctgtcctcatctatgggtttagcagacaagttttgctgcctttcaagggaagatgttctccggtttctaattggatgccttggagctcttgcgcccatcccactgactcagatatcttccctcggagtcatcaatccacaatattgttatgtagaagcatctgcgcctgccatggaagcaattgagaagatcccgcaggacccatgcgccgttgctgtagtggaaacgatgccagatggaactcgtaagatactaggcgacatatctacttacaaactgtggaaatgtgactatgtttcagcagcatgggcgctggcaaacctgtcagccgggcagtttgtcattggcgctgatgagaatgcagcgatgtccatgtctgtcctcccggagcctcctgtcagcccatcatcaccagtggaagaaatcagtcctgggcgctcacccagggcgaagaagttcagcagcaggagcatcggtttccaggcgaaccagatgtcggcgtggcggatgcggagctcgttccaccggggcaggagcacgccactgacctgcaagagcacgagcaccctcgcggcggtcatggcacagatgctgtctcaccgggccacgcacgtttgggtgacggatgcagagtcggaggaggacggcgttctcgtcggcgtggtgggctataccgatatcttcaatgccgccacccggagcacctgctccagcccgacaacttcttgatggcttgatgcaccacaccgtaatgtacagtactgtgcttggttgattggttggtggtcgcccctgggtgcacgctttgcaccgaactgtaaactgcacttggttagtctgttggttcgtttggagagttttagatattcttggtctgcatagcgcaggacttggtggtatattgttgcattcgttggacggttcaaataaggattgggactt

SEQ ID NO: 27361 - protein, 405 aa, Panicum virgatum
  misc_feature: Ceres CLONE 1876438
  misc_feature (14)..(145): Pfam Name: CBS Pfam Description: CBS domain pair
  misc_feature (205)..(395): Pfam Name: CBS Pfam Description: CBS domain pair
MAAVFFHHVVGDLTVGKPEVAELHDTDALDDAARAIASSPEGAVPVWRPRATPDDPPSGARFIGMISALDIAAFVAAAGIGDRAMRAVVGEVVQPNPELLREIDPGTRLIDALELMRHGVKRFLVRKSGSWKGITKRFSVLYNGKWLKNMESTSPNAASSSRQLSSSMGLADKFCCLSREDVLRFLIGCLGALAPIPLTQISSLGVINPQYCYVEASAPAMEAIEKIPQDPCAVAVVETMPDGTRKILGDISTYKLWKCDYVSAAWALANLSAGQFVIGADENAAMSMSVLPEPPVSPSSPVEEISPGRSPRAKKFSSRSIGFQANQMSAWRMRSSFHRGRSTPLTCKSTSTLAAVMAQMLSHRATHVWVTDAESEEDGVLVGVVGYTDIFNAATRSTCSSPTTS

SEQ ID NO: 27362 - DNA, 696 bp, Panicum virgatum
  misc_feature: Ceres CLONE 1876457
  misc_feature: Encodes the peptide sequence at SEQ ID NO. 27363
aaggaaatagcggcgagcaaaagcgggcggaaaagtaaagagagccaggctcgcgccgttcccccaccgcgccacccacccaccagttggaaatcctgaatccgatccctctctttctctctcgagaggagtcgagcgaggctctcggttccgatccggcaagcgggtatggcgacgtcgttcgaccgctgggagaaggaccccttcttcctcgccgcggaggaggtccaggaatccgccgaccggatggaatcggtgtacaggatatgggtacaggagaggagcgggggcgatccggaggcggcgggcgttaccggaggagggcctacggccgccgagcttcgccgcgagctgcacacggcgctcggcaccgccaagtggcagcttgatgaactggagcgtgcaatcagatcgaacgaccgggttgtttcggcaggaaaagatacaagagctaggcatgatgacttcgttacagcgattggctatcgaatattagaggttgagaacaacttgaaagaatccaatgttgcagaggggagggcgccgttgagctgggttcatttggatgaggatgagcgcaatgaccttgcggctttcctatctgcaggcccttttcaacagaaagataaagtggtcacaacttcggctggtgatattgaagtgggcagcaacacaacaaggatgaaaaatgatata

SEQ ID NO: 27363 - protein, 175 aa, Panicum virgatum
  misc_feature: Ceres CLONE 1876457
  misc_feature (11)..(112): Pfam Name: Syntaxin-6_N Pfam Description: Syntaxin 6, N-terminal
MATSFDRWEKDPFFLAAEEVQESADRMESVYRIWVQERSGGDPEAAGVTGGGPTAAELRRELHTALGTAKWQLDELERAIRSNDRVVSAGKDTRARHDDFVTAIGYRILEVENNLKESNVAEGRAPLSWVHLDEDERNDLAAFLSAGPFQQKDKVVTTSAGDIEVGSNTTRMKND

SEQ ID NO: 27364 - DNA, 696 bp, Panicum virgatum
  misc_feature: Ceres CLONE 1876457-R
atttctaccctcataagatcagcagcttgtatggtacattcattggctgttaagtaacttatggccaataggagcttgaggcatgcacatgtgggcatttagcaaccatggcagactgttatgatgatcaaggttgaaaaccatgtagcgtgctctggttggagcaacttatcttgtcacatcttcagggcagcctgtttcatccgtggaaaaacctctcctgggcagtcggcttcatccttggatatgcactgctcgatgcctggcatgcttgatgatgcacctccacaactcaatcctcctgggtgatcagttggcgcctatgtaatggtccgatataaattactggtccactggactggtgatcatgctgctagcaacagaattgcaggtcttgcttcatgcatcaatgccactgctttactgcctgacttggaagggtggtgattttttgtgggagttgccatctgaactgtagtttgtttcatagggcataggttctgatgagaaatgtaaaagatacccaaaataactgtatggtactgcttgtattttgcccccttacaacagaattaggaacctggcagctcccagcacctattcagcctttgcagagttgtaataaggtgccagcttgttttgatcttgtagaaactgcacgatactgctaaattcagggaagggtgacaattttac

SEQ ID NO: 27365 - DNA, 426 bp, Panicum virgatum
  misc_feature: Ceres CLONE 1876459
  misc_feature: Encodes the peptide sequence at SEQ ID NO. 27366
ctgaactacgcacccaaccagcaaaggcacgagcaccaccgccggccgggaagcaagctcaaaccctaaccgccggcgacgccagcacgatggcccgctacgaccgcgcgatcacagtcttctcccccgacggccacctcttccaggtcgagtacgccctcgaggccgtccgcaaggggaacgccgccgtcggcgtccgcggcgccgacaccgtcgtcctcggcgtcgagaagaagtccacccccaagctccaggactccaggtccgtgcgcaagatcgccagcctggacacccacatcgcgctggcttgcgcggggctcaaggcggacgcgcgcgtgctcatcaaccgcgcgcgggtcgagtgccagagccaccggctcaccgtcgaggaccccgtcaccgtcgagtaaatataccccccccttt

SEQ ID NO: 27366 - protein, 106 aa, Panicum virgatum
  misc_feature: Ceres CLONE 1876459
  misc_feature: SWISSPROT Homolog: EC 3.4.25.1 Proteasome endopeptidase complex
MARYDRAITVFSPDGHLFQVEYALEAVRKGNAAVGVRGADTVVLGVEKKSTPKLQDSRSVRKIASLDTHIALACAGLKADARVLINRARVECQSHRLTVEDPVTVE

SEQ ID NO: 27367 - DNA, 966 bp, Panicum virgatum
  misc_feature: Ceres CLONE 1876470
  misc_feature: Encodes the peptide sequence at SEQ ID NO. 27368
agaccgccagctacgctagctgctcgtgtggttggtccgtcacagcaatccaatcgagtcgtcggtaacaaagaaggcagccagcatccatggcgaagcgcgttgccaccgtgcttgccgttgctgccgtcctgatgatggcggtgcagccatcggaggcggcggctgaggacgcggcgctccggttccctggccgggcgggcagcagaccgcgcaaccccgttttcccgggctaccccagagccaggccgtcgccgccaacgtccggttccccggcaccacccacgccgtcgacacctgtgtcgccgccttgccccagaccggtggtgccggagatgccgcttgtgccgggcttccccgggctgccgggcagcgttggtggctctactccatcgtcgtcaccgaccgactgcgtgacgccgctggcggggctgatgacctgcgggacgtttctgactgggagcgagtcggagaccccctcgccgcagagcgagtgttgcagcgggatcggggccttcctgaacgcctcgtcggcggcgggggacggcgaccggaccctgcggtgcctgtgcccggtgatcctgggcgacgtcaacaagatgctgcccaagcctgtggatcccgttcggatgatgtatctgcccatcgcctgcggcgtagtgcttccaccacaggtcctctacatctgcttcactggtgggcagcaaaccccgccgctcgtcggccgcattcctgacgtctgggagaagccgtcgtctgcagccttgtcaccttgacgcatttcaacaggaacgtacggaagccaccatgattcaggcagggacatctgaatgcttcaagtttatctgaaatgtgctgtgcctgtacgcactttagaaaccaactaccatacatcatgtccgacgatgtaagagttacaatgcatgtccttaattttataagggaagaatatatatattaattact

SEQ ID NO: 27368 - protein, 228 aa, Panicum virgatum
  misc_feature: Ceres CLONE 1876470
  misc_feature (108)..(200): Pfam Name: Tryp_alpha_amyl Pfam Description: Protease inhibitor/seed storage/LTP family
MAKRVATVLAVAAVLMMAVQPSEAAAEDAALRFPGRAGSRPRNPVFPGYPRARPSPPTSGSPAPPTPSTPVSPPCPRPVVPEMPLVPGFPGLPGSVGGSTPSSSPTDCVTPLAGLMTCGTFLTGSESETPSPQSECCSGIGAFLNASSAAGDGDRTLRCLCPVILGDVNKMLPKPVDPVRMMYLPIACGVVLPPQVLYICFTGGQQTPPLVGRIPDVWEKPSSAALSP

SEQ ID NO: 27369 - DNA, 436 bp, Panicum virgatum
  misc_feature: Ceres CLONE 1876494
  misc_feature: Encodes the peptide sequence at SEQ ID NO. 27370
gcagatcgatcgagcacccccaacttgcacacaatcaccatccgttctagtagtaccagacatatcgacctccttcatcgcagctccgtggacgccaccggcggcgacaacaacacctcgcggccggaggtggtgggcctgccggcggaggaggccaataaaatcctcctccaggacatgcccgactcccacctcctcctcctgcccgccggctcgccggtgaccttggactggaggtccaaccgcgtccgcgtcttcttcgacaccgtcgctcagacgccgacggagggctgaatgataaacgtaccgcctgcgtgctggatcaccgctgctagctgacgcctacgcccttgatgttccttcctgattgcccgtactggtttaccttttagctagtgcactagacaagggaagatctgcagatcacatctttgaa

SEQ ID NO: 27370 - protein, 97 aa, Panicum virgatum
  misc_feature: Ceres CLONE 1876494
  misc_feature (38)..(97): Pfam Name: potato_inhibit Pfam Description: Potato inhibitor I family
ADRSSTPNLHTITIRSSSTRHIDLLHRSSVDATGGDNNTSRPEVVGLPAEEANKILLQDMPDSHLLLLPAGSPVTLDWRSNRVRVFFDTVAQTPTEG

SEQ ID NO: 27371 - DNA, 1488 bp, Panicum virgatum
  misc_feature: Ceres CLONE 1876495
  misc_feature: Encodes the peptide sequence at SEQ ID NO. 27372
atcttattcctcctgctcaaggagggggctagtatcctctagttaccgctagtaaattactactgtttactgctaacctaattacccctcctcacgcggaggcaaagcaccctctgcttcgccaccttcgctgctcctgcctcgctccctcctcttctcttcatctcaaacttcgtcacacaagatgacggtgactccggtcatcacggtgagcgacgggaggctggcggtgcgcggccgcacggtgctcaccggcgtgccggacaacgtgtcggcggcgcacgcggccggggccgggctcgtcgacggggccttcgtcggcgcccacgccggcgaggccaagagccaccacgtcttcaccttcggcacgctccgggactgccggttcctgtgcctgttccggttcaagctgtggtggatgacgcagcggatgggcgactgcggcggcgacgtcccgctcgagacacagttcatgctcgtcgaggtgcccgcctccgccggcgacggagacgacgccgacgccggcccgatgtacctggtgatgctgccgctgctggaggggccgttccgggcggcgcttcaagggaacgaccgcgacgagctgcagatctgcatcgagagcggcgacaaggcggtgcagaccgaccagggcgcgcacatggtgtacctccacgccggcgacagccccttcgacgccatcgccgccgccgtccgggcggtggagaagcacctgcagacgttccaccaccgggagaggaagaagctgccgtcgttcctcgactggttcggctggtgcacctgggacgccttctacaccgacgtcaccgccgacggcgtcaagcgcggcctccagagcctggccgagggcggcgcgccgccgcggttcctcatcatcgacgacggctggcagcagatcgccgccgacgaaaagcccgaccccaacgtcgccgtccaggagggcgcgcagttcgcgagcaggctgacggggatcaaggagaacaccaagttccaggccaagcccaccactgaccacggcggcgacggcgaggcggcggcgggcgggctgaagcagctggtccgggagaccaaggaggcccacggcgtgaagcaggtgtacgtgtggcacgccatggctgggtactggggcggcgtggggatcgaccgctacgagccgtcgccggcgtacccggtgcagtcgccgggggtcaccggcaaccagccggacatcgtgatggactcgctgtccgtcctcgggctcgggctcgtgcccccgcgccgcgcccgcgacttctacggcgagctccacgcgtacctcgcctcctgcggcgtcgacggcgtcaaggtggacgtgcagaacatcatcgagacggtcggcgccggccacggcggccgcgtcgcgatcacccgcgcctaccaccgcgcgctcgaggcctccgtggcgcggagcttccccgacaacggctgcatctcctgcatgtgccacaacac

SEQ ID NO: 27372 - protein, 434 aa, Panicum virgatum
  misc_feature: Ceres CLONE 1876495
  misc_feature (7)..(434): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
  misc_feature: Functional homolog of the protein sequence given in SEQ ID NO 50752
  misc_feature: Useful for making plants with altered carbohydrate content
MTVTPVITVSDGRLAVRGRTVLTGVPDNVSAAHAAGAGLVDGAFVGAHAGEAKSHHVFTFGTLRDCRFLCLFRFKLWWMTQRMGDCGGDVPLETQFMLVEVPASAGDGDDADAGPMYLVMLPLLEGPFRAALQGNDRDELQICIESGDKAVQTDQGAHMVYLHAGDSPFDAIAAAVRAVEKHLQTFHHRERKKLPSFLDWFGWCTWDAFYTDVTADGVKRGLQSLAEGGAPPRFLIIDDGWQQIAADEKPDPNVAVQEGAQFASRLTGIKENTKFQAKPTTDHGGDGEAAAGGLKQLVRETKEAHGVKQVYVWHAMAGYWGGVGIDRYEPSPAYPVQSPGVTGNQPDIVMDSLSVLGLGLVPPRRARDFYGELHAYLASCGVDGVKVDVQNIIETVGAGHGGRVAITRAYHRALEASVARSFPDNGCISCMCHN

SEQ ID NO: 27373 - DNA, 637 bp, Panicum virgatum
  misc_feature: Ceres CLONE 1876495-R
cggcgcggcgctgccggtgacgctgggcccgctggagtacgaggtgttccacgtctgcccgctccgccgggccgccgccgcggcgggcgccgcgttcgcgcccgtcgggctgctcgacatgttcaacgccggcggcgccgtcgaggactgcgcggtgggagcggccggcggcggcgcggcggccgtggcgaggatgagggtgcgcgggtgcggccggttcggcgcctactgctcgcggcggccggcgaggtgcgcgctggacgcggcggaggtggagttcggctacgacgccgacacggggctcatcaccgtcgacctgcccgtgccggagaaggagctgtaccggtggacgctggagatcacggtcgtgtagaccaagacggtggcgccggatgctcgtcgggtctttgcggctgggccattctcagccgtcgccattggtgatgcatgtccacgggagattgggggagggattagggtggttgtgatgtgccttgttgtatgatcatcagtgtgggggagacgggagagttgtatgctttgctatgccactgtggtgttatgttgtacggtgtaccctgtgatatgaacgttgtattaaatatatactgggtataataaaggatggtgctccttc

SEQ ID NO: 27374 - DNA, 1794 bp, Panicum virgatum
  misc_feature: Ceres CLONE 1876522
  misc_feature: Encodes the peptide sequence at SEQ ID NO. 27375
acgcgcatgcgatcgagccttggtagtagctaagccttgcccttgcatgcacactcagccatgggcgccctccggagcttcctccccgcctacccggagctcctcctggccgcgctgtgcttcctctccctcgccgccctccgcctcgcggtgcgcgcgcggaggcagcgcgcgccggtgagctggcccgtggtgggcatgctccccttcgtgctcggcaacctcggccgcctcttcgacgccaccaccgacgcgctccgcgagtgcgggggcacgttcgtgttccgcgggccgtggctggcgcgcgcggacttcctggtgacgtgcgacccggcggcggtgcagcactgcctggcgtccaaccacggcggctacgacaagggccgggacttcgcggagatgttcgacgtcgtcggcgacgggctgctggtcgcggacgccgcgtcgtgggcgcgccagcggcacgtcgccgccaccgtcttcggcaacccctcgttccgctccttcgtgctgtccaccatggcgcggcagacggcgcggctgctggtgccgttcctcgaccacgccgccgccgccgcctcgccggatgggttcgagatcgaggacgtgttcatgcggtactcgctcgacgtgtcctacgcctccgcgttcgccgccgacctggatacgctgtccgtcgccgctgccgccgcctcggcgccggtcccgctggttgcccaggcgactagggtggccagcgaggccgcgctgttccggcacatcgtgccggcttggtggtggaggctgatgaggtggctcaacgtcggcaccgagaggaggctggccgaggcaaaggcggtcctcgacgagttcgtctaccgcgagatcgccaaccgcaagtcccagtccctcgccgtcgcctccggaaggcgaggaggcggcagcgacctcctgtccctgtacatggcgtggccgagggaccccggcgtgaccgaacggcagcgggaccagttcctccgcgactctgccgtcggttacatgttcgcggccaaggacctcatcgtcgccgcgctcacctggttcttctacatcctctgcacacacccacacgtcgaggccaagatcctccaggagatcaggtccctgcgccccagcaccaccgtcacggccaccggcggcggcgagcacgccgtgttcgactccgacgtgctccagcccgcgtcctacctccacgccgcggtcctcgagacgctgcggctgttcccgccggcgccgttcgaggagaaagaggcggttgccgacgacgtgctgccggacggcaccaaggtggccaagggcaccagggtcatcttctgcatctacgccatgggcaggatagaggagatatggggcagcgactgccatgagttccggccggagcggtggctctccgatattggccgagtccggcacgagccgagccacaagttcgtcgtcttcaactgcggccccaggagctgcctcggcaagaacctgggactcagcaacatcaagatcgccgctgcggcaatcttatacaactttcaggtggagcttgtcgatggtcatgccgtcgagccacagaactcagtggtactccacaccaagaacgggatgagggttaggatcaagagaagggaggcagcatgacgcattgtggtgccacgttgcatctattaaaactccaaacaagaaaagaaacataaaaaagagaagcgaagtgatagagagaataaaaaaaattggagcacacattccagattggtctgcccatgtaatttcagcccggttggatac

SEQ ID NO: 27375 - protein, 528 aa, Panicum virgatum
  misc_feature: Ceres CLONE 1876522
  misc_feature (37)..(521): Pfam Name: p450 Pfam Description: Cytochrome P450
  misc_feature: SWISSPROT Homolog: EC 1.14.15.3 Alkane 1-monooxygenase
MGALRSFLPAYPELLLAALCFLSLAALRLAVRARRQRAPVSWPVVGMLPFVLGNLGRLFDATTDALRECGGTFVFRGPWLARADFLVTCDPAAVQHCLASNHGGYDKGRDFAEMFDVVGDGLLVADAASWARQRHVAATVFGNPSFRSFVLSTMARQTARLLVPFLDHAAAAASPDGFEIEDVFMRYSLDVSYASAFAADLDTLSVAAAAASAPVPLVAQATRVASEAALFRHIVPAWWWRLMRWLNVGTERRLAEAKAVLDEFVYREIANRKSQSLAVASGRRGGGSDLLSLYMAWPRDPGVTERQRDQFLRDSAVGYMFAAKDLIVAALTWFFYILCTHPHVEAKILQEIRSLRPSTTVTATGGGEHAVFDSDVLQPASYLHAAVLETLRLFPPAPFEEKEAVADDVLPDGTKVAKGTRVIFCIYAMGRIEEIWGSDCHEFRPERWLSDIGRVRHEPSHKFVVFNCGPRSCLGKNLGLSNIKIAAAAILYNFQVELVDGHAVEPQNSVVLHTKNGMRVRIKRREAA

SEQ ID NO: 27376 - DNA, 645 bp, Panicum virgatum
  misc_feature: Ceres CLONE 1876544
  misc_feature: Encodes the peptide sequence at SEQ ID NO. 27377
aagatggatatgtatcacttgacaactttcggatggctctgacaagatgtttgactgatgctatgagggaatcaagggttcttgagtttttgcatgcgttggaaccacttgcgtacagaaggatggacttcgaagaattctgtgctgcagcaataagcccttaccagcttgaggctttggaaaggtgggaagaaattgcaggaacagcttttcagcactttgaacaagagggcaaccgagttatatcggttgaggagttggcacaggaactaaatctcgcaccgactcattattccattgtgcaagactggatcagaaagtcagatggcaagctaaactttcttgggtttacaaaatttttgcatggtgtcaccatacggggctcaaatacaagacgacactaaatggttggaaattgtattcgattctaatttaaatcctatcattacattacatggccctgattgttgtgaccccttccctcttgtcctgcctcttcttctgatcaatgatcattcttcctcctgtttgttatcttgccggttgttgtcatcatagcttttgtagagtacatgtaaagatccttgtaatgaaggcgaaatcatatggtttgctcaagaaatagtgtcgtgttcctttttgctc

SEQ ID NO: 27377 - protein, 133 aa, Panicum virgatum
  misc_feature: Ceres CLONE 1876544
  misc_feature: SWISSPROT Homolog: EC 2.7.11.1 Non-specific serine/threonine protein kinase
DGYVSLDNFRMALTRCLTDAMRESRVLEFLHALEPLAYRRMDFEEFCAAAISPYQLEALERWEEIAGTAFQHFEQEGNRVISVEELAQELNLAPTHYSIVQDWIRKSDGKLNFLGFTKFLHGVTIRGSNTRRH

SEQ ID NO: 27378 - DNA, 680 bp, Panicum virgatum
  misc_feature: Ceres CLONE 1876567
  misc_feature: Encodes the peptide sequence at SEQ ID NO. 27379
acccaccacttgccggccaccatcaccaatccccccagccagcgcggatcgagcgagcccgccgtcgccgtcgccgaactccgtcatggccgccgcgctgagggctgcgccgccgtccccggccaccgccaggcccgcggaaggcttcgccaaggcggaggcggcgtcgcgggtcgcggcaggcggcggcgtcggggcggccgggaagaggaaggcgcgcggcgtggcggtccgggcgtcgctgttctcgcccaagcccgcggcggccaaggacgcgcggccgtccaaggtgcaggagctctacgtgtacgagatcaacgagcgggaccgcgagagccccgcgtacctgcgcctcagcgccaagcagacggagaacgcgctgggcgacctcgtgcccttcaccaacaaggtgtacaacgggagcctggacaagcggctgggcatcaccgccggcatctgcgtgctgatccagcacgtccccgagcgcaacggcgaccggtacgaggccatctacagcgtctacttcggcgactacggccacatcacggtgcagggcccgtacctgacctacgaggagtcgttcctggccgtcacgggcggctccggcgtcttcgagggcgcctacggccaggtgaagctccaccagatcgtcttccccttcaagatcttttacacctttc

SEQ ID NO: 27379 - protein, 198 aa, Panicum virgatum
  misc_feature: Ceres CLONE 1876567
  misc_feature (62)..(198): Pfam Name: Allene_ox_cyc Pfam Description: Allene oxide cyclase
  misc_feature: SWISSPROT Homolog: EC 5.3.99.6 Allene-oxide cyclase
MAAALRAAPPSPATARPAEGFAKAEAASRVAAGGGVGAAGKRKARGVAVRASLFSPKPAAAKDARPSKVQELYVYEINERDRESPAYLRLSAKQTENALGDLVPFTNKVYNGSLDKRLGITAGICVLIQHVPERNGDRYEAIYSVYFGDYGHITVQGPYLTYEESFLAVTGGSGVFEGAYGQVKLHQIVFPFKIFYTF

SEQ ID NO: 27380 - DNA, 1564 bp, Panicum virgatum
  misc_feature: Ceres CLONE 1876574
  misc_feature: Encodes the peptide sequence at SEQ ID NO. 27381
acaccaccgaaatttgaaatccccaccccgaaccaggcaggcacgccgcccgttgtcctcaccgccgccgcatccatggagaagatctccgtcgccgtccgcttccgccctcccaacccagccgccgccgacccctcaaaaggcggcgaccgcgagtggcgcatcgacgacacccgcgtcaccctcgtccaccgcgccgccggccccgttcccggcgcacccttcgtcttcgaccacgtgttcgacaggaccgccaccaacgagcgggtctacggcacggtcgtccgggacctcatcggcgccgtcgtcgacggcttcaacgccaccgccttcgcctacgggcagaccagcagcggcaagacgttcaccatgaacggctccgacgccgaccctggcatcatcccgcgcgccgtccgcgacgtcttcgacaccgtgcgtcagacggacgaccgcgagttcctcgtcagggtgtcctacatggagatctacaatgaggagatcaacgacctcttgacacttgagggccggcggttgccgattaaagagaacctggagcgtggagtatatgtagctggtttgcgggaggagatcgtgaacagcgcagaacaagtgttggagctcctccagcttggagaagtgaacaggcattttggggagacaaacatgaacgcccggagtagtcggtcacacactattttcagaatggtcattgaaagcagtgctaagaatcagatagactctgaagatcctatccgtgtctctgttttgaatttggtggacttagctgggtcagaaagaaacaacaagaccggaactgaaggtgtgcgtttgaatgaggcagggcatattaacaagagcttgttgatgcttgggaatgtcatcaataagttaagtgagaatggaaagcaaagagggcacattccctatcgtgatagtaagttgactcgcattctccaacctgcacttggaggcaatgcaaaaacttctatcatctgcactgctgcaccagaagagatgcacattgacgaaactagaggaacccttaaatttgcaagtagagctaaatgtgtcagcaattgtgcccaagtaaatgagattctaacagatgctgctctgctgaagaggcaaaaacgagaaattgaagaactgcgtaaaaagctgcagggttcccattctgaagggttggagcaggttgtactaaaactacgcaatgatatgcacaagtctgagcttgagcgtgatcgtttggcaatggaacttgaagaggaaaggaagttacggatgaccctagagcaccatttgactgagcaacagaagctagagggcctcgataacaccagcatatcagcagaccagtttactgattcgacccagctagatgcactgaaaactccagattccaagtatacacctgatggatttgttgcacatcgctcacgctattcaaacgatgtcgagttcagcccattgcctgaaaatttggataatgttgccaatgatgatctatgggcgtgcctgaacaaaggttgtgttactgatcttgacatgctggagatgacacctg

SEQ ID NO: 27381 - protein, 496 aa, Panicum virgatum
  misc_feature: Ceres CLONE 1876574
  misc_feature (9)..(333): Pfam Name: Kinesin Pfam Description: Kinesin motor domain
MEKISVAVRFRPPNPAAADPSKGGDREWRIDDTRVTLVHRAAGPVPGAPFVFDHVFDRTATNERVYGTVVRDLIGAVVDGFNATAFAYGQTSSGKTFTMNGSDADPGIIPRAVRDVFDTVRQTDDREFLVRVSYMEIYNEEINDLLTLEGRRLPIKENLERGVYVAGLREEIVNSAEQVLELLQLGEVNRHFGETNMNARSSRSHTIFRMVIESSAKNQIDSEDPIRVSVLNLVDLAGSERNNKTGTEGVRLNEAGHINKSLLMLGNVINKLSENGKQRGHIPYRDSKLTRILQPALGGNAKTSIICTAAPEEMHIDETRGTLKFASRAKCVSNCAQVNEILTDAALLKRQKREIEELRKKLQGSHSEGLEQVVLKLRNDMHKSELERDRLAMELEEERKLRMTLEHHLTEQQKLEGLDNTSISADQFTDSTQLDALKTPDSKYTPDGFVAHRSRYSNDVEFSPLPENLDNVANDDLWACLNKGCVTDLDMLEMTP

SEQ ID NO: 27382 - DNA, 199 bp, Panicum virgatum
  misc_feature: Ceres CLONE 1876574-R
gggggaaggacgccgagcgccacgccaccgagaagcaggaggggcggggagcagggcgggagaggcagaagagggaggagggaagcaggacacccgggggaaagccgggcccccccgcagcgggaagggcagcccacgccgcggcacaccaagcccaaggccacccgggagaacggcaaggccgcgcacgccgcaaccc

SEQ ID NO: 27383 - DNA, 709 bp, Panicum virgatum
  misc_feature: Ceres CLONE 1876576
  misc_feature: Encodes the peptide sequence at SEQ ID NO. 27384
gcgcacgtgtccgccacacttccaaaggaataccccctcccccctctctctttcccaccgccgccgctacgctttcggctccaccaccccttcctcctcggagccctcccctcggcggcggcggaagaagagatggcggagcggctgacccgtatcgcgatcgtcagcgaggacaagtgcaagcccaagaagtgccgccaggagtgcaagaagagctgccccgtcgtcaagaccgggaagctttgcattgaagtgactccggcatcgaaactcgctttcatttccgaggagctgtgcattggttgtggtatttgtgttaagaaatgtccatttgacgccattgaaatcattaacctcccaaaagatttggaaaaggataccactcaccgatatggacccaacaccttcaagttgcacaggttacctgtcccgaggcctggtcaggttttgggccttgttggcacgaatggaattggaaagtcaacagcacttaaagttttggctggcaagctgaaacctaatttgggacgcttcaaaaacccacctgactggcaggaaatccttacatacttccgtgggtctgaacttcagaactacttcacacgcatattggaagataacctcaaggcaatcattaaacctcagtatgtcgaccacattccaaaagctgttcaaggaaatgttgggcaagtacttgaacagaaggatg

SEQ ID NO: 27384 - protein, 192 aa, Panicum virgatum
  misc_feature: Ceres CLONE 1876576
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature: SWISSPROT Homolog: EC 1.2.7.7 3-methyl-2-oxobutanoate dehydrogenase (ferredoxin)
MAERLTRIAIVSEDKCKPKKCRQECKKSCPVVKTGKLCIEVTPASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKD

SEQ ID NO: 27385 - DNA, 2046 bp, Panicum virgatum
  misc_feature: Ceres CLONE 1876583
  misc_feature: Encodes the peptide sequence at SEQ ID NO. 27386
aaacatactcgctcttcctcttcttgggttcgtcccctctgatccctccctccccttccccacatggccacatctctagggttttagcaccccatttccccatcgccatttccgatcggatcgctccctcctcatccgccgctaggcagatcccgccgcgagccaccctaccttccggcgccgccaccttcgtctcggaggtctccgccgaaagctcgcacaaatcccctcctttcgcccatttgttgcaaagatcgggttttttttctcttcatcatccatttcttgcgtttcattccttccgttcctggaaatttcaccgcttccttgagatctcatgttcttcgatctgatcttgccgcgtctcgcgagaagcatagctgttttgtgcgagagtttggggagaagatcctcggagttgtgattcttgcgcccatttgctcgctccaataactttcagaagcatctgatctcgaatagtgaaagaaagtagccacctttgtgccgtttcttgcaactaggcttggccctgcgtattggtggtgggttggcgctgagggggagctctgcggcgctgcccattcctatgaatggacgggagggagtccacggkggcgtcggggcccaacttctcctcgttctacgcgcagcaccggggcatcggtgctccgggcgtccccagccactcgccggggctccacggcccgccgcccggcggataccggcagcaacttgatgcattctctgcggggtacgcattccagaccccgcacgtcggtggcccccacattgggcaggggtaccaccatgttgaggcctcacctcctggggcgcagcacagcgccggtgccggtgccagctccggccgtgctatggagattggcatgggtgtggccgtgagtgctgatgctaaggcggatcaggggagtgtggctggccaggatgagcaagtgaagaagaagcgggggaggccaaggaaatataagcctgatggggcggtgactcttgggttatcaccctcttcatcaacaacgcctcactcgtcgaactcggggatgggaaccatggtcagcacaccaggttcaggatttggatcagggggttcaggctctggtgctccatcagagaaacgtggccggggacggcctcccggctctgggaagatgcaacagttggcttcgcttggaaagtggtttcttggctctgttggaacaggttttactcctcatgtgattattattcaaccaggagaggatgttgctgccaggataatggcgttttcacaacaaggcccaagggcagtgtgcatcatttcagctactggagctgtttctacggcaacccttcaccaggattcagactctggtggtgtggttacatatgagggtcgatttgagatcctgtgcctttctgggtcatacttggtactagatgatggcggcacacggacccgaagcggagggctttgcatagctttgtgtggtcccgaccacagggttattggtggcagtgtaggtggagtcctgacagcagctagaacagttcaggtgatagtggggagcttcatgtatggtggttcaaagaaaaacaaaggtaaagccgagccagacatggagcacgaggagacgaatgctggtgaggaagaggcggcccctgcaatggtgctgcaggagcacaacatgcctcctcacgtgatgagcggatggcctccgggcatgatgagggagatggactcgcgagcctcaaacatcgatatcaactcgatccgcgagtaggtagttggctgctggatatggcgggtgggaagagcaggccaggctctctgacattgaaggaaggagagaaaccatcctgggcagcggctgagctagaggacacaggcacagcatgcgtgcacgaacctcccctaaggtgcgagaagagttgttgtggttgctgtgttaagtaggaactctgcgtatcgtatcatatgatataattaagagctgtttatggtgttgtacttggatgctgttgtatgagataatgagatatgcttttggtacc

SEQ ID NO: 27386 - protein, 394 aa, Panicum virgatum
  misc_feature: Ceres CLONE 1876583
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature (8)..(8): Xaa is any aa, unknown, or other
MDGRESTXASGPNFSSFYAQHRGIGAPGVPSHSPGLHGPPPGGYRQQLDAFSAGYAFQTPHVGGPHIGQGYHHVEASPPGAQHSAGAGASSGRAMEIGMGVAVSADAKADQGSVAGQDEQVKKKRGRPRKYKPDGAVTLGLSPSSSTTPHSSNSGMGTMVSTPGSGFGSGGSGSGAPSEKRGRGRPPGSGKMQQLASLGKWFLGSVGTGFTPHVIIIQPGEDVAARIMAFSQQGPRAVCIISATGAVSTATLHQDSDSGGVVTYEGRFEILCLSGSYLVLDDGGTRTRSGGLCIALCGPDHRVIGGSVGGVLTAARTVQVIVGSFMYGGSKKNKGKAEPDMEHEETNAGEEEAAPAMVLQEHNMPPHVMSGWPPGMMREMDSRASNIDINSIRE

SEQ ID NO: 27387 - DNA, 664 bp, Panicum virgatum
  misc_feature: Ceres CLONE 1876592
  misc_feature: Encodes the peptide sequence at SEQ ID NO. 27388
aggctaactgtccatccacaacatacatcttgcacacaacatactaccaatctcgtctctgtagcagttgaagaactccaacgaaaatgaactcggtggtgaagatcggcccctttggcagcacctccgaggctgagggcaatcgcgacgtcaccgtagcgccgctgcgcctggagagcatcaccatccgccatgggaatgtgctccacgccctctccttcacctacaaggactgccacgggctgcagcacaccacaggccaatggggcggcgacggcggcaactccaccacaattacccttggccctgacgagttcgtgacgggagttcacgggctctacggcttctacggttacgggagcgacggcgtcaccggcttcaccatcgtcaccaacctccggacctaccgaccgttcggagtcagtgactccatcaaggaacccaagtccgtcgacatccccgtcatgaacaacggcagcatcgtctgcttcttcgcccaccgcagcaaggcctacggcacggtcatcgaagtctacatcgagcccttctgatgattgtcatgtgcttggcaaaatcgatcatgaacctgctgtttaatttgtgcgttcagcttttgtgtgtatgcatgaaaaaataaactgggatgtgatgtcatcccactatc

SEQ ID NO: 27388 - protein, 154 aa, Panicum virgatum
  misc_feature: Ceres CLONE 1876592
  misc_feature (18)..(153): Pfam Name: Jacalin Pfam Description: Jacalin-like lectin domain
MNSVVKIGPFGSTSEAEGNRDVTVAPLRLESITIRHGNVLHALSFTYKDCHGLQHTTGQWGGDGGNSTTITLGPDEFVTGVHGLYGFYGYGSDGVTGFTIVTNLRTYRPFGVSDSIKEPKSVDIPVMNNGSIVCFFAHRSKAYGTVIEVYIEPF

SEQ ID NO: 27389 - DNA, 1506 bp, Panicum virgatum
  misc_feature: Ceres CLONE 1876616
  misc_feature: Encodes the peptide sequence at SEQ ID NO. 27390
tgcgcacccaccctcctctctctctctctctctctctctcccgtcgtcgccatttattacccctcttcgccgcaaaattcctgtcctagtaaagggtcctgcgtccaccgtccacgtggacggtggctgcggcgtgggcgggcgccggagatgtgagagccgccgcggcgttggagatggctgcggcgggagcggggggcgggggcgaggggaagaagcggggcgcgtcgcggagctggatcctgttcgacgctgccggggaggggcgggtgctggatgccgacaagtacgccatcatgcaccgcgtcgacatcaacgcgcgcgacctccgcatcctcgacccgctgctctcctacccctccaccatcctcgggcgcgagcgcgccatcgtcctcaacctcgagcatataaaggcgatcattacttccgaggaggttttgcttagggatccatctgatgagaatgtaatccccgtagtagaggagctccggaggcgcttagcaccatcaagtgccactcagcatgatggaaaggagaacttaagtggccagcatgatgcagaaggggcggaagaagatgaatctccttttgagtttcgtgcactggaggttactctggaagctatatgcagtttccttgatgcgcgcactactgagcttgagactgatgcttacccagctttggatgaattgacatccatgatcagcagccgcaacttggatagagtacgaaagttaaaaagcggcatgacaagattgactgcaagggttcagaaggtgagagatgagcttgaacaattattggatgatgatgatgacatggctgatctttacttgtctagaaagttggctggggcatcttcccctgtcagtggttctggaggaccaaattggttccctgcatccccaactattggttcaaaaatatcaagagcaagcagagccagtgcacctaccatacatggaaatgagaatgatgtggaagaactggagatgttgctggaggcatatttcatgcaaattgatggcactttaaacaaattgacaacgctgagagagtacattgatgacacggaagattacatcaatatccagcttgacaaccaccgtaatcagttgattcagctagagttattcttgagttctgggaccgtttgcttgtcgctttactcgttagttgctggagtctttggtatgaatataccgtacacctggaatgaggaccatggatacgtcttcaaatgggtggttctcgtatccgggcttttttgcgcctttatgtttgtctccattgttgcttatgcgaggcacaagggtctcgttggatcctgaatagctgaaataaccgcagcttgcttccctcaactgtaaattgagctagagagcatcaactttgcggtgtgattcatctcttgtaccaaattcattagtatcaaattggggatattgaataggaacaattaatagaaaaaaattaatgcaaaagaaatatatggcgatgtctccc

SEQ ID NO: 27390 - protein, 384 aa, Panicum virgatum
  misc_feature: Ceres CLONE 1876616
  misc_feature (16)..(382): Pfam Name: CorA Pfam Description: CorA-like Mg2+ transporter protein
MAAAGAGGGGEGKKRGASRSWILFDAAGEGRVLDADKYAIMHRVDINARDLRILDPLLSYPSTILGRERAIVLNLEHIKAIITSEEVLLRDPSDENVIPVVEELRRRLAPSSATQHDGKENLSGQHDAEGAEEDESPFEFRALEVTLEAICSFLDARTTELETDAYPALDELTSMISSRNLDRVRKLKSGMTRLTARVQKVRDELEQLLDDDDDMADLYLSRKLAGASSPVSGSGGPNWFPASPTIGSKISRASRASAPTIHGNENDVEELEMLLEAYFMQIDGTLNKLTTLREYIDDTEDYINIQLDNHRNQLIQLELFLSSGTVCLSLYSLVAGVFGMNIPYTWNEDHGYVFKWVVLVSGLFCAFMFVSIVAYARHKGLVGS

SEQ ID NO: 27391 - DNA, 953 bp, Panicum virgatum
  misc_feature: Ceres CLONE 1876625
  misc_feature: Encodes the peptide sequence at SEQ ID NO. 27392
gaaggttcagacctttttccatctcattcgatctcaccacctttctcttctctactcgcttcattttctgaaccgagatttctgtggagatacgaaagctttggttgccctctctctgtttgcagtgtttttcgtccagaatatcagatgtagcggaggttttacggtcgaacgaggaggtcgccgacgagttctgcttgttcgtagctaagcgagcctgcggcatagatacacatagccttgacgaacaggcctcgtttcccgtgggaaggcctcggcgatggcgatgacgataaagggcatcttcagagggttgaagatcatcgctcaaatattcacagtgcagagggagcatgagatcgagatcgggtaccctacggacgtgaggcatgtgtcgcacatagggttcggcgctagcggctcctgtccaagctggatgagtgaattcagaggagtagaggaggtatcagcagaggcagcaggagcaggagaagcatccgcaagctccgctgcgcagtcgaggcaagcctcctgtgcttccctagacttcgagcaaccggcaggcgtcgtgccgccgccggaagaggtcgccaccaccggcagctccgccgccggcaccccaagtggcgccccgaggaagccgacggcgaggccgaagaaagcccgggcgccgtcgcctgcctcgaggtcgtcctcgtggcgctccacgggctcgttcgccaccgcgtgcagcgactccggcgaactgcgccccgccggcctgcgagccgcctgatcgataccgcgacggagggcggcgcgcgcctccccgatcaccgtacttgtacatgctcttgacacggtttgttgcctgtaacgttttcttgggtttggtctgtttggtttcggccttcggggcgtgaaagcggttgggaactgttatttttattcggaaacaggaaagctcggtcggg

SEQ ID NO: 27392 - protein, 164 aa, Panicum virgatum
  misc_feature: Ceres CLONE 1876625
  misc_feature (28)..(92): Pfam Name: PBD Pfam Description: P21-Rho-binding domain
MAMTIKGIFRGLKIIAQIFTVQREHEIEIGYPTDVRHVSHIGFGASGSCPSWMSEFRGVEEVSAEAAGAGEASASSAAQSRQASCASLDFEQPAGVVPPPEEVATTGSSAAGTPSGAPRKPTARPKKARAPSPASRSSSWRSTGSFATACSDSGELRPAGLRAA

SEQ ID NO: 27393 - DNA, 556 bp, Panicum virgatum
  misc_feature: Ceres CLONE 1876631
  misc_feature: Encodes the peptide sequence at SEQ ID NO. 27394
atcttccttctccggccggaaagcaactactccgcgtcccggccgctacccttttccccgcaccgcacggcggagaccacgatccccgccggccgacgaagtagggatcgcgagttgcgacgaggaaggagaggaggctcctcgatcccgctgcagttatctattcatttcgatcgggggtcgcggtgatttggtaggagccttcgggagcagcggcgatgtcgggcgtgttcggcagggtgttcgggaagtccaagcagcagagccaggccaccgcgctggcctctctggacaagctcaacgagacacttgaaatgttggaaaagaaggaaaatttgctagtgaaaaaggcgaatcttgaagtagagaaggccaagaatttcaccaaagccaagaataagagagccgcaatacagtgcttgaagaggaagaggttatatgagcaacaaattgagcagcttggaaatttccagctaaggatacatgatcagatgattatgctagaagctgcaaaagattgaacagagaaatcagcaaactgagttgatttcgtggc

SEQ ID NO: 27394 - protein, 100 aa, Panicum virgatum
  misc_feature: Ceres CLONE 1876631
  misc_feature: Functional homolog of the protein sequence given in SEQ ID NO 50916
  misc_feature: Useful for making plants with modulated nitrogen use efficiency
MSGVFGRVFGKSKQQSQATALASLDKLNETLEMLEKKENLLVKKANLEVEKAKNFTKAKNKRAAIQCLKRKRLYEQQIEQLGNFQLRIHDQMIMLEAAKD

SEQ ID NO: 27395 - DNA, 680 bp, Panicum virgatum
  misc_feature: Ceres CLONE 1876639
  misc_feature: Encodes the peptide sequence at SEQ ID NO. 27396
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatataattaaaccctacgtcgtgcgtgctatagctatagctatagctatactatacttaattggtttgcaatt

SEQ ID NO: 27396 - protein, 149 aa, Panicum virgatum; identical to SEQ ID NO: 10105
  misc_feature: Ceres CLONE 1876639
  misc_feature (58)..(133): Pfam Name: Fer2 Pfam Description: 2Fe-2S iron-sulfur cluster binding domain

SEQ ID NO: 27397 - DNA, 1907 bp, Panicum virgatum
  misc_feature: Ceres CLONE 1876640
  misc_feature: Encodes the peptide sequence at SEQ ID NO. 27398
actacagagtacagacatttactcagctcacggctcacagctgtttcagcaaaacggttttgagctttctcaccagttcataacctacaccaatttttcttacagctcacaattcacaatagcttttcttacggtaacagcttaaccaaacacaccctatatatatgttcaccttggtctgagcaagaaggaaggcgcagcagcagctccctccaatggcttcccagttaccctcctccctcgcggcatcagcgggcctgtgcttgctctcactgctcaccgcggccgtgctggcgttgaccctctacatcctcggcggcgtcgcgtccttcgccgccctctgcgtcagggagtacgcccggcgagaccggggccggccgccgctcatcgggacggtgttccggcagctcagcaacttcgacaggctgttcgacgagcatgtcaggtacgcgctggagcaccgcaccagcaggctggtctaccctggccacagcgagctctgcacagccgacccggccgtcgtcgagcatgtccttaagagcagctccagtaaatacagcaaggggacctacaattatagcatcatgaaggatctcttcggggaagggattttcgcaacagatggggacaagtggaggcaccagaggaagctggcaagccatgagttctcaacaaaagtgctccgcgaattcagcagtgttgcgttcagaataaatgctactaagctggcagatataatatcttctgcagcaactaatggaactgttataaacatgcaggaccttttgatgaaaacaactatggattctatcttcaaagtgggatttggtttcgagctgaacacactatctggatctgataaatcaagcattcagttcagcaatgcgtttgatgaggcaaactctcttgtgtatcaccgatatgttgatctattctggcagctgaaaaggtatttcaatatcggatcagaagccaaacttaagaggaatattcagataattgatgacttcgtgatgaagctgatccatcaaaagagagaacaaatgaatggacaagataatagagcaagagaggacatactatcaagattcataatacagagcaaaaaggaccctcagacaatgaatgatcgttacctgcgtgacatagtcctaaacttcctgatcgctgggaaagacacgactgcgaacactctcacatggttcttctacatgctttgcaagaatcctatagtgcaggataaagttgcccttgaaatcaaggagtcagttgagtgggacaaggaagacaacaataacacagagcatttcacagaaaaattgaatgaaagcgctattgaaaaaatgcattacctccatgctgcgatctccgagacactacggctgtatccagctgttccagtggatagtaagatggcagatgaagatgatgtactacctaatggttatagagtgataaaaggagatggactgaattacatgatttatgcaatgggaaggatgacatacctgtggggtgaagatgctgaagatttcaggcctgaaagatggcttgtggatggaatcttccagcaagagagtccttacaagtttgtatccttcaatgctggaccccgtatttgcttggggaaggagtttgcatataggcaaatgaagatcacggctgccaccctgatacacttcttcaggttcaaacaggcagatgaatccaaggatgctacatacaaaacaatgtttaccctccacatggataaaggcctccatttgtatgcctacccacgttcaatttgatctgctaaacaagcaattgtatcatttgttactgttgcaaaaaaatgtactacatatttcacaactataatttgtgctgagtaaaggaatgctgaataatattatactccaattgcc

SEQ ID NO: 27398 - protein, 524 aa, Panicum virgatum
  misc_feature: Ceres CLONE 1876640
  misc_feature (53)..(518): Pfam Name: p450 Pfam Description: Cytochrome P450
  misc_feature: SWISSPROT Homolog: EC 1.14.14.1 Unspecific monooxygenase
MASQLPSSLAASAGLCLLSLLTAAVLALTLYILGGVASFAALCVREYARRDRGRPPLIGTVFRQLSNFDRLFDEHVRYALEHRTSRLVYPGHSELCTADPAVVEHVLKSSSSKYSKGTYNYSIMKDLFGEGIFATDGDKWRHQRKLASHEFSTKVLREFSSVAFRINATKLADIISSAATNGTVINMQDLLMKTTMDSIFKVGFGFELNTLSGSDKSSIQFSNAFDEANSLVYHRYVDLFWQLKRYFNIGSEAKLKRNIQIIDDFVMKLIHQKREQMNGQDNRAREDILSRFIIQSKKDPQTMNDRYLRDIVLNFLIAGKDTTANTLTWFFYMLCKNPIVQDKVALEIKESVEWDKEDNNNTEHFTEKLNESAIEKMHYLHAAISETLRLYPAVPVDSKMADEDDVLPNGYRVIKGDGLNYMIYAMGRMTYLWGEDAEDFRPERWLVDGIFQQESPYKFVSFNAGPRICLGKEFAYRQMKITAATLIHFFRFKQADESKDATYKTMFTLHMDKGLHLYAYPRSI

SEQ ID NO: 27399 - DNA, 684 bp, Panicum virgatum
  misc_feature: Ceres CLONE 1876693
  misc_feature: Encodes the peptide sequence at SEQ ID NO. 27400
acaccaccgaattccgccctccatccgaacaccaaagctgcttccttttctcctccgccgtgctcagcccggcccaccatggcggcaccagcgagcccccgcgccggcggctccgaggcggcggcggcggaggcgtacgaggacctgctgccggtgatgggggagcggctgggcacggcgggcctgctggcggagctccgggcggggttccgcctcctggccgacccggcgcggggcgccatcacggccgagagcctgcggcgcggcgcggcggcggcgctgggcgtggccgggatgacgcccgccgaggccgacgccatggtgcgcgagggcgacgccgacgccgacggcgcgctcagcgaggccgagttctgcgtcctcatggtgcggctcagccccggcatcatggccgacgccgaggcctggctcgaggaggccatcgccgaggagctcgcccgaggagaagaacctgacgccggcggcagtggcacggcggccccggccccggcgagccgccgctcggtttgataatcaattggccggactgcctgtggactctgcgttgcctgtgccgccgtgatcggagattaatcgtgaggtgtctgctgtaattaccgtgatgatgattgctactctgcgagtgactgttcttggacgtaataataatttcgtgcaactttggtg

SEQ ID NO: 27400 - protein, 149 aa, Panicum virgatum
  misc_feature: Ceres CLONE 1876693
  misc_feature (77)..(105): Pfam Name: efhand Pfam Description: EF hand
MAAPASPRAGGSEAAAAEAYEDLLPVMGERLGTAGLLAELRAGFRLLADPARGAITAESLRRGAAAALGVAGMTPAEADAMVREGDADADGALSEAEFCVLMVRLSPGIMADAEAWLEEAIAEELARGEEPDAGGSGTAAPAPASRRSV

SEQ ID NO: 27401 - DNA, 726 bp, Panicum virgatum
  misc_feature: Ceres CLONE 1876738
  misc_feature: Encodes the peptide sequence at SEQ ID NO. 27402
cttcctggactcttctcaagtcctggacgctctggaggttaggttagaaggttccgggcttccatctacaagaagcaatcggcgcagctctgttctgtttctcctggctcttggcatcgtctggtagctcgctcttggcatcgtctggtagctccggttcaaaggcagccatgctgaaaccgccgtcgattcagagcaaggcaagaggcgatccctggccacggggagcggcatgttctgcgtggcgatgcagggcgcggacccggcggcgctgcaggcggggctgaactgggcgtgcggaccggggcacgccgactgcacggccatccagtcgggcgggccgtgctacaagcagaacaacctgcaggcgctggcgtcctacgcctacaacgactactaccagcggagcgccaaaaccagcaccacctgcgacttcaacggcaccgccaccaccaccaccacggatcccagttcggggctgtgcgtcttcacaggaagctccacggccggcggcactccggcggcaagcgcccccagcgggctgtccccgttcacgccgggcacgggtggcttcggcaacggatcgtccttcgggagcccctcgagcggcctggtccctttcgatggcgcggagagcctcctgtcccgcgcgcggtgggcgctctgtgccctgctgctggcgttgccgctcttcttctttctttgaccagcagcggagcagagcag

SEQ ID NO: 27402 - protein, 157 aa, Panicum virgatum
  misc_feature: Ceres CLONE 1876738
  misc_feature (1)..(86): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50730
  misc_feature: Useful for making plants with altered carbohydrate content
  misc_feature: Functional homolog of the protein sequence given in SEQ ID NO 50559
  misc_feature: Useful for making plants with altered cell wall content and/or composition
MFCVAMQGADPAALQAGLNWACGPGHADCTAIQSGGPCYKQNNLQALASYAYNDYYQRSAKTSTTCDFNGTATTTTTDPSSGLCVFTGSSTAGGTPAASAPSGLSPFTPGTGGFGNGSSFGSPSSGLVPFDGAESLLSRARWALCALLLALPLFFFL

SEQ ID NO: 27403 - DNA, 703 bp, Panicum virgatum
  misc_feature: Ceres CLONE 1876748
  misc_feature: Encodes the peptide sequence at SEQ ID NO. 27404
acccagcctctggttagccccccgacggagcgctcgcctgagggggcgtgaattgagatctatctggatctagtccgccggcaatggaagcggcggcgggcggcaagcgcgcgtacagcatcatcgtgcccacctacaacgagcgcctcaacgtcgccctcatcgtgtacctcatcttcaagcacctcccggatgtgaactttgagatcattatcgtggatgatggtagtccagatggaactcaagatattgtaaaacaattgcaggaagtgtatggtgaagatcgtatcccaaagtatttgccaagctttattaggaagcaaaaggaaactggtgctgatgttgtaactggcactcgttatgttaagaatggtggtgtccatggttggaatctcatgcgcaagctaactagccgaggagctaatgttcttgcacagacattactgcaacctggagcctcagatttaactggatcgtttaggttatataagcgagatgtcctggaagatttaatctcctcatgcgtcagcaagggctatgtgttccagatggagatgattgttagggctactaggaaaggttatcacatcgaagaggtcccaataacgtttgttgacagagtctttggaatttcaaaacttggtgggtccgagatagttgaatatttgaaaggcctcgtgtatctgttgctcacaacataatt

SEQ ID NO: 27404 - protein, 205 aa, Panicum virgatum
  misc_feature: Ceres CLONE 1876748
  misc_feature: SWISSPROT Homolog: EC 2.4.1.83 Dolichyl-phosphate beta-D-mannosyltransferase
MEAAAGGKRAYSIIVPTYNERLNVALIVYLIFKHLPDVNFEIIIVDDGSPDGTQDIVKQLQEVYGEDRIPKYLPSFIRKQKETGADVVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 27405 - DNA, 662 bp, Panicum virgatum
  misc_feature: Ceres CLONE 1876753
  misc_feature: Encodes the peptide sequence at SEQ ID NO. 27406
gtcatcccaccccgccgccacccgcctcgctggaccatcccgtgacacgctgatctggaggagcccggcccgtgacgccgaccactggaggagcttgctcgacgccggccggtgctccttgcttcgaatccggctaatcaggcctcgctgttcgcacttcctcatctatccagtcctctccagtcgattccgcttcccgtcgtgattgagagggttgcgtttacgagcagagatgctgttgatatgagtgcgcctcacctgttcgacggaaggcccctgggctccaccaacgagaagatcgcggcctatgacggagatgccccgcagcaagagggcgaaggcgatggacgagggagacagaatcagcagcctccctgacgagctgcgccgccacgtcttgtctttcttgccggcaagggacgccgtgcgcaccagcgtgctggcgcccaagtggcgccacctctgggcgtcggcgcggcgcctcaacgtcgacgccaagggcttcagcagccagagctcgttcgtcaagtttgtgaacgccttgctgatcactcgtgactgcattcctctggagtcgttctggctccgtgccaacgggcctgacatctgtctatcttgaaaatttcagcgacactgtcagcctttggatttgtcatgccctc

SEQ ID NO: 27406 - protein, 103 aa, Panicum virgatum
  misc_feature: Ceres CLONE 1876753
  misc_feature (17)..(64): Pfam Name: F-box Pfam Description: F-box domain
MTEMPRSKRAKAMDEGDRISSLPDELRRHVLSFLPARDAVRTSVLAPKWRHLWASARRLNVDAKGFSSQSSFVKFVNALLITRDCIPLESFWLRANGPDICLS

SEQ ID NO: 27407 - DNA, 917 bp, Panicum virgatum
  misc_feature: Ceres CLONE 1876818
  misc_feature: Encodes the peptide sequence at SEQ ID NO. 27408
acacttcaattccactcaaaactttctctcttcctctgccaagaacaccggccggctagcagcttgtgtttgttgttcccatggagatcgacggcgacaacctcagcgccaccgagctccggctcggcctgcccgggagcagcagcggcgacgaccggccgaggaggccggcgccctccgtcggcgccaagcgagcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgccggagcggagggcggcgacggccagcacgccctcgcctacgaggacaaggacggcgacctcatgctcgtcggagacgtgccctgggacatgttcatctcttcgtgcaagaagctcaggataatgaagggttgtgaggccaggtgattgccgatacacaggcagaggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagtcttaggctcttagctagccgccttgttttttgagttatgttttgtatgagcgaaggctgtaaaaaaatcaaaaagaaaaatgagaaatttgacttaagtttggtcattttcctctcc

SEQ ID NO: 27408 - protein, 186 aa, Panicum virgatum
  misc_feature: Ceres CLONE 1876818
  misc_feature (7)..(186): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: Functional homolog of the protein sequence given in SEQ ID NO 50516
  misc_feature: Useful for making plants with altered terpenoid content
  misc_feature: The sequence is a functional homolog of SEQ ID NO 739 in the 10/374,780 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 656 in the 11/479,226 US patent application
  misc_feature: The sequence is a functional homolog of SEQ ID NO 890 in the 10/412,699 US patent application
  misc_feature: Functional homolog of the protein sequence given in SEQ ID NO 50147
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 667 in the 11/479,226 US patent application
MEIDGDNLSATELRLGLPGSSSGDDRPRRPAPSVGAKRALEDTRSEASGTTAAGDDHDDATPAAKAQVVGWPPVRAYRKNTFQAAAKKAEQPGGLYVKVSMDGAPYLRKVDLRMYKGYRELREALDALFTKSFSAAAAAGAEGGDGQHALAYEDKDGDLMLVGDVPWDMFISSCKKLRIMKGCEAR

SEQ ID NO: 27409 - DNA, 537 bp, Panicum virgatum
  misc_feature: Ceres CLONE 1876849
  misc_feature: Encodes the peptide sequence at SEQ ID NO. 27410
tccatatatcactcacttaagacgacatagacatccaacccagcttaagtttcttgcacactatggcgactatgaaagctgcaaccctagccctgaaggtcctcgtgcttggcttactgctccttgcgtatgctgggatgatcactcaggcccagccgcagtgcggcagccaggccggtggcctgacgtgcagcaacaacttctgctgcagccaattcgggtactgcggccttggcggcgattactgtggcacaggatgccagagcggcccatgcttctagcttgtcgcccgcctggtctggaacaaccaactctacatatatatatcgtgggtgaatgtatgcagcgccatacctatactatactaccgaataaaggtgctgcttctgtaataagtatgtactacgacatgtatcctgtgcgagtatagattggaagggctagtagtatattcatgtgcatgcatatgtgaaataaagcctgtatctgtatgtattatctatgaataaaagtggcaagaaggtccttgcatgttgg

SEQ ID NO: 27410 - protein, 72 aa, Panicum virgatum
  misc_feature: Ceres CLONE 1876849
  misc_feature (30)..(71): Pfam Name: Chitin_bind_1 Pfam Description: Chitin recognition protein
  misc_feature: SWISSPROT Homolog: EC 3.2.1.14 Chitinase
MATMKAATLALKVLVLGLLLLAYAGMITQAQPQCGSQAGGLTCSNNFCCSQFGYCGLGGDYCGTGCQSGPCF

SEQ ID NO: 27411 - DNA, 716 bp, Panicum virgatum
  misc_feature: Ceres CLONE 1876865
  misc_feature: Encodes the peptide sequence at SEQ ID NO. 27412
ctcgctcgttcggctccgccgccttctttccaagcggcgacggcaggggagtggcgccgccctgccagttcgtcgttggacgcttcgccggcgacaagatacagggaaaagtgttttgtgtgagtaccaaaacttgaaaatgaacaagggcaagatttttaagttagctaagggattcagaggaagggcaaaaaactgtataaggatagcaagggagagggtggaaaaggcactgcagtattcatacagggatcggcgcaacaagaagagggacatgcgatctctttggattgagcgcatcaatgctggtacacgccttcatggggtgaactatggcaacttcatgcatggattgatgaaggagaatatccaacttaacaggaaggttctctctgagctgtccatgcatgagccatacagcttcaaggctcttgtcgatgtatctcgcaatgcatttcctgggaacaggcctgttcctgctaaggaggggctagcaagcattctgtaaccatttcttgcccaataatcaaacttgacggctacatctgcatctgaaagtaccttttgtcttgtaacgttgtgaagaccttgtctgtttgatgacctgccggaccgacaatcgtagtacatgttttgtacctgccaattacttttagatttctgaaaaatgtattccgtttactcctgaaagcctttggaagaattagttagtggtc

SEQ ID NO: 27412 - protein, 122 aa, Panicum virgatum
  misc_feature: Ceres CLONE 1876865
  misc_feature (5)..(98): Pfam Name: Ribosomal_L20 Pfam Description: Ribosomal protein L20
MNKGKIFKLAKGFRGRAKNCIRIARERVEKALQYSYRDRRNKKRDMRSLWIERINAGTRLHGVNYGNFMHGLMKENIQLNRKVLSELSMHEPYSFKALVDVSRNAFPGNRPVPAKEGLASIL

SEQ ID NO: 27413 - DNA, 600 bp, Panicum virgatum
  misc_feature: Ceres CLONE 1876871
  misc_feature: Encodes the peptide sequence at SEQ ID NO. 27414
gccctcttgcaaccccccccccgaccgacacctaacaaccgcccccaggctttcgatccgcgccgagggaggaggacgagcaatggcgggcgaggagggagtcgtgatcgcgtgccacaccaaggaggagttcaagaaccagatgaccaaggccaaggatgccggcaagctggtgatcattgacttcactgcctcctggtgtggtccttgccgcatcatcgccccggtgtttgctgaattagccaagaagttcactgacgctttcttcctgaaggtcgatgttgacgagctgaaggaagtagcctcagagtacgagatccaggcgatgccgaccttcctcttcattaagaacggtgagaagatccacactgttgttggtgccaggaaggaggacctccagaccagcatcgagaagcacgcctccgccactgctgcttccgcctccgcctaaggccatagcgccaccagttatcaataacggccagcccacggcgtggtagcagtaggcgtcgtaattttcagtttggtttgggtgaattgtgagctatgttcaatccgggagtcctgatatgtttgggtcccgggctggacctgttatcg

SEQ ID NO: 27414 - protein, 122 aa, Panicum virgatum
  misc_feature: Ceres CLONE 1876871
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAGEEGVVIACHTKEEFKNQMTKAKDAGKLVIIDFTASWCGPCRIIAPVFAELAKKFTDAFFLKVDVDELKEVASEYEIQAMPTFLFIKNGEKIHTVVGARKEDLQTSIEKHASATAASASA

SEQ ID NO: 27415 - DNA, 942 bp, Panicum virgatum
  misc_feature: Ceres CLONE 1876874
  misc_feature: Encodes the peptide sequence at SEQ ID NO. 27416
aaggcgtcgtcgctccggcgcgagccagacgcgacgccgtgccgcgagcgagcccgttttttctgccgcccatggcctcttctgtgtcctcctcctccccgctcttcgcctcgctccggccgcccgcgcccgccggctcgcgctgctgcgctgctcccccgcaggcagctgcgccgtcggcggagaacgccgtcccgtcgcggccggcgcctctcgtcgcggttgctagccaccggagggagctggtgctaggggcggcgctgggcgcgctgctgtcggtgtcgcgggcgccgctgccggcccaggcgcgcgaggtcgtggtcggctcgtacctgccgccggcgccgtccaaccccggcttcgtcttcttccgggccacccccaaggacacccccgccctccgcgctggcaatgtggaaccgtacgagttcgtcctgccgccgacctggaagcagacgcgggtggccaacatcctgtcggggaactactgccagcccaagtgcgccgagccgtgggtggaggtgaagttcgaggacgagaagcagggcaaggtgcaggtggtggcctcgccgctcatccgcctcaccaacaagcccaacgccaccatcgaggacatcggcagccccgagaggctgatcgcctccctggggcccttcgtcaccggcaacaccttcgaccccgacgagctcgtcgacaccagcgtcgagaagatcgacggccaaacttactacagctacgtgttggagactccgctggcgctgaccggctctcacaatcttgccaaggccacggccaaggggaacacggtggtgctcttcgtcgcaagcgccagcgacaagcagtggtcgtcgtcggagaaggttctcaaggccatagtggattcgtttcaagtatgattgcatttgcagcaatggactctgtgagatgcttggttgagcgggt

SEQ ID NO: 27416 - protein, 274 aa, Panicum virgatum
  misc_feature: Ceres CLONE 1876874
  misc_feature (75)..(274): Pfam Name: PsbP Pfam Description: PsbP
MASSVSSSSPLFASLRPPAPAGSRCCAAPPQAAAPSAENAVPSRPAPLVAVASHRRELVLGAALGALLSVSRAPLPAQAREVVVGSYLPPAPSNPGFVFFRATPKDTPALRAGNVEPYEFVLPPTWKQTRVANILSGNYCQPKCAEPWVEVKFEDEKQGKVQVVASPLIRLTNKPNATIEDIGSPERLIASLGPFVTGNTFDPDELVDTSVEKIDGQTYYSYVLETPLALTGSHNLAKATAKGNTVVLFVASASDKQWSSSEKVLKAIVDSFQV

SEQ ID NO: 27417 - DNA, 807 bp, Panicum virgatum
  misc_feature: Ceres CLONE 1876883
  misc_feature: Encodes the peptide sequence at SEQ ID NO. 27418
gcccttggcgagcctccctccttcccactaaccacacgaccacacctcacccctcaaggcctcaacgcctaccaaactagcacagcctctccataactgctgctccacctcctgctccccggagggagggagccgccattctccgtcgatctcctccacgctccggcgctgcctcgcccgcccatggccgccgcctcgggctccaacccggacagcatggacaccgaccctcccggcggcctctccatcgccgtcgagcgcaacccgccggagtcccgcctgctccagctcggcgtcaggacctggcccaagtggggttgcccgacggggaagttcccggtgaagttcgacgcgcggcagacgtgctacctgctcaagggcaaggtgcgggcgcacatcaaggggtcgtcggagtgcgtggagttcggcgccggcgatctcgtcgtcttccccaaggggctcagctgcacctgggacgtcgtcgccgccgtcgacaagtactacaagttcgactcgtcctgactccatcagcccgctcgcgcgcgagttcccgctgattgatgatccgccgattgattgctgggctgtgccctagcttaattgcgttgatttagcctaattctgctgctaattttgcttacctagctctgtgcctagtgcctctaatcgtctcctgtgtcgtgtaaaaaattaaaatggaatgggtgtgcagtgcagtgcagggcatctagccctctgtcgtactaggccagtggttattcatccatccgggaactgcagaaaaaccggtcaatgcagggcctgttc

SEQ ID NO: 27418 - protein, 112 aa, Panicum virgatum
  misc_feature: Ceres CLONE 1876883
  misc_feature (33)..(107): Pfam Name: Cupin_3 Pfam Description: Protein of unknown function (DUF861)
  misc_feature: Functional homolog of the protein sequence given in SEQ ID NO 50187
  misc_feature: Useful for making plants with modulated cold sensitivity
MAAASGSNPDSMDTDPPGGLSIAVERNPPESRLLQLGVRTWPKWGCPTGKFPVKFDARQTCYLLKGKVRAHIKGSSECVEFGAGDLVVFPKGLSCTWDVVAAVDKYYKFDSS

SEQ ID NO: 27419 - DNA, 714 bp, Panicum virgatum
  misc_feature: Ceres CLONE 1876943
  misc_feature: Encodes the peptide sequence at SEQ ID NO. 27420
aaaaggggacgttcccgatttggggatcagattcagatcagggtttcgttccttctttgcagagcagagaagagaagacacaagagatggcactactgaatcggagaggatggacgacgctgcgctgtgctgcgatttcgttccagttcaggaagctgtttaatcggaccgccgccgcgtcttcatctggaactggatgcacctccaaactgttcgtcggtggtctttcttacgatactaatgaaacagctctcaaggacgctttctctcaacatggtgctgttattgcagtgaaggttgtatgccatccaacgacgggcaagtcaaaagggtttggctttgtcacgttttcttcacaagatgaagcagcaaaggcagcgcacaaaatggacggtgaggtgcttgatgggaggaacattcgggtgcactactcaaacactggatgatctgccactgcttatgttcagtccagcctacaaatagacagtctgctgatttctcagcacagcatcagcacagggttccctgagctgagttgttcctcactttattttgagacttaaaagatcgcaggaccacctcatctttaaaccgttttctttcactggcacgattgcatgaacatgtaacagtgatattactagatcagcatgcgctagtttacgcctcaggccttcgcgaatttttttgagttttgacattgtagtactttcg

SEQ ID NO: 27420 - protein, 119 aa, Panicum virgatum
  misc_feature: Ceres CLONE 1876943
  misc_feature (42)..(113): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MALLNRRGWTTLRCAAISFQFRKLFNRTAAASSSGTGCTSKLFVGGLSYDTNETALKDAFSQHGAVIAVKVVCHPTTGKSKGFGFVTFSSQDEAAKAAHKMDGEVLDGRNIRVHYSNTG

SEQ ID NO: 27421 - DNA, 601 bp, Panicum virgatum
  misc_feature: Ceres CLONE 1876957
  misc_feature: Encodes the peptide sequence at SEQ ID NO. 27422
atcacacactcggacctgagctgatccaccactacagcctgcagttgcagatcgagagaagcaaaaccatggcgtcgtccaaggcgctcctagtgcttgcgctcctgctcgctgctgccttccttgtcgcctcagctaataacgagcacacccagccaaaggaggaggagaacaagcaggccggcgtgcaggactaccacggcggcggctggcgcgggggaggctaccctggccacggcggcggctaccctggccgcggcggcgggtactgccagtgggggtgctgcaaccgcggctactacggcggctgccgctgctgctcacgccccgacgagatcccggagcccatgtaccgcccggagttcgtcgaggtccacgactgaataatgaagaagctgcacggcctcgttgccatgtactagtcgatcggtaaaagtatgggttgaacaataaaggcatgcatatatatatgtatgcaattgtgcgtgtgaatgtatgtccgtgtgtggtggttggagtcgatatgcagtagaatgtaactctcatgcatgtatagtagtgcatgccgccttcgaataaaaataagagagtcgttgttgct

SEQ ID NO: 27422 - protein, 104 aa, Panicum virgatum
  misc_feature: Ceres CLONE 1876957
  misc_feature (1)..(81): Pfam Name: GRP Pfam Description: Glycine rich protein family
MASSKALLVLALLLAAAFLVASANNEHTQPKEEENKQAGVQDYHGGGWRGGGYPGHGGGYPGRGGGYCQWGCCNRGYYGGCRCCSRPDEIPEPMYRPEFVEVHD

SEQ ID NO: 27423 - DNA, 693 bp, Panicum virgatum
  misc_feature: Ceres CLONE 1877058
  misc_feature: Encodes the peptide sequence at SEQ ID NO. 27424
gtcccgccttatcctcccctgatcccgtacaaaagcgggctccctcacgctcccgcccgcccgctcaagctatccaccaccatagccgccgccccgccgccacactcttcttgctcacggtaagcgtcgttcgtccatgccgcattcttcccatccctctgcatcatcgcgattcccaccttcttctccgttgccgtcgaggcgcaggctctagcccaccgagcgcaggaatggcgtcgttcgccgtggcaacggtcccgtcgctggcggccccggcggccaggaagaggtccggcggcgtcacctacgtcgagggcatgaacgcctacagcggcctcaagggactcaacaaggtcaccatgctcgagctgcgcaagaccgccgactactccttcgccaagatcgtggcgtcgctcagccccgccggcaagacgcggcgcggcagcgcgttcggggctcagatgaacgccgcggcggagatcttcaggatcgccgccatcatgaacggcctcgtgctcgtcggcgtcgccgtcgggttcgtgctgctccgggtggaggccgccgtcgaggagtccgagtagggatggacgcgcgcccgcccgcccgccctgatagcagccactctgctgctgcctcttgcctcatataagccgtgatatataaaacgtaatgtgtgttttttattgaatttac

SEQ ID NO: 27424 - protein, 116 aa, Panicum virgatum; identical to SEQ ID NO: 27343
  misc_feature: Ceres CLONE 1877058
  misc_feature (78)..(114): Pfam Name: PetM Pfam Description: PetM family of cytochrome b6f complex subunit 7

SEQ ID NO: 27425 - DNA, 643 bp, Panicum virgatum
  misc_feature: Ceres CLONE 1877086
  misc_feature: Encodes the peptide sequence at SEQ ID NO. 27426
acacagctcacgcgcagcatcaccaccggagcatcagggagcacgggagagagcagagcgccacaggccgtccgatcctccgcgcgaagcagatcagatggctctcgctctctccggctctgccgcgctccgcgccgcgctggcctcgctggccccgcgggccgccaggggctacgcggcgtcggcggcgtccggggccatgcggcgcgcggcggccgcggcggagagcgccgccgcgggggaagccaaggaggccgggcgcggcgccgccgccgccgagatctcctgggtccccgaccccgtcaccggccactaccgccccgccaactgggccgccgccgccgaccccgccgacctccgcgccgcgcacctcgcccgggcctgagccccgcccgcccccgcccacccgtctgacatagcataccaattaccaacgaaggggaaggtggggtggaggtggaggttcgtttggcgtcatcgtcggccgcgcgcgcacgcgctgtcacggcggcggcccggcatggccggtaagtcgtctcggtcggtcgccgtcggacgcttgacgccgctacatcgtctcggcctcgaccaatcgggagataccgtacatggaggggcggcctctggtcgtcgtggcgtgcgt

SEQ ID NO: 27426 - protein, 95 aa, Panicum virgatum
  misc_feature: Ceres CLONE 1877086
  misc_feature (1)..(93): Pfam Name: LEA_3 Pfam Description: Late embryogenesis abundant protein
MALALSGSAALRAALASLAPRAARGYAASAASGAMRRAAAAAESAAAGEAKEAGRGAAAAEISWVPDPVTGHYRPANWAAAADPADLRAAHLARA

SEQ ID NO: 27427 - DNA, 850 bp, Panicum virgatum
  misc_feature: Ceres CLONE 1877088
  misc_feature: Encodes the peptide sequence at SEQ ID NO. 27428
atcccccatgggaggcgccatgaggcagctgctcggcttgctgggagccatcaatggccgccccagggagaggaggaagaagatggtgctgcggcgcccggtgcgggaggtggagctcagggtcaggatggactgcgagcgctgcgagcgcgaggtcaagaaggcgctctccggcatgagagaagtgcatcatgtggaggtgaacaggctgcagcagaaggtgacggtcactggcgaggtggacccgctggcggtgctgcggcgggcccagtccacggggaagaaggcggagccgtggcccgcttctgcggccggcggctactactacgcccccgcggcctacggcgtcggggcggcccagctgcaggcccacgacggcggccggtgggcgaacccggccgcggctggctactaccagtacccggcggcgaggagcgcggaggcggccatcggcgccgagcagatcaccgacctgttcagcgacgacaaccccaacgcctgctccgtcatgtgacgccctacgtgtgctcgacacagcagctcagttaccatcagtttaggtagcatcaggaatagctgtagcgaggcagtagatactagatatatagtaaggctagcgacatggtggcatcgtattgtcactctgaatctcgtgaggttttctatgtggcgtggtgaagttagggaagaatgtagcgtagcagagtttaggtcgatggcacgcggagcaagaagcaaactttgcgtcgatagattctagtatctagtaatctacgcgcttagatcccctgcccgttctttatgttgggatcaggcagtggaacatgagatcagctagctctgaggggtc

SEQ ID NO: 27428 - protein, 168 aa, Panicum virgatum
  misc_feature: Ceres CLONE 1877088
  misc_feature (36)..(96): Pfam Name: HMA Pfam Description: Heavy-metal-associated domain
  misc_feature: SWISSPROT Homolog: EC 3.6.3.4 Copper-exporting ATPase
MGGAMRQLLGLLGAINGRPRERRKKMVLRRPVREVELRVRMDCERCEREVKKALSGMREVHHVEVNRLQQKVTVTGEVDPLAVLRRAQSTGKKAEPWPASAAGGYYYAPAAYGVGAAQLQAHDGGRWANPAAAGYYQYPAARSAEAAIGAEQITDLFSDDNPNACSVM

SEQ ID NO: 27429 - DNA, 681 bp, Panicum virgatum
  misc_feature: Ceres CLONE 1877091
  misc_feature: Encodes the peptide sequence at SEQ ID NO. 27430
acacaggagcccgcgcagtgatcgaaagcaagtaacaagagaagatggccgacgtttggatcatcaacactaccaaagatttggaaagggaactgagtaaatccgacaagctgattgtgctggagttcatggcgccgtggaacgagccaagcaaggtcatgaaggaaccgtataggcgaatcgccagagccaataaagaccaagtcaacttctacacgctcaacgtcgacaagttcaaagatttggcggaggaagctggagtggaggcgctgccgacgtacgttctgctgaagaataacgatgtgatggacatgatcgttggcgtcaggaggcaggagctcgagaatgccataaaaaccaatatataacaactgatccgatcgtccatgcgtcgagaacgggaaatgaatgatccataaataagtccactactgtcccatgtgttgtatcacgtatattgaaactcgtgtgcattttacgtatggatcgattaccatatgtttgattttcctaaacttctgtggaactagatccccatgttgaggccctgaagaaacacagcatatgtatactggtttgaaacagtttttgcaataaatcaatgtctggatctactactaggccagcaaaacaacaatgagtaaataaagctaaacgacacccgagcgtttctcggctgtt

SEQ ID NO: 27430 - protein, 107 aa, Panicum virgatum
  misc_feature: Ceres CLONE 1877091
  misc_feature (4)..(106): Pfam Name: Thioredoxin Pfam Description: Thioredoxin
  misc_feature: SWISSPROT Homolog: EC 1.8.1.8 Protein-disulfide reductase
MADVWIINTTKDLERELSKSDKLIVLEFMAPWNEPSKVMKEPYRRIARANKDQVNFYTLNVDKFKDLAEEAGVEALPTYVLLKNNDVMDMIVGVRRQELENAIKTNI

SEQ ID NO: 27431 - DNA, 673 bp, Panicum virgatum
  misc_feature: Ceres CLONE 1877105
  misc_feature: Encodes the peptide sequence at SEQ ID NO. 27432
gaacctcgcctccccctctcggcgtctctccggcagctgcgccgcggcctggatcgcaccccccgtcggagccaccatggctgggaagcttattgcaaacctgattgtcatgggctctgcggtaataggaagagctatgcttcaggcatatcgtaaagcgcttgataatgcaaataagactggtgtggcccatgaggcaataaataatattcgtagagccagtaaaacaatgaccgagcaggaagcgaggcagatactgggtgtatcagagaattcaacctgggaagagattgtacagcggtacgataacttatttgaaaaaaacgccaaagctgggagtttttacctccaatcgaaggttcaccgagccaaggagtgcctagaaactgtgtatcaaaagaacaagcaagatgaacctcctacttgagaccccgctcctcaagtccagttgagattctttttcccctcataagaaaaatgtacataacagcaaaggtcgctgctgttgtatcactagtgtgcagcgtggaaccaataaggctgatccgttaagcgcagctgctgcgaacctgtacaagactgatctgttaagggcttaagggacactggcgcacctgttactcttgttcttttgagctgatgattccacgagaccatatgtattcctgtgctt

SEQ ID NO: 27432 - protein, 116 aa, Panicum virgatum
  misc_feature: Ceres CLONE 1877105
  misc_feature (1)..(116): Pfam Name: Pam16 Pfam Description: Pam16
MAGKLIANLIVMGSAVIGRAMLQAYRKALDNANKTGVAHEAINNIRRASKTMTEQEARQILGVSENSTWEEIVQRYDNLFEKNAKAGSFYLQSKVHRAKECLETVYQKNKQDEPPT

SEQ ID NO: 27433 - DNA, 508 bp, Panicum virgatum
  misc_feature: Ceres CLONE 1877122
  misc_feature: Encodes the peptide sequence at SEQ ID NO. 27434
atggacagtgagtttgcgttcaagaagtactggagcgaggaagctcgtgaagggagggactatgtgcacaagaacttcaactgtgaggatctgctgatgaattttctatatgcgaatgcaagctcctccaggaccgtggagtatgtccacccggcatgggctattgacacatccaagctttcttctgttgcaatcagccgaaacacgcagaagcattatgatatcagaacaaattgcttggcaaagttttcctccatatatggccccctccctcagaaatgggagtttggcatgcgagaagaccattgggataaatagtgtgacaaaggtgcagtaccgagcaatgaaacacatatgcttcatcaagattttttgttgatcccatgtaaagttttatagttatagcccttctggtacaaatgccctggcctgtgatgtacgtattagattcgtacataagaacataagaacatcgttgcagctggtagttttaattttcaactctttc

SEQ ID NO: 27434 - protein, 105 aa, Panicum virgatum
  misc_feature: Ceres CLONE 1877122
  misc_feature (1)..(103): Pfam Name: EXTL2 Pfam Description: EXTL2, alpha-1,4-N-acetylhexosaminyltransferase
  misc_feature: Functional homolog of the protein sequence given in SEQ ID NO 51245
  misc_feature: Useful for making plants with altered carbohydrate content
MDSEFAFKKYWSEEAREGRDYVHKNFNCEDLLMNFLYANASSSRTVEYVHPAWAIDTSKLSSVAISRNTQKHYDIRTNCLAKFSSIYGPLPQKWEFGMREDHWDK

SEQ ID NO: 27435 - DNA, 559 bp, Panicum virgatum
  misc_feature: Ceres CLONE 1877135
  misc_feature: Encodes the peptide sequence at SEQ ID NO. 27436
ttgttcgagaaactgttcatgtcagagaatcccggtgaattggaaaattggctgggggatcttaacccgaactcaaaagaggtgataaaggatgcttatgctgtaccgtcacttgccactgcagttctgggtgacaagttccagtttgagcgccttggctactttgctgtggatactgactccacgccggagaagcttgtgttcaacagaacagttaccctccgtgattcatttgggaaagctggacccaagtgacttctatctaattttgagttttgattgggtgcagactgcagaggcgcacctgagccatacaatttgtgaaggaaatgatagtgtaatccatgaaacagtttaaaagcctttctccttgtaaaatgtgcatgtgaatgcagcttgtttgctttggttgaaatctgattttgtatgatcgtatcagtgctggtgtacccaatttgtgcaaaaagctacaaatatatatgatttaggatgtcagcagttaaacgctacatatatactatcataatttggaataccaaaggttagttttttaattgtt

SEQ ID NO: 27436 - protein, 84 aa, Panicum virgatum
  misc_feature: Ceres CLONE 1877135
  misc_feature: SWISSPROT Homolog: EC 6.1.1.18 Glutamine--tRNA ligase
LFEKLFMSENPGELENWLGDLNPNSKEVIKDAYAVPSLATAVLGDKFQFERLGYFAVDTDSTPEKLVFNRTVTLRDSFGKAGPK

SEQ ID NO: 27437 - DNA, 1437 bp, Panicum virgatum
  misc_feature: Ceres CLONE 1877180
  misc_feature: Encodes the peptide sequence at SEQ ID NO. 27438
aaaactacccgtgttcgccgccgccgccgcctcctcccttcgtcctcagccttttcctagggtttcctcgcggcctcgctccgcggccggcggcggcgtcggcgagagccgcccgccctcccgcctcgtcctcggtcgcagccgcgccgccctctccgcgccgagcaagcaatggcagggcaagcagggaacccagcaaaccatcatataagcccccacgtgataagcagcgcttttgttcagcaatattaccacattctacatgagcaaccagatcaagtgcacaagttttaccaagaatcaagtgtccttggtcgaccagagtccaatggaaccatggtggatgtaaccacccttggtaacatcaatgaaaaatttatgtctatggacttcgggaaattcttaatagagatagagacggcggatgcgcagttatctcacaaggatggggtgctcattgttgttactggatccttgacttcagatgatggcgtctgccgtaggtttacccagtcgttcttccttgctccgcaagaagctggtggctattttgttctcaacgatgtgtttaggtttatatcagagcggaaacctgctgagatagctcaagttggtactcaagaaaatgaaagtggtcagaatggtatatctgcatctgaaacatgttcagcattaccagaacctactccagctgacaagagtgtgatcttggaccatgtgacagctgagagtattgtcacggagaggcaaattagtaatccctctgttaatggaactgctgttgaaaataatgttaatgttgagccacctgtgcaagtggtcaaagaggatcccaaaaaggccccagttactgctcctccccctcctgctccaactcagacagatgttactaagaaatcttatgcatccattgtgaaggacatgaaggagggcccaccgactccaccagttgccaaaacaactccatcagttcccaagcaaaagcctgctcctaagccagtgtccaaggctgttgaaggtccggaaaaagcatccgtgaaacctgcccaggctaatggagccagtgatatgattgttgcccaaaacaactcttctcgcagtgagcaaggctattcaatttttgtcaagaatttgcctttcaattctaatgttgaaattgttgaggaggaatttaagaaatttggcgctataaagccaggtggcgtccaagtcaggcacaataaggttagaacttttggttttggttctatttgtgatgtctagttttaaacaattcttgttgcgttggtgcagcatgatcgttttgtctttggctttgtcgagtacgagtcccagcagtctatgcaagcagcaattgaggcatctccaattcatatggaggagaaagaagtccaaattgaggcgaaaaagaccaattcacgaggtggccgtttccat

SEQ ID NO: 27438 - protein, 363 aa, Panicum virgatum
  misc_feature: Ceres CLONE 1877180
  misc_feature (18)..(135): Pfam Name: NTF2 Pfam Description: Nuclear transport factor 2 (NTF2) domain
MAGQAGNPANHHISPHVISSAFVQQYYHILHEQPDQVHKFYQESSVLGRPESNGTMVDVTTLGNINEKFMSMDFGKFLIEIETADAQLSHKDGVLIVVTGSLTSDDGVCRRFTQSFFLAPQEAGGYFVLNDVFRFISERKPAEIAQVGTQENESGQNGISASETCSALPEPTPADKSVILDHVTAESIVTERQISNPSVNGTAVENNVNVEPPVQVVKEDPKKAPVTAPPPPAPTQTDVTKKSYASIVKDMKEGPPTPPVAKTTPSVPKQKPAPKPVSKAVEGPEKASVKPAQANGASDMIVAQNNSSRSEQGYSIFVKNLPFNSNVEIVEEEFKKFGAIKPGGVQVRHNKVRTFGFGSICDV

SEQ ID NO: 27439 - DNA, 631 bp, Panicum virgatum
  misc_feature: Ceres CLONE 1877180-R
ctacaaccgtaggaacgatggtggcgagatctcaaaccgcaggaacgacggtggcgagaacttcaaccgcaggaacgacggcggcgagaacttcaaccgcaggaacgacagcggcgagaacttcaaccgaagaaacaacttcagaaatcagaatgagttctctggtcgcggacggggggcacctccaccagggaatggttaccaccagaatgggaatggtctctacccagttcgacacttccagaatgggaatgggaggttcggccgtgtcagcagtggccctaagcaatcaccagttgctgtgtagaggcatcaggtatcaaagtaggacgcttaaggctacattcaagtgagtgtaaggattatttatagtaggagcattgctgatcaggcaccttctggtgggcatatcaaattcttttgtactgagttggatcacaaagattttagtagtggcaggcagtcgtccattggtggtaggtgaattttgttgccgttgacaaaccttgtcaactggttgttggacttgtggtccgtagattgtgtcatctgcctattaggattcagagattggactctaatcttatgaggtggcgcatgcagaaatgtgtccatgtttacttacgctttc

SEQ ID NO: 27440 - DNA, 695 bp, Panicum virgatum
  misc_feature: Ceres CLONE 1877205
  misc_feature: Encodes the peptide sequence at SEQ ID NO. 27441
attcattccacttcctaaacatccaaagaagccaaaactattaaactagacagcaaagaagtaaattcttcgcttcttgcatagttcctgtgtgatccaatccaagaagccatgaccacggccatggagcagcttgttgttaccccgctgccgccaataggcgccacggagtacagagacctaatccaggcgctagccacaccagtgcaatctgctccggtcgtgccattcatggcggacaccgaccagagcccggccatggctgtcgcaggtgccagctgctaccacctcatcacgccggcgcaagcggcttactactaccgcatcggccggtgcatgggaccggcaccgcgcgtgatgaagcggcactacggcctcgcggcgccggcagcagccatggcgaagctgtaccgcggcgtgcggcagcggcactggggcaagtgggtggcggagatccgtctgccgcggaacaggacgcggctgtggctcggcacgtacgacaccgccgaggaggcggcgctggcctacgacggcgccgcgttccggctgcgcggcgccgcggcgcgcctcaacttcccggaactcaggcgcggcggccggcacctcgcgccgccgctccacccgtctgtcgacgccaagctccaggccgtgacatccgcgccggcacccgccgcctcgcaggggctcgagagtgc

SEQ ID NO: 27441 - protein, 190 aa, Panicum virgatum
  misc_feature: Ceres CLONE 1877205
  misc_feature (94)..(145): Pfam Name: AP2 Pfam Description: AP2 domain
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
MEQLVVTPLPPIGATEYRDLIQALATPVQSAPVVPFMADTDQSPAMAVAGASCYHLITPAQAAYYYRIGRCMGPAPRVMKRHYGLAAPAAAMAKLYRGVRQRHWGKWVAEIRLPRNRTRLWLGTYDTAEEAALAYDGAAFRLRGAAARLNFPELRRGGRHLAPPLHPSVDAKLQAVTSAPAPAASQGLES

SEQ ID NO: 27442 - DNA, 1871 bp, Panicum virgatum
  misc_feature: Ceres CLONE 1877209
  misc_feature: Encodes the peptide sequence at SEQ ID NO. 27443
accaacccgcgcccctcttgggctcttggctgcgtgcgtgtcgccgtcctcggcacttacccccttccctggcggcctgcctgcctgcctctacagcagcggcccgccggcacggcgacacggcgagcgctcgctcaaggccgcgggggctacctgggtcgtctgctcctccagccccatcggagatccgcgctgccgttccctgattcagcgcctgttgatggatgagagatgaaaaacttcatcaagtaatcaatttgaagaagttcagatgggctccattctaagtgtgagtagtgctaagtctatggatcgacatgagtcatctgggacagatcctaataagagggtgaaggtatctacttatgagtatgggacgaacccgaggatccttccaacacttcccgatgagctctcattccaaattctggcaagattaccacggattcattacctcaacttgaagatggtttgcagagcttggaaggcagcaatcaccagccatgaactttcccagctgaggagagagcttcgtgtaaatgaagaatggttgtatgtactgaccaaagtcgaggcaaataagctcgattggtatggccttgatccattgtttcagaaatggcagaggttgccaccgatgccttctttcgtcaatgaggaatccactaggactggatcttctgggttccggatgtggaatgttgtgggctcaagcattaggattgctgatttcgtgaggggctggttctggcgcaggaatggtttggaccagatgcccttttgtggttgctcagtgggtgttgctgatggttacttgtatgttgttgggggcttttccaaagctgttgccctgaactgtgtatggagatatgacccttttctcaacttgtgggaggaagtaagcccaatgatggctgggcgggctttctgcaaggcaacatttttgaatggcaagttgtatgtagttggtggagtcagtaagggtcggaatggcttgcttcctctgcgttcagctgaggtgtttgatccaaaaactggactgtggagtgagctaccagaaatgccttttgcgaaagcacaggtactccccacagctttcttggctgatgtgctgaagcctatcgccacaggaatggcaccatacaagggtaaactgtacgttcctcagagcttgtactcatggccattcttttttgacattggaggtgagatctatgacccggaactgaattcttggtcagcgatgccagatggtctcggcgatggatggccagcaaggcaggcaggcacaaagctcggtgtcgtgatcgatgacaaactttataccttggagccttctacctctttggatagtggccacataaaaagatacaactctgaagaagacacatgggtaactatcgccccacaggttccggttaacgatttcactgatgcagaggctccatatttacttgctggcctccatggaaggctgcacgttataacaaaggcggcgaacaatactctccaggttatgcatgctgtggtgcagaataacacaggcagcggggcatcagaagaaaacgtgttatggaacacagtggcttccaggaactttgggacggctgagcttgtgagctgccaggttcttgatgtttaaaacgaggtcgcctttcacacctgtagagcatacgtttggactaggtttcatgctatgggctatcgttttagccaacaaagatatagttttttccttgtgtgtatgtgtggtgtgtggagattggagaaggcctttaatttgacatgtataagttgactcaactgctggaaagatgtgtatataggcatacaatcgacatggttacgtacagtgatcaattttttttcct

SEQ ID NO: 27443 - protein, 456 aa, Panicum virgatum
  misc_feature: Ceres CLONE 1877209
  misc_feature (169)..(214): Pfam Name: Kelch_1 Pfam Description: Kelch motif
  misc_feature (216)..(265): Pfam Name: Kelch_1 Pfam Description: Kelch motif
  misc_feature (39)..(86): Pfam Name: F-box Pfam Description: F-box domain
MGSILSVSSAKSMDRHESSGTDPNKRVKVSTYEYGTNPRILPTLPDELSFQILARLPRIHYLNLKMVCRAWKAAITSHELSQLRRELRVNEEWLYVLTKVEANKLDWYGLDPLFQKWQRLPPMPSFVNEESTRTGSSGFRMWNVVGSSIRIADFVRGWFWRRNGLDQMPFCGCSVGVADGYLYVVGGFSKAVALNCVWRYDPFLNLWEEVSPMMAGRAFCKATFLNGKLYVVGGVSKGRNGLLPLRSAEVFDPKTGLWSELPEMPFAKAQVLPTAFLADVLKPIATGMAPYKGKLYVPQSLYSWPFFFDIGGEIYDPELNSWSAMPDGLGDGWPARQAGTKLGVVIDDKLYTLEPSTSLDSGHIKRYNSEEDTWVTIAPQVPVNDFTDAEAPYLLAGLHGRLHVITKAANNTLQVMHAVVQNNTGSGASEENVLWNTVASRNFGTAELVSCQVLDV

SEQ ID NO: 27444 - DNA, 647 bp, Panicum virgatum
  misc_feature: Ceres CLONE 1877210
  misc_feature: Encodes the peptide sequence at SEQ ID NO. 27445
atcgaaagctccatccttgcgaccttaactacatatatgtacctacagctcattcgtactacacagctccgatcagctagctgctagcaatctaggaccaaccaagcaaagcatcacgagaaccatggcacccaaaaagctcaccacccttctcctcgccgtcgtcctcttggcgctcgccgcaccgccggttgccggcgaccccgacatgctccaggacatctgcgtcgccgactacaaatcccttcagggcccgctgcgggtgaacgggttcccgtgcaagcgcgaggcgaacgtgacggcggaggacttcttcttcggcgggctggccaaggccgccgacgtgtactccggcaacccgatggggtcggcggtgacggcggcggaggtggagacgctcccggggctcaacaccctgggcgtgtccatggcgcggaccgactacgcgccgtggggcggcgtgaacccgccgcacgcgcacccgcgcgccaccgagatcctcttcgtcctcgagggcaccctggaggtgggcttcgtcaccgcggcggcgccgagccggctcctcagccgcaccgtctcccggggccaggtgttcgtgttcccgcgcggcctcgtgcacatccagcgcagcgtcggggcggcgcccg

SEQ ID NO: 27445 - protein, 174 aa, Panicum virgatum
  misc_feature: Ceres CLONE 1877210
  misc_feature (65)..(174): Pfam Name: Cupin_1 Pfam Description: Cupin
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MAPKKLTTLLLAVVLLALAAPPVAGDPDMLQDICVADYKSLQGPLRVNGFPCKREANVTAEDFFFGGLAKAADVYSGNPMGSAVTAAEVETLPGLNTLGVSMARTDYAPWGGVNPPHAHPRATEILFVLEGTLEVGFVTAAAPSRLLSRTVSRGQVFVFPRGLVHIQRSVGAAP

SEQ ID NO: 27446 - DNA, 663 bp, Panicum virgatum
  misc_feature: Ceres CLONE 1877219
  misc_feature: Encodes the peptide sequence at SEQ ID NO. 27447
ggaatccctggtggataacataaaatttgatcatgggtatactgctaaaagtcctgcgattgtgaatctactcgatataatggcggaattcacccctgatcagcagcatgcgttctgccagtttgtaactggtgctcctcgccttccacccggtggtttggcagcccttagccccaagcttactattgttaggaagcacccttcaagtgcggtaaatacttcaaattcaactggggcgacagagtccgcagatgatgatttacctagtgtgatgacgtgtgctaattatctgaagttgcccccctactccacaaaagaaatcatgcgcaagaagttgctttatgcaatcctggaagggcgaggatcatttgatctttcataaataatatatatccaaactaacatacaggggtcaatttatgtcgcagaattagtttcttgattggtccctataacataggttgaggtactagccgctcagcagacagcttcaagggtgaaccagccccttgagtgcaccaacaagaacagaaagccgctctctctctcagtacatgtaataaaaaggaatcttttttgttccagaattggtacctttgctgtgtcgatccagaaacaaagaacctgtaaatgtgtgatgactgatttgataataaacgtggt

SEQ ID NO: 27447 - protein, 126 aa, Panicum virgatum
  misc_feature: Ceres CLONE 1877219
  misc_feature (1)..(126): Pfam Name: HECT Pfam Description: HECT-domain (ubiquitin-transferase)
ESLVDNIKFDHGYTAKSPAIVNLLDIMAEFTPDQQHAFCQFVTGAPRLPPGGLAALSPKLTIVRKHPSSAVNTSNSTGATESADDDLPSVMTCANYLKLPPYSTKEIMRKKLLYAILEGRGSFDLS

SEQ ID NO: 27448 - DNA, 1277 bp, Panicum virgatum
  misc_feature: Ceres CLONE 1877226
  misc_feature: Encodes the peptide sequence at SEQ ID NO. 27449
ggtgcttgctgtgatttattggcacgcacgggccaggaggaaaccaaccaaccactgcacgatcgatcccctcgtccttgggatcgaggaggaggtagcagtatggaggcgtcgtcgctgctgagcggcgggctcaactccggcgtggtgctgagcctgatcgccgtgctgtggacggtggtgtggcagaatctgcagcacctccagctgcagcagttcttcgggcgccacctgagccgccacgcgcggcggctggcggcgatggtggacccctacctgtcggtgaccatcgccgagtacgagggcggccggatgaagcgcagcgacgcgtacgaggaggtcaaggcctacctcagcgcggcctgctctcgcggcgtgcgccacctccgcgccgagggcgccaaggacgccgacaagctcgtgctcagcatggtcgacggcgaggaggtggccgacgagttcgagggcgccacggtctggtggtgggcctactccaagtcgccgcctcgcgccgacgccgccgcggcctggtggggcggcggcggcgcgcaggaggagcgccgcttctaccggctcttcttcctcgagcgccaccgcgagctcgtgctcgacacctacctcccgcgcgtccggcagcagggccgcgccgtcatggtcaagaaccgccagcggaagctcttcaccaacatctccacgcaccagtggagcgacggggggtacatgcggtcggcgtggagccacgtggtgttcgagcaccccaagacgttcgacaccctcgccatggacccggccaagaagaaggagatcacggacgacctcgacatgttcaagaacggcaaggactactacgcgcgcgtcggcaaggcgtggaagcgtgggtacctcctctacggcccgccggggacgggcaagtcggccatgatcgccgccatggccaactacctcgactacaacatctacgacatcgagctcacgtccgtgcactccaacacggacctccgcaagctcttcatcgagacgaccagcaagtccatcatcgtcatcgaggacatcgactgctcgctcgacctcaccggcgcgcgcaacaagaagaaagcccccgcggcggaggacgacaagaagggcggcgcggcggccggcgcaaacaaggccggcgtgcgatataataaggacacccctagcatggtgacactgtcgggcctgctcaacttcatcgacgggctgtggtctgcgtgcttcggctagcggatcatcctcttcacctccaaccacgtacg

SEQ ID NO: 27449 - protein, 380 aa, Panicum virgatum
  misc_feature: Ceres CLONE 1877226
  misc_feature: SWISSPROT Homolog: EC 3.6.4.3 Microtubule-severing ATPase
MEASSLLSGGLNSGVVLSLIAVLWTVVWQNLQHLQLQQFFGRHLSRHARRLAAMVDPYLSVTIAEYEGGRMKRSDAYEEVKAYLSAACSRGVRHLRAEGAKDADKLVLSMVDGEEVADEFEGATVWWWAYSKSPPRADAAAAWWGGGGAQEERRFYRLFFLERHRELVLDTYLPRVRQQGRAVMVKNRQRKLFTNISTHQWSDGGYMRSAWSHVVFEHPKTFDTLAMDPAKKKEITDDLDMFKNGKDYYARVGKAWKRGYLLYGPPGTGKSAMIAAMANYLDYNIYDIELTSVHSNTDLRKLFIETTSKSIIVIEDIDCSLDLTGARNKKKAPAAEDDKKGGAAAGANKAGVRYNKDTPSMVTLSGLLNFIDGLWSACFG

SEQ ID NO: 27450 - DNA, 657 bp, Panicum virgatum
  misc_feature: Ceres CLONE 1877254
  misc_feature: Encodes the peptide sequence at SEQ ID NO. 27451
atccggttccgccgcccgctcccagctcacgccaaaggcgacgacgtcatgttccgttccgcgccgcccgacccgcttcgagcttcgatcgggtaggtagctcggacggccggtcgcttccggtggccatggaggctgcgccggcggtggccatggagcgggagcgcttgacggccgagatggccttccgcgacccggacgggggcgagccggcgcccgtcatcgtgatcaagatccaccgccggctcccggacttcgtgcgtaacatcagggtcaagtgcgtccagctcgggatccgcgacggcggcagcccctcgtcggtgctgccgatgctctgcgtgcccgcgctcgccgccaccgcctactccttcggccgcctcgacgtcgtctactactcgatcaacctgctcacctgcgtggcctggctcggctgcgcggcgctgctgctcaacatctactagttcaagaggccgcggccggtgtagctcgtcgagttcgagtgctacgaggacgaggacctggactagatctgcgacgcggtgttcctggagatgaccgagagcaccggctgcttcaccgaggtggcgctcgacttccagaccaacatcaccacccgctccgcgctcgtcgacgagacgtacctgcccccgggtgtcc

SEQ ID NO: 27451 - protein, 110 aa, Panicum virgatum
  misc_feature: Ceres CLONE 1877254
  misc_feature: SWISSPROT Homolog: EC 2.3.1.119 Icosanoyl-CoA synthase
MEAAPAVAMERERLTAEMAFRDPDGGEPAPVIVIKIHRRLPDFVRNIRVKCVQLGIRDGGSPSSVLPMLCVPALAATAYSFGRLDVVYYSINLLTCVAWLGCAALLLNIY

SEQ ID NO: 27452 - DNA, 1717 bp, Panicum virgatum
  misc_feature: Ceres CLONE 1877308
  misc_feature: Encodes the peptide sequence at SEQ ID NO. 27453
gcgcgaataatatagcaggcagctggcagcggcagcgcccgagctcgatcagaccgcgtctcgtctgccggagcatggccgggcgcgaccgccgcggggccctgtcgccctcgtcgtccgggcggctcacgccggagcaggggcggcgctgggcgtggagccccgcatggtcgcgcccgctctccgaccgcggcaccaccagcaggggcagcagctcgtcgtcgtcctcatcttcatctttgaggtccctgttccgctccatcggggtctggttcacctcgctctcctcctcctccaccaccaccacgtcgtcggcctccaggaggcggcggatcaaggaggccgcgccggcggcggttgacgtgatcaagaagccgccgttgccggcgcagaccggggggaagccgtccgcccgcgggctctacgccggcagcggccggcagcagctgcgcccgtcgttccagagctccgtcttctccatggaggagatcctccgggccaccaacaacttctcgccggcgctcaagatcggccagggcggcttcggggccgtctacaagggcgtcctccccgacggcaccgtcgtcgccgtcaagcgcgccaagatgcggatgcagaaccctcacgtggacgtggagttccgcagcgaggtcaagatcatggcgcgcatcgagcaccagagcctggtgcgcttctacggctacctggagtgcggcgaggagcgcatcgtcgtcgtcgagtacgtccccaacggcaccctgcgggagcacctcgacaggtgccacgggcggttcctcgacttggggacgcgcctcgacatcgccatcgacgtcgcccacgccgtcacctacctgcacatgtactccgaccaccccgtcatccaccgcgacatcaagtcctccaacatcctcctcacccactcgctccgcgccaaggtcgccgacttcggcttcgcccgcctcggctccggcgccggcgccggcgaggccacgcacgtcaccacgcaggtcaagggcacggcggggtacctggacccggagtacctcaagacctgccagctcaccgaccgcagcgacgtctactccttcggcgtgctcctcgtcgagctcgcctccgcgcgccgccccatcgagaccaagcgcgacatcaaggagcgcctcaccgcgcgctgggccatggccaggttcatcggtggcaccgccgccgacgtgctcgacccgcacctcgcgcgcacgcccgccgcggagcgcgcgctggagatgctgctggagctcgccttccggtgcacggggcccgtcaggcaggacaggcccgccatgagagactgctgcagggcgctctgggccatcaggaagacatacagggacatgctcgccgccgccgacgtcacccccagcactccgaccgactcaccggcgccggcgacctctggaggacctgatgcctgcactgcatcatccaacgcaacaaacactattattgctactactaactgattggtttgactgacaataactctgctctgctctgctctgctgtaaatatagaccaaccagccaaacaattcttgttgcatttgttcttatcaattacattttactagctagcctagttgttcctggtcaatatatcgtgcacctagctagctaatgtcacttctcaagtgcctttcatacggctttacatctcgagaattcagatcaattgtgtgaatcct

SEQ ID NO: 27453 - protein, 473 aa, Panicum virgatum
  misc_feature: Ceres CLONE 1877308
  misc_feature (146)..(424): Pfam Name: Pkinase Pfam Description: Protein kinase domain
  misc_feature: SWISSPROT Homolog: EC 2.7.11.1 Non-specific serine/threonine protein kinase
MAGRDRRGALSPSSSGRLTPEQGRRWAWSPAWSRPLSDRGTTSRGSSSSSSSSSSLRSLFRSIGVWFTSLSSSSTTTTSSASRRRRIKEAAPAAVDVIKKPPLPAQTGGKPSARGLYAGSGRQQLRPSFQSSVFSMEEILRATNNFSPALKIGQGGFGAVYKGVLPDGTVVAVKRAKMRMQNPHVDVEFRSEVKIMARIEHQSLVRFYGYLECGEERIVVVEYVPNGTLREHLDRCHGRFLDLGTRLDIAIDVAHAVTYLHMYSDHPVIHRDIKSSNILLTHSLRAKVADFGFARLGSGAGAGEATHVTTQVKGTAGYLDPEYLKTCQLTDRSDVYSFGVLLVELASARRPIETKRDIKERLTARWAMARFIGGTAADVLDPHLARTPAAERALEMLLELAFRCTGPVRQDRPAMRDCCRALWAIRKTYRDMLAAADVTPSTPTDSPAPATSGGPDACTASSNATNTIIATTN

SEQ ID NO: 27454 - DNA, 1398 bp, Panicum virgatum
  misc_feature: Ceres CLONE 1877315
  misc_feature: Encodes the peptide sequence at SEQ ID NO. 27455
aagcacacaaccaaccaagcagcagaaaacatcttctgtccttcccctccgatccctccctcatcgagagtccagacgacccccacaagttccactccacgcagctgctagctagcgtttcgcaagtagtgtacggacgaggcaatggcggtgatggccgaagtgtccacgaccaccggcgcggcgctccgcagcccggcctcgccagcgccggcgccggtgaaggagggcgacgccgacaagctccggttcatcgaggagatgacctccgacgtggacgccgtgcaggagcgcgtcctggcggagatcctcgcccgcaacgccgacaccgagtacctcaccaattgcggcctcgccggcgccaccgaccgcgccaccttccgcgccaaggtgccgatggcgacgtacgaggacctgcagccgtacatccggcgcattgccgacggcgaccgctcgcccatcctgtccggacaccccgtctccgagttcctcaccagctccggcacgtccgccggcgagcgcaagctcatgcccaccatcgaggatgagctcaaccgccgccagctcctctacagcctccagatgcccgtcatgaacctgtatgtgcctgggatggacaaggggaaggctctccatttcctcttcgtcaagtcggagaccaggacgccgggcggcctcgcggcgcggccggtgctgaccagctactacaagagcaaccacttcaagaaccgcccgttcgatgcttacaacaactacacgagccccacggcggccatcctctgcgccgacgcgttccagagcatgtacgcgcagatggtgtgcggcctcgtccagcgccacgacgtgctgcgcgtcggcgccgtgttcgcgtccggtcgcctccgcgccatccgtttcctgcagctcaactgggagcagctcgccgcggacgtcgagaccggcgcgctcaccccgcgcgtcaccgacccgtcggtgcgcgaggccgtcgcgggcatcctccgcccggaccccgagctcgccgcggtgatccgcgccgagtgctccagcggcgactgggcgggcatcatcacccgcatttggcccagcaccaagtacctcgacgtcatcgtcaccggcgccatggcgcagtacatcccgacgctcaagtactacagcggcgggcttcccatggcgtgcaccatgtacgcgtcgtcggagtgctacttcggcctgaacctccggcccatgtgcgacccctcggaggtgtcctacaccctgatgcccaacatgtgctacttcgagttcctgcccatggacgccgccgcgtcgggcggcgacgcgagccagctggtggacctcgcccgcgtggagctcgggcgcgagtacgagctggtgatcaccacctacgccgggctgaac

SEQ ID NO: 27455 - protein, 417 aa, Panicum virgatum
  misc_feature: Ceres CLONE 1877315
  misc_feature (32)..(417): Pfam Name: GH3 Pfam Description: GH3 auxin-responsive promoter
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
MAVMAEVSTTTGAALRSPASPAPAPVKEGDADKLRFIEEMTSDVDAVQERVLAEILARNADTEYLTNCGLAGATDRATFRAKVPMATYEDLQPYIRRIADGDRSPILSGHPVSEFLTSSGTSAGERKLMPTIEDELNRRQLLYSLQMPVMNLYVPGMDKGKALHFLFVKSETRTPGGLAARPVLTSYYKSNHFKNRPFDAYNNYTSPTAAILCADAFQSMYAQMVCGLVQRHDVLRVGAVFASGRLRAIRFLQLNWEQLAADVETGALTPRVTDPSVREAVAGILRPDPELAAVIRAECSSGDWAGIITRIWPSTKYLDVIVTGAMAQYIPTLKYYSGGLPMACTMYASSECYFGLNLRPMCDPSEVSYTLMPNMCYFEFLPMDAAASGGDASQLVDLARVELGREYELVITTYAGL

SEQ ID NO: 27456 - DNA, 647 bp, Panicum virgatum
  misc_feature: Ceres CLONE 1877315-R
  misc_feature: Encodes the peptide sequence at SEQ ID NO. 27457
aagatctccgcctccgccgacggcgaggcggtggacagggagacgctggaccaatgctgcctccagatggaggaggcgctcaactcggtgtaccggcagagccgcgtggcggacggctccatcgggccgctggagatccgggtggtccggccgggcaccttcgaggagctcatggactacgccatctcccgcggcgcctccatcaaccagtacaaggtgccccgctgcgtgacgttcccgcccatcatcgagctgctggactcgcgcgtcgtgtccagccacttcagccccgggctgccgcactggacccccggccagcgcaacgacgactagaccggcggcgaggagctgggactctccggcgcgcttaattagactggaaccatctgctgcatccgatgtccttggttggcattgctcggtggcagaggtagcatgtccgtgctgcacctaaatatttgttaattttagaatttttgagtactgtcagttagtggcgtgagggtaacttggatgtgatgtgaagagaggtggctgagctgaccagctgaagcgagtagtcgatgcctgcaagagtcgcggattcttctagtagtggtactgttatccgtacgagtgcagtatgcggctagtttaaacgttcctcc

SEQ ID NO: 27457 - protein, 110 aa, Panicum virgatum
  misc_feature: Ceres CLONE 1877315-R
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
KISASADGEAVDRETLDQCCLQMEEALNSVYRQSRVADGSIGPLEIRVVRPGTFEELMDYAISRGASINQYKVPRCVTFPPIIELLDSRVVSSHFSPGLPHWTPGQRNDD

SEQ ID NO: 27458 - DNA, 616 bp, Panicum virgatum
  misc_feature: Ceres CLONE 1877326
  misc_feature: Encodes the peptide sequence at SEQ ID NO. 27459
atcgatagtagagcagagcagagcagagcagagcagagtcttcctcaacccatcctcgctcccctacaccaattcgttcagcgatctttcgtgcttggccctcctgcgctgcacatggcatcccccgccgccgccggagccgccgggcgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgcgccccgtctacgccgccatggacagcgcagggtacatcatgacctcggacgtgctggcgagcgtggagcggcacgccagcgccgtctcggcggcggccgtcgacaaggccaggcgcctctgcgccgagcacccgcacgtggcggtggagacgctggtggagagcggggacccgcgggacgtgatctgcgacgccgccgacaaggtgggcgccgacctgctcgtcatgggcagccatggatacggcttcttccagaggtatcagtcgtctaaattacagtacattactaggagtacaagcatcggcgaaagcgatgccatggccactggctggataaggatcggag

SEQ ID NO: 27459 - protein, 167 aa, Panicum virgatum
  misc_feature: Ceres CLONE 1877326
  misc_feature (11)..(162): Pfam Name: Usp Pfam Description: Universal stress protein family
MASPAAAGAAGRRIVVAVDEGEESAHALAWCLANVVSPAGGDTLVLVHARRPRPVYAAMDSAGYIMTSDVLASVERHASAVSAAAVDKARRLCAEHPHVAVETLVESGDPRDVICDAADKVGADLLVMGSHGYGFFQRYQSSKLQYITRSTSIGESDAMATGWIRIG

SEQ ID NO: 27460 - DNA, 2130 bp, Panicum virgatum
  misc_feature: Ceres CLONE 1877346
  misc_feature: Encodes the peptide sequence at SEQ ID NO. 27461
gactccaaccagcagaccgatcgagctcgctcgccttttgagaagaacaaacgcgtcctctctggtcttcttcccacttcgttccacaatcaccctatccacacgtacgtacgtacgagaaggagcacccgtgtcgtgactcgtgagccgccggtgcgacgacgtacgacacacccatggcgccgtccgaggactgcggctggctgctgtacctctccctggccgccaaatgcggcgacccccaccgcctgctcggcttcgccgcggtcttggccaccgccttcgtcgtcacggcgctgctgcactgggcgtcccccggcggccccgcgtggggccggtactggtggaccaggagggccggcctgggcattggcgccgccatcccggggccccgcgggctgccggtgctcggcagcatggggctcatgacgggcctggcgcaccggaagctcgcggcggcggctggcaaggcccggcgccgcctcatggccttctccctcggcgagacccgcgtcgtggtgaccgccgacccggacgtggcgcgggagctcctcgccagcgccaccttcgccgaccgccccgtgaaggagtccgcgtacgggctcctcttccaccgcgccatcggcttcgccccgcacggcgcctactggcgcgcgctccgccgcgtcgcgtccgcgcacctcttctcgccgcgccagatcgccgcctccgccgcgcagcgcgcggtgatcgcgcgccagatggtggacgccatgatgatggagcagggcgccgccgctccaggagtcgtgacggcgcggcggttcctgaagcgcgcgtcgctgcacagcgtgatgtggtcggtgttcgggcggaggtacgagctgctgcaggcggcggacggcggcgaggaggcggcggagctccagagcctggtggaccagggctacgacctcctcgggcagctcaactggtccgaccacctcccctggctcgcccgcttcgacctgcagaggacccgggccaggtgcgccgccctcgtcccccgggtcaaccgcttcgtcggccgcatcatcgacgagcaccgcgccgcccgcctccacctcggcggcgacggcgccgccgccgtcgtggacttcaccgacgtcctgctctccctgcagggcagcgacaggctctccgacgccgacatgatcgccgttctctgggagatgatctttcgaggcacggacacggtggcggttctgatggagtgggtgctggcccggctggtgctgcaccaggacgtgcagcgcagggtccaggaggagctggaccgggtggtcgggccggggcgggccgtgaccgagccggacggcgcctcgctcgcctacctccacgcggtcatcagggaggtgctgcgcctgcacccgccgggcccgctgctctcctgggcacgcctcgccacgtcggacgtccacgtcggcgggtacctcgtacccgcggggaccaccgccatggtgaacatgtgggccatcacccacgacccggccgtctggcccgacccggccgagttcaaacccgagaggttcgcggccggctcgccgggcgacgaggcgttcccggtgatgggctcggatctcaggctggcgcctttcgggtccggccggcgggtctgccccggcaagtcgctggcgatggccaccgtcgcgttctgggtcgccaccctcctgcacgagttcgagtggctgccggcgtcgtccgacgagccgccgcgtggcgtcgacctgtccgaggtgctgaggctgtcgtgcgagatggccgctccgctggaggcgaggctggtgccacgtcgcgcggtgtgatgacgtggcgccgatccaagtggcagtgggagtaccttctagtagtagagtaacataattaacgcgtgcacggtgggctgtgtaaaaaaaaatgtaaagtgtccatgctagtgctgctagtgtgccatgcatcaagccggtttgcttatgtgtgtacctgtaaacctgctatgtacctgcatgtataatagtatctgaaagtaagttaatgtaggtggagggtcggtagtgtacctgctgcatatatagaccttgagtgagacagccatatatatttatatatatcttttgcctagagctactagcc

SEQ ID NO: 27461 - protein, 548 aa, Panicum virgatum
  misc_feature: Ceres CLONE 1877346
  misc_feature (69)..(538): Pfam Name: p450 Pfam Description: Cytochrome P450
  misc_feature: SWISSPROT Homolog: EC 1.14.13.21 Flavonoid 3'-monooxygenase
  misc_feature: Functional homolog of the protein sequence given in SEQ ID NO 51217
  misc_feature: Useful for biocontainment applications
  misc_feature: Useful for making plants with modulated flowering time
  misc_feature: Useful for making plants with modulated nitrogen use efficiency
  misc_feature: Functional homolog of the protein sequence given in SEQ ID NO 51246
  misc_feature: Useful for making plants with modulated time to senescence
MAPSEDCGWLLYLSLAAKCGDPHRLLGFAAVLATAFVVTALLHWASPGGPAWGRYWWTRRAGLGIGAAIPGPRGLPVLGSMGLMTGLAHRKLAAAAGKARRRLMAFSLGETRVVVTADPDVARELLASATFADRPVKESAYGLLFHRAIGFAPHGAYWRALRRVASAHLFSPRQIAASAAQRAVIARQMVDAMMMEQGAAAPGVVTARRFLKRASLHSVMWSVFGRRYELLQAADGGEEAAELQSLVDQGYDLLGQLNWSDHLPWLARFDLQRTRARCAALVPRVNRFVGRIIDEHRAARLHLGGDGAAAVVDFTDVLLSLQGSDRLSDADMIAVLWEMIFRGTDTVAVLMEWVLARLVLHQDVQRRVQEELDRVVGPGRAVTEPDGASLAYLHAVIREVLRLHPPGPLLSWARLATSDVHVGGYLVPAGTTAMVNMWAITHDPAVWPDPAEFKPERFAAGSPGDEAFPVMGSDLRLAPFGSGRRVCPGKSLAMATVAFWVATLLHEFEWLPASSDEPPRGVDLSEVLRLSCEMAAPLEARLVPRRAV

SEQ ID NO: 27462 - DNA, 1806 bp, Panicum virgatum
  misc_feature: Ceres CLONE 1877347
  misc_feature: Encodes the peptide sequence at SEQ ID NO. 27463
tctcccgtttcgactcatctccagcggtcgtccccgactggtggcgccacagcagcgcggcccgcggcggctcaccgacgcaccgccgcccatccagccccacgcttccgtcgccccaggccccagccctagcaactcgcggcgccgcagcctgcggtctgcgggctgcggcctggccggccccggcggcgcctgccgtctagcacgggcacacggcgcagcacatcagcggggcgttgcagcctgggcggcgcgcgggactctcggctgacgcggtgcgggagcggcaagggcgggcgtggcgcgtggcgagtggcgaccgacgagggctcaccgagttagagggctcgattctgtaagcaggcggagaaacgcaatttcattatgctttggcaaaggagttctacgctatggcaacccgtatcctgttgcgtcaaaatctgagaaagttggcttcgtttgcactccagaacatatcccagaggcaactaatttcaccttgccctccaatcctcagatctactgctgtttcccctagcaaatgtttcagccccctttacctgtttggaaattcgtggactgtcagatgggctacctatggatcagtgaatctagttttgtctgatgatggcaagcctaggtttcagattgaggaggtggaaccctccaaaaagagaaggtatttgacaaagaagcgcttgaagcttcagagaaagcgggtaaagaaaaagaggaaagaggcaaataaaaatgatccacgacgcattagacccaagggaaagaagataaaacaaaaattccccacagctgaagctaggctcaaatataagattgacaaggccaaattaaaggaagctatgttggtcgagaagctaaagaagtatgaggttgccaaagctcaaggccctatggctaaaccagatgaccttagcggtgaggaaaagttttacttgaagaaggtttcacagaaaaagtcaaattatgtccctgttggaaggcgaggagtttttggaggcgtaattctgaacatgcatttgcattggaagaaacatgaaaccgtgaaggtcatatgtaagccctgcaaaccagggcaaatccaggaatatgcaaatgagatagctagattgagtggcggtatacctgttaacatcattggagatgacactatagtcttctaccgaggaaagaactatgttcagccagaagttatgtcacctgtcgatacattgtcaaagaaaaaggcacttgaaaaatcaaaatatgaacagtcgctggagacagttcggcgtttcattgcagtatctgaaaaggagcttgaactttattatcggcatgttgcactttatggaattccacaatcccagaaggctgttcttgtttgcggtgatgatagagaagcttctttgcttaaaatgggggaattggatcaagggaaggaccaatttccccatgtggctactgatcatttttctgattttcacatcagtgatgtttctgaatcagatgaagaagagacttctggtagtgaatacgatgttaatgacgatgacactgaggatatgatcaacatttctgaagacgcgatttctgatcatcgtgggttagccaacagaaagtgaagtgtgattaccttgtctgacataattacattgttgtctataaatttgcctcagacttagccacacattataccatggatgtttctcatcacttggattgaatgatgtcagtgttagactttggtgtacctaatcatcatcatattatgttgattattcattacagctagctagcccttctgttgtc

SEQ ID NO: 27463 - protein, 402 aa, Panicum virgatum
  misc_feature: Ceres CLONE 1877347
  misc_feature (173)..(257): Pfam Name: CRS1_YhbY Pfam Description: CRS1 / YhbY domain
MATRILLRQNLRKLASFALQNISQRQLISPCPPILRSTAVSPSKCFSPLYLFGNSWTVRWATYGSVNLVLSDDGKPRFQIEEVEPSKKRRYLTKKRLKLQRKRVKKKRKEANKNDPRRIRPKGKKIKQKFPTAEARLKYKIDKAKLKEAMLVEKLKKYEVAKAQGPMAKPDDLSGEEKFYLKKVSQKKSNYVPVGRRGVFGGVILNMHLHWKKHETVKVICKPCKPGQIQEYANEIARLSGGIPVNIIGDDTIVFYRGKNYVQPEVMSPVDTLSKKKALEKSKYEQSLETVRRFIAVSEKELELYYRHVALYGIPQSQKAVLVCGDDREASLLKMGELDQGKDQFPHVATDHFSDFHISDVSESDEEETSGSEYDVNDDDTEDMINISEDAISDHRGLANRK

SEQ ID NO: 27464 - DNA, 3395 bp, Panicum virgatum
  misc_feature: Ceres CLONE 1877374
  misc_feature: Encodes the peptide sequence at SEQ ID NO. 27465
acaaacgaaacacacacacacctaacagcgacgcaaatggctcaatcatatctcctgctgctcctcttcctgctagtgttcctcgcctccacctccagctcgcgatccatggtgcaggccaccgatcaagaaacactcctaacaatcaagaaagactggggcagcccatcggcactcagctcgtggaatccccagaacgcttcttcctactgcagctgggtaggggtcagctgcaacaagaatggccaagtgaccaagctatccttccccgatctcaacataatcaatccgatcccaacttccatttgcaccctcaagaacctgttgtacctagacctttcctacaacaatctcaccaaccagttcccgacggcgctctatggctgctcggctctcagcttcctcgacctgtccaacaatcacttctccggcgccctcccggctgacatcgacaaattgtcgtcggagatggagcacctcaacctgtcgtgcaatggcttcaccggcagtgtgccatcggcgattgccgcattccccaagttcaagtcccttgttcttgacacgaacagtttcaacgggacttacccgagctcggccatcgcagagctcagcgagctcgagacgttaactcttgcacataaccccttcgcgccaggccctatccctgacgagttcgccagcttgaagaagctgaagacgctctggatgtcagagatgaacctgactggcggcctccccgacgagctctcgccgctcactgagctgacgacgttggctctggacaacaacaagcttcacggtgaaatcccgtcgtgggtttggaagttccccaagctcgagctcctgtacctttatgcgaacagcttcaccggtgggattgggccagaggtcaccgccttcagcttgcagcagctcgacctgtcggcgaactggctcactggaccgataccggaggccatcggcgagatgaagaacttgacattgctcaacttgttctacaacaacctcaccgggctgattccggcgagcatcgggctgctcccgaacctcgtagacatccggctgttcaacaacaggctctccggccccctcccgccggagctcgggaagcactcgccgctcggcaaccttgaagtcagctacaactacctcaacggcacggtcccggacaccctctgcctcaacaagaagctctacgacatcgtgctgttcaacaatgagttctccggcgagctcccggcggccctgggggcgtgcgacacgctggacaacatcatgctgcagaacaacgacttctccggcgagttcccggaggaggtgtggtcggcgttccccaagctgaccaccgtgaagatacagaacaacggcttcaccggcactctgcccagcgtgatatcctccaacatcacacggatcgagatggggaacaatcggttctctggcgccctgccgtcctcggcaccggggctgaacaacttcatggcggagaacaaccggttctccggcgcgctgccggcaaacatgtcggggttcgccaacctcaccgatctgaacctcgcagggaaccagatttctggctcgattccaccttccatccgatcattgggaaggctgaattacctgaacctcagcagcaatctgatctccggtgggatcccggcggagatcggtctgctgccggtgctcaccttgcttgatctgtccaacaacgagctcgccggcgaaataccggaggagctgaacagcctcgtcctccatctcagcagcctcaatctctcttccaaccaactcaccggcaaggtccccgagtcgctgcagagcccggcattcgatgaggcgttcctcgggaaccaaggcctctgcgccacggtgaacctgaacctgaagattccggcgtgcctcggccacaaccagatgtcaaacggcctgatcatcctgttctcggtggtcgccggcgtcatcctcatgggcgccgtcgggtgcttcatcatccggcggaagacgcgccggcgcgacctgacgacgtggaaggtgacgccgttccgcaaggtggacttcaccgagagcgacatactcagcaagctccgcgaggagaacgtgatcggcagcggcggctccggcaaggtgtaccgcgtccacctcggcggcgcggtggtggccgtgaagaagctgtggagcaggggcaaggcggaggagaagctggacaaggagttcgactcggaggtgaggatcctgggcgacatccggcacaacaacatcgtcagcctcctctgctacatctccagcgaggacaccaagctgctggtgtacgagcacatggagaacggcagcctcgaccggtggctgcacccgcgggacccggccggcgccggcgccgcggcgtcgctggactggccgacgcggctggccatcgccatcgacgcggcgaggggcatgagctacatgcaccacgagtccgcgcagcccatcatgcaccgggacgtcaagtccagcaacatcctgctcgacccggccttccgcgcaaagatcgccgacttcgggctcgcccggatcctggtcaggtccggcgagccggagtccgtgtccgccgtcggcggcaccttcggctacatggctccagagtgtggacgcggcgtgaaggtgaacgagaaggtggacgtgtacagcttcggcgtggtgctgctggagctggcgacggggcgggtggcgaacgacgacggcgccgggtgctgcctggtggagtgggcgtggcggcggtacaaggccgggggcgctctgcacgacgtcgtggacaggggcatccgggaccgggccgtgcacgccagggacgcggtggccgtgttcctgctcggggtgatgtgcaccggggacgacgcgccgtcccggccgtccatgaagcaggtgctgcagcagctcctccagtacgaccgcacggccagcgtcgccggcgcgtgccgggacggcggcgacgacgtctcacgggcagagctccccaaggggaggaagaagggcgagcaaggtgccaggagagcgctggacagcggcggcgagttctgggatggtgacgaggagagcggcggcttcgtggcgcatcccgtttaacattaaggcgccggcgggcacacgctgttagatgagcctagcgtctgagttagttagatttgcatgtaatttttctgttagtcatgcgcatgaggaccggcctgtggttgccatgcgcatcatgcccgcgagaatagctcgcactagactcggacaaccggaggtgggcgcacatcgtggatgtggggatggacgcgtcgttagcgcagtgtgcggatcgccaccggagtcctttgctttgtgttcaataaaaggagaacaaaccagaaaacgctgcggttttgggcagcacc

SEQ ID NO: 27465 - protein, 1021 aa, Panicum virgatum
  misc_feature: Ceres CLONE 1877374
  misc_feature (683)..(960): Pfam Name: Pkinase Pfam Description: Protein kinase domain
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAQSYLLLLLFLLVFLASTSSSRSMVQATDQETLLTIKKDWGSPSALSSWNPQNASSYCSWVGVSCNKNGQVTKLSFPDLNIINPIPTSICTLKNLLYLDLSYNNLTNQFPTALYGCSALSFLDLSNNHFSGALPADIDKLSSEMEHLNLSCNGFTGSVPSAIAAFPKFKSLVLDTNSFNGTYPSSAIAELSELETLTLAHNPFAPGPIPDEFASLKKLKTLWMSEMNLTGGLPDELSPLTELTTLALDNNKLHGEIPSWVWKFPKLELLYLYANSFTGGIGPEVTAFSLQQLDLSANWLTGPIPEAIGEMKNLTLLNLFYNNLTGLIPASIGLLPNLVDIRLFNNRLSGPLPPELGKHSPLGNLEVSYNYLNGTVPDTLCLNKKLYDIVLFNNEFSGELPAALGACDTLDNIMLQNNDFSGEFPEEVWSAFPKLTTVKIQNNGFTGTLPSVISSNITRIEMGNNRFSGALPSSAPGLNNFMAENNRFSGALPANMSGFANLTDLNLAGNQISGSIPPSIRSLGRLNYLNLSSNLISGGIPAEIGLLPVLTLLDLSNNELAGEIPEELNSLVLHLSSLNLSSNQLTGKVPESLQSPAFDEAFLGNQGLCATVNLNLKIPACLGHNQMSNGLIILFSVVAGVILMGAVGCFIIRRKTRRRDLTTWKVTPFRKVDFTESDILSKLREENVIGSGGSGKVYRVHLGGAVVAVKKLWSRGKAEEKLDKEFDSEVRILGDIRHNNIVSLLCYISSEDTKLLVYEHMENGSLDRWLHPRDPAGAGAAASLDWPTRLAIAIDAARGMSYMHHESAQPIMHRDVKSSNILLDPAFRAKIADFGLARILVRSGEPESVSAVGGTFGYMAPECGRGVKVNEKVDVYSFGVVLLELATGRVANDDGAGCCLVEWAWRRYKAGGALHDVVDRGIRDRAVHARDAVAVFLLGVMCTGDDAPSRPSMKQVLQQLLQYDRTASVAGACRDGGDDVSRAELPKGRKKGEQGARRALDSGGEFWDGDEESGGFVAHPV

SEQ ID NO: 27466 - DNA, 1186 bp, Panicum virgatum
  misc_feature: Ceres CLONE 1877391
  misc_feature: Encodes the peptide sequence at SEQ ID NO. 27467
acaagtgccaagcggaggcgacggaccagacagagagaggcagggagctcaccgccgtcgcgataacccacccgtggctccacggattcgagctgccgccgccagccgtgggcacatctgaccaggcggggcggttgatcctcagaaggtcggggggaagatgacggtgggcgccgggatcgcggtccaggacgggagcctcgtggcgctgggggccaagatcctgcgggaggtgcgcggcaatgtgcacgtcacgccggccgccgggggcggcctcgccaacggcgccttcctcggcgtgcggtccgcgcccgccggcagccgcaccgtcttccccgtcgggaagctccgggaccaacggttcatgtgcactttccggttcaagatgtggtggatgacgcagaggatgggctcgtcaggccgtgacatccccttcgagacacagttcttgatcgtcgagggcactgatggaccgcagctcaccaacgatagcaccgagcaacctgtggtgtacactgtcttccttccgatattggaggggtcattccgtgctgttcttcaggggaacgctgatgatgagctggagatctgcttggagagtggtgatccagatgtggaatcctttgaaggcacccatctagttttcgtcagtgctggatcggatccatttgaagtgatcacaaattcaataaaagctgttgagaggcacttgcagacgttttctcacagggaaaagaaaaagatgccagacattctaaactggtttggttggtgcacatgggatgcattttacaccaacgttactgctgaaggagtgaaggagggattacagagctttcaaaaaggtggagtttctcctaagtttgtcataattgacgatggatggcaatcggtcgctatggatcctgtgggaattgcgtgcttagctgataactcagccaactttgcaaataggttgactcatattaaggagaaccacaagtttcagaaaaatgggaaggagggtcacagggaagatgatccagcaaaaggcctcgcgcatatcatcaatgcgattaaaggaaaacatgagctgaagtacgtgtatgtatggcatgcgattactggatactggggtggagtcaagccaggtgttgttggaatggagcactatgaatcgaagatgcagcaccctgtgtcatctccc

SEQ ID NO: 27467 - protein, 341 aa, Panicum virgatum
  misc_feature: Ceres CLONE 1877391
  misc_feature (7)..(341): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
MTVGAGIAVQDGSLVALGAKILREVRGNVHVTPAAGGGLANGAFLGVRSAPAGSRTVFPVGKLRDQRFMCTFRFKMWWMTQRMGSSGRDIPFETQFLIVEGTDGPQLTNDSTEQPVVYTVFLPILEGSFRAVLQGNADDELEICLESGDPDVESFEGTHLVFVSAGSDPFEVITNSIKAVERHLQTFSHREKKKMPDILNWFGWCTWDAFYTNVTAEGVKEGLQSFQKGGVSPKFVIIDDGWQSVAMDPVGIACLADNSANFANRLTHIKENHKFQKNGKEGHREDDPAKGLAHIINAIKGKHELKYVYVWHAITGYWGGVKPGVVGMEHYESKMQHPVSS

SEQ ID NO: 27468 - DNA, 678 bp, Panicum virgatum
  misc_feature: Ceres CLONE 1877391-R
ggctggtgccgggtagggaagaagaaccttgttcatgatgagcagcccggaactgtcaccggtgtcatccgggcacgggatgtggactaccttgcaaaggttgctgatcaaagctgggacggcgacgtgatcgtttattcgcacgtaggaggtaaatcatcacttttgctggattcttcatcttaactatctttcagattaatgacaagcaatctgctgtccattttttgaggagaggtggtctacctgccgaagaacgcctccttgcccgtgacgctgagatcacgcgagtacgaggtgttcaccgtcgtccctgtgaaacacctgccgagtggcgcctcctttgcgccgatcggcctgaccggaatgttcaactccggcggcgcggtgagggagctgggattcggcgaagacgtaggcgtcgagctcaaagtgcggggctcgggcacggtggcagcttactcgtcaacaaagccgaagagtgtagccgtcgattccatggtggttgatttctcgtacgacgatgcctgtggtctggtcacctttgagctcggcctccccaagcaagaactgtacctgtggaccgtttcggtagagtactgagattgatgtaatgagaaaagttcagatatgacttcctgagtatatctgtcaaaagtaaagagagaggcttcgtgg

SEQ ID NO: 27469 - DNA, 636 bp, Panicum virgatum
  misc_feature: Ceres CLONE 1877393
  misc_feature: Encodes the peptide sequence at SEQ ID NO. 27470
atcgatcgcgacccggcctctctcctccctccatcaccgtcaccagcggactcacaactccaaagccccagctccatcgccggcctcacctccgccccctggccgcaacaaaggaaatgcctcgtccctcagccagccaccaccgcctaccatagccacacctcccgcccggcagctagctaccttcaccaccttcacggctccgctgcattaccaccccaatgggtcgggctcttctcccccgccacctcgtcctcgtcctcctgctgctgctgctgcgcaccgccatcgccatcgcaaccacggccaccacccctcaagctggtgacgacgacgccctagccaggcaggccgcgatcctggtttccatcagggacgccttcgccgcgccgctcccgccgccgctgcgcgcgtgggcgctcgccaacagcgcctcgctctgcacctcgtgggccggcgtcgcgtgcggccccggcggccgccgcgccgtcgtctcggtcgacgtctccggctacaacctctccggcgcgctctcccccgccgtcggccgcctcgcgggcctcctcttcctctccgccgcggggaactgcttctctggcgcgctgccgccgaccctcgccggcctacccgagctgc

SEQ ID NO: 27470 - protein, 138 aa, Panicum virgatum
  misc_feature: Ceres CLONE 1877393
  misc_feature: SWISSPROT Homolog: EC 2.7.11.1 Non-specific serine/threonine protein kinase
MGRALLPRHLVLVLLLLLLRTAIAIATTATTPQAGDDDALARQAAILVSIRDAFAAPLPPPLRAWALANSASLCTSWAGVACGPGGRRAVVSVDVSGYNLSGALSPAVGRLAGLLFLSAAGNCFSGALPPTLAGLPEL

SEQ ID NO: 27471 - DNA, 1718 bp, Panicum virgatum
  misc_feature: Ceres CLONE 1877396
  misc_feature: Encodes the peptide sequence at SEQ ID NO. 27472
cagccagccaaaccaccggcggaagattgcaaggaaccatcatggcctcccctccgccgcggagcgagaagctgcgggtccttctcatccccttcttcaccaacagccacatcggccccttcgcggacctcgcctaacacctcgccgcggcccggccgggcgccgtcgaggccaccgtcgctgtcaccccggcgaacgtcctggtcctccggtcagcgctcgcccggcgcggccccggccgccacgccgaggtccaggtcgcgacgtacccgttcccgtccgtggacggcctcccaccgggggtggagaaccactccaccgtcagtgctgcggacgcgtggcgcatcgacgccgtcggcggcgacgagcggctgatgcgcccggggcacgagggcctcattagggactgctcgcccgacgtggtcgtctccgacatactcttccactggaacgccagcatcgccgatagtgtcggcgtgccgtgcgtcacgttccacgtcattggggcgttcccgatgctagccctgttcagtttgataggtgctggcgcgactgacggggtgctgactcttcccgagtatatgggaccggacattcagatcccagtaaccgagctgcctgaggaggtgaggagccggcgtcgaccagaggacgtccgcgccgagggagccaaattaagttcagctcacaatagctgcttcggtctcgtcgtgaacactttcttcgatttggaggacaggtactgtgacatgtacgtgcgtcacatgaaacgcacctactttgtcgggcctgtgtcactgccgccaccatcgcagctagccgccggcgacgatggctcagggtgcatcgagtggctggataggaagccagcccggtcggtcgtgtacttgtgcttcggcagcttggctcacgtatccaagcctcagcttcgcgagctcgccctcgggttagaagcctccgggaagccgttcttgtgggtggtcaggtcggaggcatgggtgccgccagaggggtgggaggagcgcgtcggggacagagggatggtcgtcacaaggtgggccccacagacggcgatccttgcacacccggcggtgggtgcgttcgtgacgcactgcgggtggaactcggttttggagacggtcgtggccggcgtgccggtgctgacgtggccgatggtgttcgagcagttcatcactgagaggttcgtgacgaaggtgctgaagataggcgaacgtctgtggccggagggtgccggcgtgaggagcacgaggtacgaagagcacgagctgatcccgagcgaggcagtggcacaagcggtgggcaggttcatggagcccggaggggtaggggacgccgcgaggagcagggtcaaggagctctccgcgaaggctcacgcggccatggaggagggtgggtcctcgcacggcgacctgcgccgcctgattgatgatctcatccaagaaagaacggctggcgcagggacgacagtatgatattctggttttagctcatgaagcgtgtctcatttttttttaagaataagtgtgtctcgtttatttgtctgttttcggtttggattttccactgtttggttagtaaggtccagtacatctaagcttggcatcaggtaacgtaccagcacgggtttaaacagctatcacatcttctttttagactatggaatgtaatgtcacggaataatatgcaatagattttct

SEQ ID NO: 27472 - protein, 372 aa, Panicum virgatum
  misc_feature: Ceres CLONE 1877396
  misc_feature: SWISSPROT Homolog: EC 2.4.1.238 Anthocyanin 3'-O-beta-glucosyltransferase
  misc_feature: Functional homolog of the protein sequence given in SEQ ID NO 51247
  misc_feature: Useful for making plants with altered carbohydrate content
MRPGHEGLIRDCSPDVVVSDILFHWNASIADSVGVPCVTFHVIGAFPMLALFSLIGAGATDGVLTLPEYMGPDIQIPVTELPEEVRSRRRPEDVRAEGAKLSSAHNSCFGLVVNTFFDLEDRYCDMYVRHMKRTYFVGPVSLPPPSQLAAGDDGSGCIEWLDRKPARSVVYLCFGSLAHVSKPQLRELALGLEASGKPFLWVVRSEAWVPPEGWEERVGDRGMVVTRWAPQTAILAHPAVGAFVTHCGWNSVLETVVAGVPVLTWPMVFEQFITERFVTKVLKIGERLWPEGAGVRSTRYEEHELIPSEAVAQAVGRFMEPGGVGDAARSRVKELSAKAHAAMEEGGSSHGDLRRLIDDLIQERTAGAGTTV

SEQ ID NO: 27473 - DNA, 1906 bp, Panicum virgatum
  misc_feature: Ceres CLONE 1877406
  misc_feature: Encodes the peptide sequence at SEQ ID NO. 27474
aacggaagccttcaaagcagagcgccaagagctatctgcgagcgcgcggcgcacacacaaagcagcaaaagctttgtcaaattaaagcccggccggcccctcgttgatcgacgacgcgcccgccatggagctcaacctcgtgtcgtgggcgtcgctcctcctcctcgcactctccgccgcgtacgtctactgcacgacgcggagccggtcgccgcagcggctgccgccgtcgccgccggggtggccggtgatcgggcacctgcacctgctgtccagcgggatgccgcaccacgtcatgaccgacctggcgcgggccatgcgggcgccgctgctccggctgcgcatgggcagcgtgcgcgccgtggtgatctccaagccggacctggcccgcgccgcgctcaccaccaacgacgccgcgctcgcgtcgcggccgcacctcctgtcgggccagttcctgtccttcggctgctccgacgtcacgttcgcgcccgcgggcgcctaccaccgcatggcgcgccgggtggtcgtctccgagctcctctcggcgcgccgggtggcgacctacggcgccgtccgggtcaaggagctccgccgcctcctcgcgcacctcaccaagaacacctccccggaccggcccctcgacctcagcgagtgcttcctcaacctggccaacgacgtgctctgccgcgtcgccttcggccgccgcttcccgcacggaaagggggacaagctcggcgccgtgctcgccgaggcgcaggacctcttcgccggcttcaccatcggagacttcttcccggagctcgagcccgtcgccagcaccgtcaccggcctccgccgcaggctcaagaactgcctggcggacctccgcgaggtctgcgacgagatcgtcgacgagcacctcagcggcaagcgcccgcacatccccggcgaccgcgacgaggacttcgtcgacgtcctcctccgagtccagaagtcccccgacctcgaggtcccactcaccgatgataacctcaaggccctcgtcctggacatgttcgttgccggcacggacacgacgttcgcgacgctggagtgggtgatgacggagctggtccgccacccgcgcatcctcaagaaggcgcaggacgaggtgcggcgcgtcgtcggcggcaagggccgcgtggaggaggcggacctcggcgagctccactacatgcgcgccatcatcaaggagacgttccgcctccacccggccgtgccgctgctggtgccgcgggagtccgtggccccctgcacgctcggcggctacgacatcccggccaagacccgcgtcttcatcaacaccttcgccatgggccgggacccggagatctgggagaacccgctcgagtactcgccggagcgcttcgagaacggcggcggcgagatcgacctcaaggacccggacttcaagctgctgccgttcggcggcggccggaggggctgccccggctacaccttcgctctggccaccgtgcaggtgtcgctggccagcctgctgtaccacttcgagtgggcgctgccggccggcgtgcgcgccgaggacgtcaacctcgacgagagcttcggcctcgccaccaggaagaaggagccgctggtcgtggtcgtcaggaagagcgaggggtacgagttcaagggggaggagctgagcgaggtttaagatcaattgttattaaatattatttggttcattgtttttgttcttattaattagtgcaattgtgcaaataagtgtcaagtcttgggagtggtcgccattaaccttttgtagagtagtcgcaggcaagggaccattacaaggaaccttgtaaaacaatttgatctattgtaacacttcggttggttggtgacctggtgggcaataaaaaagaccatttctttctttttt

SEQ ID NO: 27474 - protein, 517 aa, Panicum virgatum
  misc_feature: Ceres CLONE 1877406
  misc_feature (34)..(500): Pfam Name: p450 Pfam Description: Cytochrome P450
  misc_feature: SWISSPROT Homolog: EC 1.14.13.68 4-hydroxyphenylacetaldehyde oxime monooxygenase
MELNLVSWASLLLLALSAAYVYCTTRSRSPQRLPPSPPGWPVIGHLHLLSSGMPHHVMTDLARAMRAPLLRLRMGSVRAVVISKPDLARAALTTNDAALASRPHLLSGQFLSFGCSDVTFAPAGAYHRMARRVVVSELLSARRVATYGAVRVKELRRLLAHLTKNTSPDRPLDLSECFLNLANDVLCRVAFGRRFPHGKGDKLGAVLAEAQDLFAGFTIGDFFPELEPVASTVTGLRRRLKNCLADLREVCDEIVDEHLSGKRPHIPGDRDEDFVDVLLRVQKSPDLEVPLTDDNLKALVLDMFVAGTDTTFATLEWVMTELVRHPRILKKAQDEVRRVVGGKGRVEEADLGELHYMRAIIKETFRLHPAVPLLVPRESVAPCTLGGYDIPAKTRVFINTFAMGRDPEIWENPLEYSPERFENGGGEIDLKDPDFKLLPFGGGRRGCPGYTFALATVQVSLASLLYHFEWALPAGVRAEDVNLDESFGLATRKKEPLVVVVRKSEGYEFKGEELSEV

SEQ ID NO: 27475 - DNA, 742 bp, Panicum virgatum
  misc_feature: Ceres CLONE 1877412
  misc_feature: Encodes the peptide sequence at SEQ ID NO. 27476
ctccctccctcccctcgcctctcccacctcaatcctagacgccaccacacccatccatacacacacgccgcaggcgcgcgcctcccgcacaaaggaaaagaacgaggccatggcgccgagaacgtcggagaaaacgatggcaccggcggcggcggcgccggggctcgcgctcggcgtcggcccgcacttccgcggcgtcaggaagcgcccgtggggccggtacgcggcggagatccgcgacccggccaagaagagccgcgtgtggctcggcacgtacgacacggccgaggaggctgcgcgggcctacgacgccgccgcgcgagagtaccgcggcgccaaggccaagaccaacttcccctacccttcgtcgtcgcccatgcccccggcagccaccgccggcaccggcggcagccggagcggcgacagcagcaccgtggagtccttcggcggcgacgtgcaggcgcccatgcaggccatgccgctgccgccgtcgctcgagctggacctgttccacagcgcggcggccgcgggcgccggcgccggcgtgcgcttcccgttcggcagctaccccgtgacgcacccctactacttcttcggccaggccgccgcggccgccgccgcggggtgccacatgcagctgaagctgccgccgccgacggtgaccgtggcggccgtggcgcagagcgactccgactcctcgtcggtggtggacctgtcggcgccgccgctcgccggcgccgtg

SEQ ID NO: 27476 - protein, 210 aa, Panicum virgatum
  misc_feature: Ceres CLONE 1877412
  misc_feature (25)..(76): Pfam Name: AP2 Pfam Description: AP2 domain
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MAPRTSEKTMAPAAAAPGLALGVGPHFRGVRKRPWGRYAAEIRDPAKKSRVWLGTYDTAEEAARAYDAAAREYRGAKAKTNFPYPSSSPMPPAATAGTGGSRSGDSSTVESFGGDVQAPMQAMPLPPSLELDLFHSAAAAGAGAGVRFPFGSYPVTHPYYFFGQAAAAAAAGCHMQLKLPPPTVTVAAVAQSDSDSSSVVDLSAPPLAGA

SEQ ID NO: 27477 - DNA, 662 bp, Panicum virgatum
  misc_feature: Ceres CLONE 1877416
  misc_feature: Encodes the peptide sequence at SEQ ID NO. 27478
gcggacgtcttcgctctggttggaaggtttcgagaaactcccccgcccgaggagatcgggattcgggagcgaagaggatgatgggagggcgcccgctgctgctgctgctcgtctcggcgctgctcgttcagatccgcgcctccgacccgctgctgtacgagtcgttcgacgaggacttcgaggggaggtgggtcgtctccaagaaggacgagtaccaaggtgtatggaagcgtgccaagagtgatgggcacgaggactatggcctccttgttagtgagaaggccaggaaatatgccataatcaaggagcttgatgagccagttactttgaaggatgggacagtagtcctgcagtttgaagtgaggctccagaatggccttgagtgtggaggtgcctatattaagtacatccgccctcaggaggccggatgggatgccaaggagtttgataatgagaccccatacactatcatgtttggtccagacaagtgtgggtcaaccaacaaggtgcatttcatccttaagcacaagaaccccaagactggaaagtatgttgagcatcacctcaagttcccaccttctgtcccatatgacaagctctctcatgtctacacggctatcttgaagccagacaatgaggtgagaattttgatcgatggggag

SEQ ID NO: 27478 - protein, 194 aa, Panicum virgatum
  misc_feature: Ceres CLONE 1877416
  misc_feature (24)..(194): Pfam Name: Calreticulin Pfam Description: Calreticulin family
MMGGRPLLLLLVSALLVQIRASDPLLYESFDEDFEGRWVVSKKDEYQGVWKRAKSDGHEDYGLLVSEKARKYAIIKELDEPVTLKDGTVVLQFEVRLQNGLECGGAYIKYIRPQEAGWDAKEFDNETPYTIMFGPDKCGSTNKVHFILKHKNPKTGKYVEHHLKFPPSVPYDKLSHVYTAILKPDNEVRILIDG

SEQ ID NO: 27479 - DNA, 687 bp, Panicum virgatum
  misc_feature: Ceres CLONE 1877436
  misc_feature: Encodes the peptide sequence at SEQ ID NO. 27480
aaagccaatcaatcatacaagttgaagtagaagtaaccaaccaaggcaagaggcagctagcactctccactgtgtgagactccgtgaggccaccggcttgcgctcctgctctgcaccctccgcaccagctcagcaatcatgcctcgcccggccctcctccagggactcctggtcgccgccgcggtcctggccatggcggccgcgtcgccggcgaacagcgaggccgcggccggcgacttcatccgcaagtcgtgccgcgacacgcagtacccgtcggtgtgcgtgcagagcctggcgtcgtacggcgggtccccgccgccgcggagcccgcgggagctggcgcgcgcggcgctgtcggtgagcgcggaccgcgcgcgcgcggcgtcggcgtacgtggggcggctgtgcggcggcggcggcgcggcggcgaggaagggcgcgcggaagggcacggcgggcgcggtgcgcgactgcctggagaacctggcggacagcgtggggcacctccgcgacgcggcgcaggagatgggcggcgccgggatgggggggcgcgcggggtcggcggcgttcaagtggcacctgagcaacgtgcagacctggtgcagcgcggcgctcaccgacgagaacacctgcctggacgggctcgccggccgcggcgtggacgccaagacgcgcgccatccgcggc

SEQ ID NO: 27480 - protein, 164 aa, Panicum virgatum
  misc_feature: Ceres CLONE 1877436
  misc_feature (11)..(163): Pfam Name: PMEI Pfam Description: Plant invertase/pectin methylesterase inhibitor
  misc_feature: SWISSPROT Homolog: EC 3.1.1.11 Pectinesterase
MAAASPANSEAAAGDFIRKSCRDTQYPSVCVQSLASYGGSPPPRSPRELARAALSVSADRARAASAYVGRLCGGGGAAARKGARKGTAGAVRDCLENLADSVGHLRDAAQEMGGAGMGGRAGSAAFKWHLSNVQTWCSAALTDENTCLDGLAGRGVDAKTRAIR

SEQ ID NO: 27481 - DNA, 628 bp, Panicum virgatum
  misc_feature: Ceres CLONE 1877460
  misc_feature: Encodes the peptide sequence at SEQ ID NO. 27482
aaattctcagcacacgccgcatcgagacacggaaatggcggagcgcccgacctgaaccccccaaggcgagcgacaaacccacttctagaagcttctagatctcccgaaaggttgcggggaggggagcaagctctgggccctgggagtatggtttctctcggctgatggcgtccgccaagtcgtcgaggtcgcggcccgccggccactccggtgtgttcccggcgaacgcggcggccggcccggggggcagcgacggccgggtgcagctggcggacaacctcaagatattcaagaccgacaacttcgacccacacccctacctgcagaccatgtgccgcaccatggacgagaaggaaatcaggcacctgtgttcttatttgccagatctaaagaacgcttctgctgaagagatgcgcagaagtgtttatgcgaattatgctgcattcatcagaacatcaaaggagatatcagaccttgaaggggagctgttatctgttagaaatttgctaagtacccaatcagctttaattcatggtctctccgaacgacttcagatatattcattgagtacagggcttgaaggtcctgctgaccaagacatctccactgatgaagatcaggaaccatc

SEQ ID NO: 27482 - protein, 154 aa, Panicum virgatum
  misc_feature: Ceres CLONE 1877460
  misc_feature (42)..(128): Pfam Name: Vps51 Pfam Description: Vps51/Vps67
MASAKSSRSRPAGHSGVFPANAAAGPGGSDGRVQLADNLKIFKTDNFDPHPYLQTMCRTMDEKEIRHLCSYLPDLKNASAEEMRRSVYANYAAFIRTSKEISDLEGELLSVRNLLSTQSALIHGLSERLQIYSLSTGLEGPADQDISTDEDQEP

SEQ ID NO: 27483 - DNA, 1972 bp, Panicum virgatum
  misc_feature: Ceres CLONE 1877486
  misc_feature: Encodes the peptide sequence at SEQ ID NO. 27484
ggaccgcgaggccgcacgcctttcacactagatgggttgctgccgctcctcgctccggccgggggcgggagcgggggcggggacggggacccacgcggcggggaagccggccccccggcaccgcccgccgccgccgccaccgacgacgaaccgcccgtcccctaacgcgcaccgggccgcgccctcggcccgcgcgggcggcggcgggggtggggatgtcccggcgttcgcggagttctccctggcggacctccgcgcggccacgggcgggttcgcggccgggaacatcgtctccgagagcggcgagaaggcgcccaacctcgtctacaggggccagctcaagggcgccggcggcgcgccgccgcgcgcgattgccgtgaagaagttcgccaagctcgcgtggcccgaccccaagcagttcgcggaggaggccaagggcgtgggggccctgcgccaccggaggatggcgaacctcatcggctactgctgcgacggcgacgagcgcctgctcgtcgccgagttcatgcccaacgacaccctcgccaagcacctgtttcactgggaaaaccagactatagaatgggccatgcgtctgagagttgcatactacatctcccaagcgttggaatattgtagtatcaaggggaggcctttatatcatgacttaaatgcatacagggtcctctttgatgagaatggtgaccctcgtctgtcatgctttggtctaatgaaaaacagcagggatggcaaaagctatagcacgaacctagcttatacacctccagaatatctcagaaatggcagggttactccagaaagtgtcatattcagttttggcactgtacttctcgaccttctcagtggtaaacgtatacctccttcacatgcacttgatatcatgagaggcagaaacattgaatcagtaatggattcacatttggaggggaactactcgacagaggtggctactacactggtgaatcttgcttctcaatgtctacagtatgagccaagagatcgtcctgacataaaaaagttggtttccatactggagcctttgcagaagaaattagaggttccatcctatgtgatgcttggaattccaaagcctgtggaagaaccacatgtacctcctactccacagcgccctctttctcccatgggagaagcctgttccaggatggacctaactgccatccatcagatcctattcacgacacattacagagatgatgaagggtccaatgagctatcttttcaagaatggacacagcagatgagggatatgttggatgcaaggaaacgtggcgactttgcctttaaagacaaagattttaaggcagcaatcgattgttacagtcagtttgttgatgtggggacaatggtgtcaccaactgtgtttgccagacgaagcttgtgctaccttatgtgtgaccaacctgacgctgccctccgcgatgccatgcaagcacagatcgtctcccctgattggccaacagcattctacatgcaggcagttgcactatccaagctgaacatgcagagtgatgctgtggacatgctgaacgaggcttcagagctagaagagaaaaggcaaaagaccacaaagggtccttgagaagtgacatcccttatatataacatagattcacgctatgtagtaaatgccccaaccctttcccctgtagaaagtgcttagaatatatcgtggttaaatcttagatggttaatatttagatgttaggaaacctctgtggagaagaggctctcgacagaacagccttatggtcagaaaaaaactcatttggtttgtcgacatttccgtgataggttctgcatttttttgggcccatgtatataagatctgctgcatgagagtttgaaacttggtataggtcctggtcgttcaggtgggcccctgtagccgaagctaataaacatgtcttcatttgtgcaaaactgtttatctatg

SEQ ID NO: 27484 - protein, 528 aa, Panicum virgatum
  misc_feature: Ceres CLONE 1877486
  misc_feature (98)..(340): Pfam Name: Pkinase_Tyr Pfam Description: Protein tyrosine kinase
  misc_feature: SWISSPROT Homolog: EC 2.7.11.1 Non-specific serine/threonine protein kinase
MGCCRSSLRPGAGAGAGTGTHAAGKPAPRHRPPPPPPTTNRPSPNAHRAAPSARAGGGGGGDVPAFAEFSLADLRAATGGFAAGNIVSESGEKAPNLVYRGQLKGAGGAPPRAIAVKKFAKLAWPDPKQFAEEAKGVGALRHRRMANLIGYCCDGDERLLVAEFMPNDTLAKHLFHWENQTIEWAMRLRVAYYISQALEYCSIKGRPLYHDLNAYRVLFDENGDPRLSCFGLMKNSRDGKSYSTNLAYTPPEYLRNGRVTPESVIFSFGTVLLDLLSGKRIPPSHALDIMRGRNIESVMDSHLEGNYSTEVATTLVNLASQCLQYEPRDRPDIKKLVSILEPLQKKLEVPSYVMLGIPKPVEEPHVPPTPQRPLSPMGEACSRMDLTAIHQILFTTHYRDDEGSNELSFQEWTQQMRDMLDARKRGDFAFKDKDFKAAIDCYSQFVDVGTMVSPTVFARRSLCYLMCDQPDAALRDAMQAQIVSPDWPTAFYMQAVALSKLNMQSDAVDMLNEASELEEKRQKTTKGP

SEQ ID NO: 27485 - DNA, 2278 bp, Panicum virgatum
  misc_feature: Ceres CLONE 1877494
  misc_feature: Encodes the peptide sequence at SEQ ID NO. 27486
gagactgagactctgacctctcagtcaaagctactgctcggtgaagagggcgaggccttggagcactcgaggccttgtggagactgggaggggatcttctccgcttccagaggccaagatcgagcgtccacctcgtccgctcacctcgatccagcaatgcgtgcggccgccggaggtgccccgccgcgacgtgctggtggtatccgtgtccgcgccccactggttagcattgccattcagacttggttgatcaatgcatctgcaggtggagtctgtctcctgctactgcagggtagatggaggtcttaaaaccgttgtaagtgctaggaagtttgtccctggtgcaaagctgtgcatgcaacctgatatcataccaaacaagcgcaagtcaaggagctcgcgcaaggagaggtcccaaactcaatcaccactgctacctgggcttcctgatgaactggctatttcctgtctcatgcgggttgctcgggttgagcacccaaatatgcggttagtatgtaaacgatggaaccgacttttgtctgggaattattattattccttgcgtaagaaattcggcatggcagaagaatgggtttatgtcttcaaaagggaccgtgatcagaagctatcttggtatgcctttgatccagtaaaccagctctggaagtcattgcctccacttccaccagagtattcagaagctgttggctttggttgtgcggttctcaatggatgctacctgtacttatttggtggcaaagacccaatacatgggtctatgaggcgtgttgtattttacaacgctcggataaacaaatggctgcgagctccagatatgctgcaaaaacgacacttctttggttcttgtgtcataaacaactgtctttatgttgctggaggggagtgcgaagggatacaaagaactctgaggtctgctgaggtatatgatcctaacaggaatagatggtcttgtattgctgaaatgagcacaggaatggtgccctccattggagtagtacatgatggcaagtggttcctaaaaggtctcaattctcatcgccaggttgtaagtgaggtctatctgccagcatctaaaatgtggtcaaccaccggtaacgaaatggtcacagggtggaggaatccaagcatttccttcagaggctggctttactctactgattgccgtgatggttgtaagcttaaagtctataatagagagacaggatcatggacaagattcattgacaccagacaccacatcggaagctcacgagctctcgaagctgcagcctttgtctcccttaatggaaaactctgcattatccgtaataatatgagtatcacacttattgatatatcagacccaacaacggtcactgaggttgacagtgcgcgcatgtgggaggcttttgcacgaaaggggcagcacaggtctttcatggcaaacctgtggtcaaccatcacaggccctaatctgaagacagacattatgcattgccaagtgctccaagtttgagtttggccatatgtgaagcaaaaacataaacaaccctgaaaggctcagttagaagctgaattggttacatgaactgaagcaaagagaccagctttttcctcggtaaaattcactggttcgccctttggaatattctgattttggcacagttgcatcctatttgtcagataaggctccaagggattggggctgggggcccggaggaagaatctgccattgttcatgagaattaagggttgtactgcagctttgactccacaggttcagaagtgcaggaagcactgagaaatgaatgtctaagcctagagtaggaacgaagcatggcagagactatgactgaaggccccatggattgatacatagagctgttagttcagcttggtagaacgcggatcactaaaagcttccatggaatcgaaggttgtttaagaagtactccatgattttggtgagatctgctacagtagatgtatacagcaaaaaaaaagctgctgccatgccgtcatatattttcagaaaaggaaggataacgatcctcatcactgtactgtcaggcatggggactaatcttatgttcatgccttgaactcttcctgcctggttgtttgctgagaagctgtggaaaccgatcagtacctatttctgaaagaaatttccatagatattctctcctcttgagtttatgaataatgcaatcttgtaagaactcctaaaaggttgccctttgaactagagcaaatcaacactatgccattggatatc

SEQ ID NO: 27486 - protein, 420 aa, Panicum virgatum
  misc_feature: Ceres CLONE 1877494
  misc_feature (198)..(245): Pfam Name: Kelch_1 Pfam Description: Kelch motif
  misc_feature (59)..(106): Pfam Name: F-box Pfam Description: F-box domain
MHLQVESVSCYCRVDGGLKTVVSARKFVPGAKLCMQPDIIPNKRKSRSSRKERSQTQSPLLPGLPDELAISCLMRVARVEHPNMRLVCKRWNRLLSGNYYYSLRKKFGMAEEWVYVFKRDRDQKLSWYAFDPVNQLWKSLPPLPPEYSEAVGFGCAVLNGCYLYLFGGKDPIHGSMRRVVFYNARINKWLRAPDMLQKRHFFGSCVINNCLYVAGGECEGIQRTLRSAEVYDPNRNRWSCIAEMSTGMVPSIGVVHDGKWFLKGLNSHRQVVSEVYLPASKMWSTTGNEMVTGWRNPSISFRGWLYSTDCRDGCKLKVYNRETGSWTRFIDTRHHIGSSRALEAAAFVSLNGKLCIIRNNMSITLIDISDPTTVTEVDSARMWEAFARKGQHRSFMANLWSTITGPNLKTDIMHCQVLQV

SEQ ID NO: 27487 - DNA, 742 bp, Panicum virgatum
  misc_feature: Ceres CLONE 1877498
  misc_feature: Encodes the peptide sequence at SEQ ID NO. 27488
ttttcttgtatcagttgcttcgaggattgaaatacatacatacagcaaatgtatttcatcgagatctgaaaccaaaaaatattctggcaaatgctgattgcaagctcaaaatatgtgacttcggcctggccagagtagctttcaacgatactccaactgccatcttttggacagattatgttgcaactaggtggtaccgagcacctgagctgtgtggatcttttttctccaagtatacaccagcaatagatatatggagtattggctgtatatttgcagaactattaactggaaaacctcttttccctgggaaaaatgttgtacatcaactcgatataattacagatctcctgggaacaccttctccagaagcaatatctaggattcgaaatgagaaggctaggcgctacttgagcagtatgaggcggaaaaagcctataccgttcacacagaagttcccaaatgcggatccacttgcactaaatttgctggagcgaatgctagcttttgagccaaaagacaggccaagtgctgaagaggctcttgcttatccttatttcaagaatatagccaatgtggatagggagccttctgcacaggctgtcacaaagcttgaatttgagtttgagaggcggagagttacaaaggatgacataagggaactcatatatagagaaattcttgagtatcatcaaaagatgctgagagaatttcttgagggaaactgagtcagtggtttcat

SEQ ID NO: 27488 - protein, 241 aa, Panicum virgatum
  misc_feature: Ceres CLONE 1877498
  misc_feature (1)..(186): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
FLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSSMRRKKPIPFTQKFPNADPLALNLLERMLAFEPKDRPSAEEALAYPYFKNIANVDREPSAQAVTKLEFEFERRRVTKDDIRELIYREILEYHQKMLREFLEGN

SEQ ID NO: 27489 - DNA, 1816 bp, Panicum virgatum
  misc_feature: Ceres CLONE 1877506
  misc_feature: Encodes the peptide sequence at SEQ ID NO. 27490
accagcccaatgcggcggacgcagtgagcaagtgaggaagacatagcgcccgccgcagtgggcacgcccgcccgcccgcccgcgcactgctgccgctgcctgacctcgccagtcagccgttgctgggtggtggagaggagaggaggggaggggagccgggagggcggcggcgccatggcggggggaggaggaggagggcccgggccggggaaggtgaaagcggggagccggccgccgtgggtggggctggcggcggcggtgtgggtgcaggtggcggcggggagcgcctacgtgttcccgctctactcgcacgccgtcaaggaggcgctcgggtacgaccagaaggcgctcaccatgctcggcgtcggcaacgacgtcggcgagaacgtggggctcgtcccgggggtgctggccaaccgcctcccgccctggctcatcctcgtcatcggctccgcctgcgccttcttcggcttcggcacgctctgggtcgccgtcaccaagaccgtcgccatgccgtactgggtgttgtggatagctttatgtatcggcacaaacagcagtgcatggttgggcactgctgctcttgtgaccaacatgaggaatttccctctcagccgaggcactgttgctggtcttatcaagggttatgttgctgttagtgctgctgtctacacagaaacttttaatggaatgctagggaattcagccacaaatcttttgctgttgcttgccttggggatcccaacagcatgtattgtggtgatgtattttgttaggccttgcactccatcactggaagaggacaactcaacagaacacagccatttcatgtacacacaaatctcaagtgtggttctcggcgtataccttctggtagctacaatacttggtgatactttgaaactaagtcaggctgtcacataccttttgtttggtataatgatacttttgctccttgctccatttgcaataccaataaagatgacactttatccaaacaaacaaactaaggaaaagcccagcacccttgctccatcttattcaactgatagtctgtctggcgcggatccagagaactcagaaccacttctgggcagcgcctcagcaacacttggtacaagtgtccatgaatccgatgatagtactgatttggatgttctattggcagagggtgagggagcagtgaatttgaaaaagaaaagagggccaaggaggggagatgatttcacattccttgaagctttagtaaaagcagacttttggctactttttattgtatacttttgtggagttggcacaggagtcactgttctaaacaaccttgctcaagttggaatgtctgttggtgctaatgacacaactattttgctgtgcctttttggcttctgcaactttgttggccgaatccttggtggatctctctctgagtatttcgtaaggtcaaggatgctccctcgtcctttttggatgatgtgcacacaaataatcatggtagtaacctttctgctgtttgcaactggtcttcatagcttgatctatgtttcaactacactcctggggatatgctatggcgtccaattcgccgtcatgataccaactgtctcggagcttttcgggctgaaggacttcggcctgatgtacaacttcatgctgttggtgaatccgctcggtgcattctttttctcggctcttcttgctggctacatctatgacaaggaggcggcaaggcagcacccaggtgtgctggagccttcaaactgctataggcctgattgctttcagagtcaccttctatgtctgtggctattcgagtggc

SEQ ID NO: 27490 - protein, 547 aa, Panicum virgatum
  misc_feature: Ceres CLONE 1877506
  misc_feature (21)..(268): Pfam Name: Nodulin-like Pfam Description: Nodulin-like
MAGGGGGGPGPGKVKAGSRPPWVGLAAAVWVQVAAGSAYVFPLYSHAVKEALGYDQKALTMLGVGNDVGENVGLVPGVLANRLPPWLILVIGSACAFFGFGTLWVAVTKTVAMPYWVLWIALCIGTNSSAWLGTAALVTNMRNFPLSRGTVAGLIKGYVAVSAAVYTETFNGMLGNSATNLLLLLALGIPTACIVVMYFVRPCTPSLEEDNSTEHSHFMYTQISSVVLGVYLLVATILGDTLKLSQAVTYLLFGIMILLLLAPFAIPIKMTLYPNKQTKEKPSTLAPSYSTDSLSGADPENSEPLLGSASATLGTSVHESDDSTDLDVLLAEGEGAVNLKKKRGPRRGDDFTFLEALVKADFWLLFIVYFCGVGTGVTVLNNLAQVGMSVGANDTTILLCLFGFCNFVGRILGGSLSEYFVRSRMLPRPFWMMCTQIIMVVTFLLFATGLHSLIYVSTTLLGICYGVQFAVMIPTVSELFGLKDFGLMYNFMLLVNPLGAFFFSALLAGYIYDKEAARQHPGVLEPSNCYRPDCFQSHLLCLWLFEW

SEQ ID NO: 27491 - DNA, 653 bp, Panicum virgatum
  misc_feature: Ceres CLONE 1877529
  misc_feature: Encodes the peptide sequence at SEQ ID NO. 27492
atggtgctcttgtagccataaaggttcagcggccgaaccttctaccctctgtactgcgagacatatatattctacgtcttgggcttgctttcatacgaaaggtagccaaacgaagaagtaatatttctctctatgctgatgagttgggtagaggtttcgtcggcgagttggactacaatattgaagctgctaacgctaccaaatttctggaggttcattctaggtatccatttatgctagttcctaaggttctaaaacaacttactagaaagaaggttttaacaatggagtgggtgaccggtgagaaccccaaggagttgctttctttgactaaaggagtttctggaaaagttactgaagcttcagaaaagaagttggatgcaaaaactcaccttcttgacctggtcaataaaggtgtcgaggcatcattagtgcagcttcttgagacaggcttgttgcatgccgatcctcatcctggcaacttgcgttatactcctgaaggtcgtgttgggtttcttgattttggtctgctttgcatgatggagaggaaacatcagcgagctatgcttgcaagcatcatacacatagtaaatggagattgggcttcccttgtcctggatttgactgaaatggatgtagttccaccaaacacc

SEQ ID NO: 27492 - protein, 216 aa, Panicum virgatum
  misc_feature: Ceres CLONE 1877529
  misc_feature (1)..(84): Pfam Name: ABC1 Pfam Description: ABC1 family
GALVAIKVQRPNLLPSVLRDIYILRLGLAFIRKVAKRRSNISLYADELGRGFVGELDYNIEAANATKFLEVHSRYPFMLVPKVLKQLTRKKVLTMEWVTGENPKELLSLTKGVSGKVTEASEKKLDAKTHLLDLVNKGVEASLVQLLETGLLHADPHPGNLRYTPEGRVGFLDFGLLCMMERKHQRAMLASIIHIVNGDWASLVLDLTEMDVVPPN

SEQ ID NO: 27493 - DNA, 1472 bp, Panicum virgatum
  misc_feature: Ceres CLONE 1877537
  misc_feature: Encodes the peptide sequence at SEQ ID NO. 27494
gaaaaaagggtggcagttaccagtttaccaccagcctatctcctggcacacctcagagacagaggagcgctctccccccctcctccatccttccgcttccttctagaaccttccgcgcccctccgtcgcagcacagcgcttcctcctccgccttccaccccgagatggcgaccatggagaacgtgatcgtgctcgtcaaccgcatccagcgcgcctgcaccgtcctcggcgaccacggcggcggggacggcgccgcctccctccccaccctgtgggaagcgctcccgtccgtcgccgtcgtcggtggccagagttcggggaaatcatcggtgctggagagcatcgtggggcgagacttcctgccccgaggatcagggatcgtgacgcggaggccgctggtgctgcagcttcacaagacgcaggatggggcgcaagagtacgctgagttcctgcacctgcccaaacgccggttcactgatttctctcttgtgcggaaggaaattgaagatgaaactgacaggttgacaggaaagacaaagcagatatctcctgttccaattcacctcagcatatattctccacatgtggtcaacttgacattgattgatctgccgggtctaacaaaagttgctatagaggggcagcctgaaagcattgtccaggatataaaaaatatggtgtgctcatatgttgacaagccgaattgtattatactggctatatctcctgccaaccaagatatagcaacatcggatgccatcaagcttgctcgggatgttgatccaactggtgaaaggacatttggtgtgttgactaagcttgatttgatggacaagggaacaaatgcacttgatgttcttgaaggaagagcttacagactgcagcatccctgggttggaattgttaaccgttcgcaagcagatattaacaggaatgttgacatgattattgctaggagaaaagagcaagagttctttgcttctagccctgactattcacatctagccagcaggatgggttcagaatatcttgctaaacttctttcacagcaattagaggctgtgatcagagcacgcattccaagcataacatatttgataaacaaatcaattgatgagcttgaatctgagatggatcaccttggtagacctattgcctctgatgctggggctcaattgtacctcatcttggagctttgccgtgcatttgacaaaatatttaaggaacatcttgacggaggacgacctggtggtgatcgaatttatggggtttttgataatcaactcccttctgctctgcggaagcttccatttgaccgtcacctctctgtgcaaaatgttaagcggattgtatcacaagcagacggttatcagcctcatttaattgctcctgagcaagggtaccgtcgactgattgaatctgctctcaattattttagaggaccagctgaagcttctgtagatgctgtacat

SEQ ID NO: 27494 - protein, 435 aa, Panicum virgatum
  misc_feature: Ceres CLONE 1877537
  misc_feature (43)..(219): Pfam Name: Dynamin_N Pfam Description: Dynamin family
  misc_feature (228)..(435): Pfam Name: Dynamin_M Pfam Description: Dynamin central region
  misc_feature: SWISSPROT Homolog: EC 3.6.5.5 Dynamin GTPase
MATMENVIVLVNRIQRACTVLGDHGGGDGAASLPTLWEALPSVAVVGGQSSGKSSVLESIVGRDFLPRGSGIVTRRPLVLQLHKTQDGAQEYAEFLHLPKRRFTDFSLVRKEIEDETDRLTGKTKQISPVPIHLSIYSPHVVNLTLIDLPGLTKVAIEGQPESIVQDIKNMVCSYVDKPNCIILAISPANQDIATSDAIKLARDVDPTGERTFGVLTKLDLMDKGTNALDVLEGRAYRLQHPWVGIVNRSQADINRNVDMIIARRKEQEFFASSPDYSHLASRMGSEYLAKLLSQQLEAVIRARIPSITYLINKSIDELESEMDHLGRPIASDAGAQLYLILELCRAFDKIFKEHLDGGRPGGDRIYGVFDNQLPSALRKLPFDRHLSVQNVKRIVSQADGYQPHLIAPEQGYRRLIESALNYFRGPAEASVDAV

SEQ ID NO: 27495 - DNA, 524 bp, Panicum virgatum
  misc_feature: Ceres CLONE 1877537-R
  misc_feature: Encodes the peptide sequence at SEQ ID NO. 27496
tgttcactgtcaagtccgtgaagccaagcggtccatgcttaaccatttctacagtcaagtgggcaggaaagatgctaagcagcttgcagtactccttgatgaggatccagccctcatggagcgcaggctgcaatgcttcaaaaggcttgaactgtacaagtctgcacgtgatgagattgatgccgtggcatggacacgatgaaaggtaacatttggcatgctccttagtcaccttcctaattattagatgtgttgtgatacgacaaatgcagaattaactgccagctattctgcacttttgttgtgaaatcttagtagactgataacttgtatattagcctgttaatatcagttgggtgcttgtgtcatatctatgtctcagctctcaaccatgcttaggaagttagaatacagatctaatagtctttggtaacccatgtgcagacttgtatgcacgaatgggaatgaagtctatctgtgataccttgattctgtaggatgcatatgttgattcttaaccccct

SEQ ID NO: 27496 - protein, 66 aa, Panicum virgatum
  misc_feature: Ceres CLONE 1877537-R
  misc_feature (1)..(62): Pfam Name: GED Pfam Description: Dynamin GTPase effector domain
VHCQVREAKRSMLNHFYSQVGRKDAKQLAVLLDEDPALMERRLQCFKRLELYKSARDEIDAVAWTR

SEQ ID NO: 27497 - DNA, 730 bp, Panicum virgatum
  misc_feature: Ceres CLONE 1877560
  misc_feature: Encodes the peptide sequence at SEQ ID NO. 27498
atacaaacaccaagtagcgatcaatcattcaggagctcgtcaatcaccgccgctagcttctcctgctccacagccatggataaggcctacgtggccgtcctcaccttcgccttcctcttcgtgctccgctacctcgtgggccgtgtcagaggagggggtggcggcggcggcaagggacatggcgacgggaagggccatagaggcgggcagcggctgccgccgagccctccggccgtcccgttcctcggccatctccacctcgtcaagacgccgttccacgcggcgctggcgcggctcgccgcacgccacggcccggtgttctccatgcgcatggggtcccgccgcgccgtggtggtgtcctcgccggacgccgccagggagtgcttcacggagcacgacgtcgccttcgccaaccgcccgctcttcccctcgcagaagctcgtgtccttcggcggcaactccctctccatggccagctacgggccctactggcgcaacctccgccgcgtcgccgccgtgcagctcctctccgcgcaccgcgtcgcctgcatgtcccccgccatctccgccgaggtgcgcgccatggtgcgccgcatgaaccgcgccgccgcggccgcgcccgggggcgccgcgcgcgtccagctcaagcggaggctgttcgagctctccctcagcgtcctcatggagaccatcgcgcggaccaagacgtcccgcaccgaggccaacgccg

SEQ ID NO: 27498 - protein, 218 aa, Panicum virgatum
  misc_feature: Ceres CLONE 1877560
  misc_feature: SWISSPROT Homolog: EC 1.14.13.89 Isoflavone 2'-hydroxylase
MDKAYVAVLTFAFLFVLRYLVGRVRGGGGGGGKGHGDGKGHRGGQRLPPSPPAVPFLGHLHLVKTPFHAALARLAARHGPVFSMRMGSRRAVVVSSPDAARECFTEHDVAFANRPLFPSQKLVSFGGNSLSMASYGPYWRNLRRVAAVQLLSAHRVACMSPAISAEVRAMVRRMNRAAAAAPGGAARVQLKRRLFELSLSVLMETIARTKTSRTEANA

SEQ ID NO: 27499 - DNA, 399 bp, Panicum virgatum
  misc_feature: Ceres CLONE 1877570
  misc_feature: Encodes the peptide sequence at SEQ ID NO. 27500
agttatgctgcgcacgacaggagccctaccccctctccactgcatccgatactcgtgatcccaatcatggcaacccgctgcgttgccctggttcccctcgcggccggtctgctccaaaccctcctccccgcctcggcgggggagggtttggtgcgggtcttgctgaagaacccggccatcaaccagaacacccccgtcgcggagcgcctctccgcggaggacaagctgccccttctccgtggcggaaactcgctgggctcgagcgatgagggcgacatcatcgcgcttaagaaccacatgaacccccagcagtttggggagatcgtcgtcggcacgactgctgagagggtcaccgtcatcttctacacctgcagctccgatcagtgagtgccttcctcc

SEQ ID NO: 27500 - protein, 106 aa, Panicum virgatum
  misc_feature: Ceres CLONE 1877570
  misc_feature: SWISSPROT Homolog: EC 3.4.23.40 Phytepsin
MATRCVALVPLAAGLLQTLLPASAGEGLVRVLLKNPAINQNTPVAERLSAEDKLPLLRGGNSLGSSDEGDIIALKNHMNPQQFGEIVVGTTAERVTVIFYTCSSDQ

SEQ ID NO: 27501 - DNA, 1849 bp, Panicum virgatum
  misc_feature: Ceres CLONE 1877573
  misc_feature: Encodes the peptide sequence at SEQ ID NO. 27502
acgcctcctcctcatccctcgaacgcgcagcggcgcagatcacgccggcgcttgcctgtagaaaacgaccatggcggtggctgcggtcgtggtggtgctcatgctcgcgctggccatggcgccgggtgcggccagcggcgcgccacggaggagcccgcggccggaggccgacctcgtgaccgggctgcccgggcagccggcggtcgggttcaggcattacgccggctacgtcgacgtcggctcgggcggcggcggcaaggcgctcttctactggttcttcgaggccgagcgggagccggagaagaagccgctcttgctctggctcaacggaggtcctgggtgctcctctgtcgcctacggcgccgcccaggagctgggcccgttcctcgtaaggagctacggcgccaacctcacccgcaacgcctacgcgtggaacaaagccgtcaacctgctgttcctggaggcgccggtgggcgtggggttctcctacgcgaaccggacggcggacctgcggcggctcggcgaccgcgtgacggcgcaggactcgtacggcttcctcctcagctggctcgacaggttccccgagttcaagagccgcgacttctacatcgccggagagagctacgctgggcattatgtcccgcagctcgcggagctcatctacgacgggaacaaaggagccaaccgggacagggtcatcaacatcaaaggtttcatgatcgggaacgcggtgctcaacgacgcgacggaccagctgggcatggtggagtacgcgtggagccacgccatcatctccgacgagctctactcggcggtgcgccgcgagtgcgactccttcaaggaggaggccgacggcgggcgccccggcaagggctgctccccggcgctccgcgccttcctgggcgcctacgacgacatcgacatctacagcatctacacgccgacgtgcctcctgcccgccaccggcgccggcaccagcgccgcccctcggcgcccggccgcgaggctcgtcgccgcgccgcgcctcttctccgagcacgaggcgtggcacaggctgaagcgtgtgccggcgggatacgacccatgcacggaggcgtacgtgaccaagtacttcaaccgcgaggacgtgcagcgcgcgctccacgccaaccggacaggcctgccctacccgtactcgccctgcagcgaggtgatcaggaaatggaacgactcgccggccaccatcctgcccatcctcaagaagctcatggccgccgggctgcgcgtctgggtctacagcggcgacacggacgggcgggtgccggtgacgtcgacgcggtacagcatcaacgccatggggctgcggccgcggcagagggcggcgaaccggtccgccgccgcggccggcgtggcgacggagcggtagggcgggtggcgggcgtggtactaccggcagcaggtggccgggtgggcggtggagtacgaggaggggctcacgctggtgacggtgcgcggcgcgggccaccaggtgccgctcttcgcgccggcccgctcgctcgccatgctctaccacttcctccggggccaggccctgccggccgagcgctccagctagccggccgagctctgctgctccctcggcctcgctcgctgctcaagtaattgatcgttttgcttgcttagctaaaagctagagcttgactgggtaggtgaatgctatggcgctgtgttgcgtgaatgtactccctgcgatggggaggcagatgtaaacgttccgtggaaatgggaattgtgtaccccttaacacatgcaacaagccccatctagatctagttgatgaaatatactgcaagctggctgcgtaccaagt

SEQ ID NO: 27502 - protein, 444 aa, Panicum virgatum
  misc_feature: Ceres CLONE 1877573
  misc_feature (40)..(439): Pfam Name: Peptidase_S10 Pfam Description: Serine carboxypeptidase
  misc_feature: SWISSPROT Homolog: EC 3.4.16.6 Carboxypeptidase D
MAVAAVVVVLMLALAMAPGAASGAPRRSPRPEADLVTGLPGQPAVGFRHYAGYVDVGSGGGGKALFYWFFEAEREPEKKPLLLWLNGGPGCSSVAYGAAQELGPFLVRSYGANLTRNAYAWNKAVNLLFLEAPVGVGFSYANRTADLRRLGDRVTAQDSYGFLLSWLDRFPEFKSRDFYIAGESYAGHYVPQLAELIYDGNKGANRDRVINIKGFMIGNAVLNDATDQLGMVEYAWSHAIISDELYSAVRRECDSFKEEADGGRPGKGCSPALRAFLGAYDDIDIYSIYTPTCLLPATGAGTSAAPRRPAARLVAAPRLFSEHEAWHRLKRVPAGYDPCTEAYVTKYFNREDVQRALHANRTGLPYPYSPCSEVIRKWNDSPATILPILKKLMAAGLRVWVYSGDTDGRVPVTSTRYSINAMGLRPRQRAANRSAAAAGVATER

SEQ ID NO: 27503 - DNA, 687 bp, Panicum virgatum
  misc_feature: Ceres CLONE 1877619
  misc_feature: Encodes the peptide sequence at SEQ ID NO. 27504
caacaacttctccggcgagctccccgctgacgctttcaccgggttgcagcagctcaaggtgctctccctctccttcaaccacttcaacggcaccatcccggactccttggccgcgctgccggagctcgacgtgctcgacctcagctccaacgccttctccggcaccatcccttcatccctctgccaagaccccaactccagcctccgcatgctgtacctccagaacaactacctctccggggcgatcccggagtcaatcaccaactgcaccaggctcaagtctctcgacctcagcctcaacaacatcaacggcaccatccctgcatccctcggaaagctcggtgagctccgggacctcatcctatggcagaacttattggagggcgagataccggcgtccctggaaaatatgcacaagctcgagcatctgatcctcgactacaacgggctcactggtacaatcccgccggaactggccaagtgcaaggagctcaactggatatccctggcgagcaacctgctgtccggctcgatcccttcttggcttgggcagctcagtaacttggccatcttgaagctgagcaacaattccttctcgggaccaataccggctgagcttggcgactgccagagcttggtgtggctggaccctgacagcaaccagctcaatgggtcgatacctgcgga

SEQ ID NO: 27504 - protein, 228 aa, Panicum virgatum
  misc_feature: Ceres CLONE 1877619
  misc_feature: SWISSPROT Homolog: EC 2.7.11.1 Non-specific serine/threonine protein kinase
  misc_feature: The sequence is a functional homolog of SEQ ID NO 2 in US patent 7135625
NNFSGELPADAFTGLQQLKVLSLSFNHFNGTIPDSLAALPELDVLDLSSNAFSGTIPSSLCQDPNSSLRMLYLQNNYLSGAIPESITNCTRLKSLDLSLNNINGTIPASLGKLGELRDLILWQNLLEGEIPASLENMHKLEHLILDYNGLTGTIPPELAKCKELNWISLASNLLSGSIPSWLGQLSNLAILKLSNNSFSGPIPAELGDCQSLVWLDPDSNQLNGSIPA

SEQ ID NO: 27505 - DNA, 589 bp, Panicum virgatum
  misc_feature: Ceres CLONE 1877621
  misc_feature: Encodes the peptide sequence at SEQ ID NO. 27506
aaccgtcggaccccaagccgcccagctcccgaatctccgcccaatggaggacccgcccccgcctccgcctcctccgccggagcccgagcccgcggccgcctccccgcggcgcgacgcggagccgtctcctccccttcagccgccgccgcggcggaggctgctgcggctgcgctgcgcggtgcagcactacgagtggggccggcgcggggacgcctccctcgtcgcgcgcctcgccgcccgggaccccgacccttcgcgcccctacgccgagctctggatgggcacgcacccctcgggcccctccacgctcctcgacggcggcgagctcctccgggactggctcgcgcggaaccccgacgcgctcggccccgccgtcgccgcgcggtggggcggcgacctcccattcctcttcgaggtgctgtcggtggccaaggcgctctcgatccaggcgcacccggacaagaagctcgccgaggtgttgcgcgcgctgcggccttcctcctacaaggacgacaaccacaagccggagatggccatcgccatcaccgagttccgggcgctttgcggctttgcgaccatgtgaggagct

SEQ ID NO: 27506 - protein, 179 aa, Panicum virgatum
  misc_feature: Ceres CLONE 1877621
  misc_feature (39)..(179): Pfam Name: PMI_typeI Pfam Description: Phosphomannose isomerase type I
  misc_feature: SWISSPROT Homolog: EC 5.3.1.8 Mannose-6-phosphate isomerase
MEDPPPPPPPPPEPEPAAASPRRDAEPSPPLQPPPRRRLLRLRCAVQHYEWGRRGDASLVARLAARDPDPSRPYAELWMGTHPSGPSTLLDGGELLRDWLARNPDALGPAVAARWGGDLPFLFEVLSVAKALSIQAHPDKKLAEVLRALRPSSYKDDNHKPEMAIAITEFRALCGFATM

SEQ ID NO: 27507 - DNA, 2062 bp, Panicum virgatum
  misc_feature: Ceres CLONE 1877627
  misc_feature: Encodes the peptide sequence at SEQ ID NO. 27508
gcgccgccggccgttctcctccgatcctcctccgtccctcccccacctccgcccgccaaaccgctccttctgctcggctgttgcttgcttccagcatcaccggagcggagcacgcaaagcaaccgacgcggcccagcaggagcagcggaggagcggtgaccatgaggtgggccgcgttcctgtgggacagcgcgtccggctccggcgcccgccgccgccccggcgtctccaacctcctcctcgtcgtcgccgccgcgagtagtggaggcctcgtcgcgtatgcggactctggatcagatgctgctgttgagaagtcccagcttcctcagaggaaaaaagttgtggtgcttgggactggttggggcggcaccacattcctgaggaatctcgacagcagattgtatgatgtgcaggtcatatctcctcggaactactttgcttttacgccgttgctcccaagtgtcacatctggaacagttgagccaaggagcattgttgagccaattcgtaggattttggagaagaaaggtggagaaatcaaattttgggaagcagagtgcttcaagattgatccgcagaacaagaaaatccattgccgctcgaatattgggacaaatcttgatgggaatggcgagttcttggctgactacgactatcttgtggtagctgtcggagctaggacgaatacattcaatactcctggtgtggtcgagaattgtcacttcttgaaggaagttgaggatgctcaaaagatccggcggagtgtgatggactgcttcgagagggcaagcctccccttcctggatgaagaagagaggaagaagaaccttcattttgttgttgtcggtggtggacctactggagtggaatttgcagcatctttgcatgattttgttactgaagatttatccaagctttatccctcaattcagcaccttgtcaagatatcattgatcgaagctgctgatcacatattgaccatgtttgacaagaggataactaactttgctgaggataagtttggaagggatggcattgatgtaaaaactggatacaaagttgtgaaggtctctaaggatacgattaccatgcaaaatcctgcaactgggaacatctcagttccttatggaatggctgtctggtcgactggtattggaactcgtccattcattgtggaattcatgaaacaaattggccaggggaataggcgtgtcttagccactgatgagtggctaagggtccgtgaatgtgatggtgtctatgcaattggtgattgtgctacaataaaccagaggagagtaatggaagatattgcagcaatattcaaagttgcagataaagataagtctggamccttgactgtcaaagagattcaagatgtgttggatgatatttacgttagatacccacaagtgcagctctaccttaagagcaagcaaatgaatggtattgccgatttagtgaggagtgccaaaggagatgctgagaaggaatctgtggagctgaatatcgaagaattcaagaaggctctttcactggtggactcgcaagtcaaattcctacctgcaactgctcaggtggcttcgcagcaaggacaatatcttgctacgtgttttaacaagatgaaggatgctgaagaacatcctgaaggccctatccgcatcaggggagaaggccgccatcgcttccgtcctttcaggtaccggcatctgggccaatttgctccactaggaggtgagcaaactgccgcacagctccccggagactggatctccattggccacagcactcagtggctctggtactccgtgtatgcaaccaaacaaatcagctggcgcacgaggatgctggtggtatctgactggacacgccgattcatctttggaagagactcgagctgcatatagtcaagaaggaaactgaatttttttgctgtgacataatcagatgatcagggccaatagagctcatcccactataagttttgaatcacataaaagttctttttgtttttggttgagggaagaatgaaagttcccttgcacttgtatagtgcaccacg

SEQ ID NO: 27508 - protein, 581 aa, Panicum virgatum
  misc_feature: Ceres CLONE 1877627
  misc_feature (59)..(377): Pfam Name: Pyr_redox_2 Pfam Description: Pyridine nucleotide-disulphide oxidoreductase
  misc_feature (224)..(330): Pfam Name: Pyr_redox Pfam Description: Pyridine nucleotide-disulphide oxidoreductase
  misc_feature (383)..(411): Pfam Name: efhand Pfam Description: EF hand
  misc_feature: SWISSPROT Homolog: EC 1.6.5.3 NADH dehydrogenase (ubiquinone)
  misc_feature (398)..(398): Xaa is any aa, unknown, or other
MRWAAFLWDSASGSGARRRPGVSNLLLVVAAASSGGLVAYADSGSDAAVEKSQLPQRKKVVVLGTGWGGTTFLRNLDSRLYDVQVISPRNYFAFTPLLPSVTSGTVEPRSIVEPIRRILEKKGGEIKFWEAECFKIDPQNKKIHCRSNIGTNLDGNGEFLADYDYLVVAVGARTNTFNTPGVVENCHFLKEVEDAQKIRRSVMDCFERASLPFLDEEERKKNLHFVVVGGGPTGVEFAASLHDFVTEDLSKLYPSIQHLVKISLIEAADHILTMFDKRITNFAEDKFGRDGIDVKTGYKVVKVSKDTITMQNPATGNISVPYGMAVWSTGIGTRPFIVEFMKQIGQGNRRVLATDEWLRVRECDGVYAIGDCATINQRRVMEDIAAIFKVADKDKSGXLTVKEIQDVLDDIYVRYPQVQLYLKSKQMNGIADLVRSAKGDAEKESVELNIEEFKKALSLVDSQVKFLPATAQVASQQGQYLATCFNKMKDAEEHPEGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 27509 - DNA, 1802 bp, Panicum virgatum
  misc_feature: Ceres CLONE 1877651
  misc_feature: Encodes the peptide sequence at SEQ ID NO. 27510
aagaaatttaccagtaccacgcgacgccattgattgaacaaggagaggcaagggaggacacagaggaaaagggtaacgcgcggccggatctgcggtggctgcgctcgccggcggggaagagggggacgcgggcggcgagcctccagcctttcttcacctccgtgctctccggatcttcggccagggcaaggacgaggaagagatggccacgcgcaaccgcaacgccgccgccggcgccggcgctgctccgcggcctcaccatcacaaccgaggtggtgttcccgctcccgctctgggaaagcagaaggccgtcgcggccggccgagctgacgccatgaaccgccgagcccccctgggcgacatcggcaacttcgtcagcatcggcgcggccgaagggaagctgccggtcaaccgcccgatcacgaggagcttcgctgctcaactagtgaaaaacgcgcaggcgaacgccgccgcaatcaagcagaatgtggcaatcccacctgcgaggcctgcgccgaggctggagaggaaggctccttccaagcctcctcctcctgagaatgtcatagagatcagctccgactctgacaagagcaggaagtccgagagcagcgccagctccgtccgctcgaggaagaaggtcatcaacacccttacttctgttctctcggctcgctcaaaggctgcctgtggaatcactgataagcctcgagaagtgattgaagacatcgacaagttggacgtcaacaatcagctcgcggtcgtggaatatgttgaggacatctacaccttctacaagactgccgagcgtgagagccggccatgtgactacattgcagcccaggtggagatcaacccacacatgagggctatcgtgaccgattggataattgaagtacaccagaagtttgaactgatgcccgagactctctacttgactatgtacatcatcgatctatacctctcattgcaaccagtcctgagaagggagctacagcttgtgggcgtttcagccatgctgatcgcctgcaaatacgaagagatttgggcccccgaggtgtatgagctcatcctgatagcagatagtgcatacagtagagagcagattctttcaatggagaagggaatactaaataggctggagtggaacttaactgttcctacatcatacatgttcctcgttcgctttatcaaggccgcatgttcgggtatcaaaactgacaaagagatggagaacatggtcttcttcttcgcggagttatcactgatgcaatatggcttggtgacgcacttgccttcaatggttgctgcctctgctgtctatgcggcaaggctcactctcaagagggctccactttggactgacaccctcaagcaccacacaggcttcagagagtcagagctaatggaatgcacaaaaatgctcgtgagcgcacatgtgatggcaccggagagcaagttgagggtcgtctacaataagtattccagcgagcagtatggaggggtcgcactacgtccaccggcaaaggagatatgcaaataaacgaagacaactttgtcttgcctttcgctttcgagagtctgacattcgctaggatttatgctttgtttggagtcaagaaagtttgaacacttgagataggatttgaacacttgtttgctgggctgttatcatggaggagtcaggaatgtgttatctgacttgtattggcaattaggattcggatgttctgctactatctaatgcatacatcttggtgtatattcctgttgtcagaatttatcaatagcaagttattcat

SEQ ID NO: 27510 - protein, 402 aa, Panicum virgatum
  misc_feature: Ceres CLONE 1877651
  misc_feature (149)..(274): Pfam Name: Cyclin_N Pfam Description: Cyclin, N-terminal domain
  misc_feature (276)..(401): Pfam Name: Cyclin_C Pfam Description: Cyclin, C-terminal domain
MNRRAPLGDIGNFVSIGAAEGKLPVNRPITRSFAAQLVKNAQANAAAIKQNVAIPPARPAPRLERKAPSKPPPPENVIEISSDSDKSRKSESSASSVRSRKKVINTLTSVLSARSKAACGITDKPREVIEDIDKLDVNNQLAVVEYVEDIYTFYKTAERESRPCDYIAAQVEINPHMRAIVTDWIIEVHQKFELMPETLYLTMYIIDLYLSLQPVLRRELQLVGVSAMLIACKYEEIWAPEVYELILIADSAYSREQILSMEKGILNRLEWNLTVPTSYMFLVRFIKAACSGIKTDKEMENMVFFFAELSLMQYGLVTHLPSMVAASAVYAARLTLKRAPLWTDTLKHHTGFRESELMECTKMLVSAHVMAPESKLRVVYNKYSSEQYGGVALRPPAKEICK

SEQ ID NO: 27511 - DNA, 641 bp, Panicum virgatum
  misc_feature: Ceres CLONE 1877696
  misc_feature: Encodes the peptide sequence at SEQ ID NO. 27512
aactttcccttctcctacccacattccatacacctcccagtccgcaacagaagcggtgcacgaaatggcacagcgtgtatcatcctcgtggtggtactataccagctgcggctggcgcttgcaaggactacctcatggccctggccgccgcggccgccgagggggcgactctggagcgcatgggcagcggcgccatcctggtcgtggacgcggccgagtcgggcgccgaggcggactccggccacgtcggcgctggcgtgcgcgtgggcgtgggcgtgggcgtgggcgataagctgccttcgtccatgtacaagggcgtggtgccgcaccccaactgctggtggggcgcgcacatctacgagcgccaccagctcgtgtggctcggcaccttcgcggggaacgccgacgccccgcgcgcctacgacgtcgcctcgcttcgcttccgccgccgcgacgccgtcaccatcttccgcccgctcgccgacgccgacccggacgccgccgcctagctccgcttcctcgcctcgcgctccaaggccgacgtcgtcgacatgctccgcaactacacctacttcgacgagctcgaccagaacaagcgcgcctctcgccgccgccgccgcgccgacgacctcgtagcccgc

SEQ ID NO: 27512 - protein, 124 aa, Panicum virgatum
  misc_feature: Ceres CLONE 1877696
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 50 in the 10/838,616 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 48 in the 10/838,616 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: Functional homolog of the protein sequence given in SEQ ID NO 50662
  misc_feature: Useful for making plants with altered alkaloid content
  misc_feature: Useful for making plants with altered lignin content
  misc_feature: Functional homolog of the protein sequence given in SEQ ID NO 50663
  misc_feature: Useful for making plants with modulated water use efficiency
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 42 in the 10/838,616 US patent application
MALAAAAAEGATLERMGSGAILVVDAAESGAEADSGHVGAGVRVGVGVGVGDKLPSSMYKGVVPHPNCWWGAHIYERHQLVWLGTFAGNADAPRAYDVASLRFRRRDAVTIFRPLADADPDAAA

SEQ ID NO: 27513 - DNA, 728 bp, Panicum virgatum
  misc_feature: Ceres CLONE 1877698
  misc_feature: Encodes the peptide sequence at SEQ ID NO. 27514
accgagtccaaatttctgctcatcccaagagggagaccacacctctactccctttccccgctcacagctccaacgccaccgcgtccgcgtccgcctcctgctccgcgcgcccgcggatttcgaaaccctagcttcccgtgtccctcgccagtcgatcgcagcagattggaggcggcggggctatggctggcggcctctgagcgtgcgaacgagcgggtgttgggatcccaagggcttccgcgatgtcgagggcggaggccaactgggagcggctggtgcgggcggcgctgcgcggggagcggttcgctggcgtctacgggcagccggtcaccggcatcgccgggaacgtgccgtcgtcgctcggcaacaacgtgcacatcgaggaggtgctccgcgccgccgacgagatccaggatgaggaccccaccgtcgcgaggattctttgtgagcatgcttactcacttgcccagaatttggatcctaatagtgaaggacggggagtattgcagttcaaaacaggtttgatgtcggtaatcaggcaaaaattagcgaagagggaaggtggtgctatagaccggagtcaggatattgctaaactgcaagaattttacaagctttacagagaaaagcataaagttgacgagttgattgaagatgaaatgaagttgagggaatcagctgtattcagcggtaaccttggagagttggaaaggaaaactctgaagcgg

SEQ ID NO: 27514 - protein, 161 aa, Panicum virgatum
  misc_feature: Ceres CLONE 1877698
  misc_feature: Functional homolog of the protein sequence given in SEQ ID NO 51248
  misc_feature: Useful for making plants with altered cell wall content and/or composition
MSRAEANWERLVRAALRGERFAGVYGQPVTGIAGNVPSSLGNNVHIEEVLRAADEIQDEDPTVARILCEHAYSLAQNLDPNSEGRGVLQFKTGLMSVIRQKLAKREGGAIDRSQDIAKLQEFYKLYREKHKVDELIEDEMKLRESAVFSGNLGELERKTLK

SEQ ID NO: 27515 - DNA, 707 bp, Panicum virgatum
  misc_feature: Ceres CLONE 1877709
  misc_feature: Encodes the peptide sequence at SEQ ID NO. 27516
gaacgacgtacgttgttcggccatcatgctgccgaccttctcgccgacggcgagcgcctcggcggcgacgcctccgccgcggccgataccaggcagctacgggccgccggtgatcggcgcgctccgggaccgcctggactacttctggttccagagccaggacgagttctttcggcggcgcgccgccgcgaaccggagcaccgtgttccgcaccaacatcccacccacgttccccttcttcgtcggcgtcgacccgcgcgtggtcgccgtcgtggacgccgccgccttcaccgcgctcttcgacagcaccctcgtcgacaagcgcgacatcctcatcggaccctacaaccccggcgccggcttcaccggcggcacccgcgtcggcgtctacctcgacacggaggagcccgagcacgggcgcgtcaaggagttcgccatggccctcctccaccgcggcgcccaggcctggcccgccgagctccgcgccgccgccgacgccatgctcgacgccgtggaggccgacctcctcgccaagcagcagcaggccaccggcggcaaggcctccgccagctacctcgtgccgctgcagcaatgcatcttccggttcctctgcaaggcgctcgtcggcgccgaccccgccgccgactgggtagtggacaggttcggcttcaccatcctggacgtgtggctggccgtgcagctcctgc

SEQ ID NO: 27516 - protein, 227 aa, Panicum virgatum
  misc_feature: Ceres CLONE 1877709
  misc_feature: SWISSPROT Homolog: EC 4.2.1.92 Hydroperoxide dehydratase
MLPTFSPTASASAATPPPRPIPGSYGPPVIGALRDRLDYFWFQSQDEFFRRRAAANRSTVFRTNIPPTFPFFVGVDPRVVAVVDAAAFTALFDSTLVDKRDILIGPYNPGAGFTGGTRVGVYLDTEEPEHGRVKEFAMALLHRGAQAWPAELRAAADAMLDAVEADLLAKQQQATGGKASASYLVPLQQCIFRFLCKALVGADPAADWVVDRFGFTILDVWLAVQLL

SEQ ID NO: 27517 - DNA, 1394 bp, Panicum virgatum
  misc_feature: Ceres CLONE 1877722
  misc_feature: Encodes the peptide sequence at SEQ ID NO. 27518
aagatcagatcacactcgcttacgcttagccgccgccgagctcagctcactctcacagtctcactaactcgcacacagtgagtgccagccagccagccagcagcatgggctcgccggcggcgcgccagctgaggcagctgaagccgctgtaccagcacgcggtgaaccacttcgtggccgtgctcgcggcgccgctggccgtggcggccgccgtcgtcgcggcgcgcgccgggcccggggagctgctcgtccggctgcaggcgctccgggcggcgcacgtgctcctcgccgcgtgcgtccccgccgcggcggcggcgctgtatctcctgctgcggccgcgggcggtgtacctggtcgactacgcctgcttccgcacgcggcccaactgccgcgtccccttcgccaccttcctggagcacgccaagctggtgaccttcgtggagggcgcctccatcgacgagcgcagcgtccggttcatgacccggctgctggagcgctcggggctcggggaggagacctgcctgcccccggcccaccactacatcccgccgtaccggaacatggaggcgtcgcgcgcggaggtggagctggtcatcttctccgccatcgacgacctgctcgccaagacggggctcagccctggcgccatcgacatcctcgtcgtcaactgcagcctcttcgcgcccgtgccgtccttcaccgacatgatcatccgccggtacgggatgcgggaggacatccggaacgtgcacctgtccgggatggggtgcagcgcggggctcatctccgtggggctggcgcgcaacctcctgcaggtggcgccccggggcgcgcacgcgctcgtcgtgtccacggagaccatcacgcccaactactacgtgggcaaggagcgcgccatgctcctgcccaactgcctcttccgcatgggcggtgccgccgcgctgctgtcgacgtcgcgcgcccgggcgcggttccgcctcgcccgcgtggtgcgcacgctgacgggcgccggcgacagcgcgtaccggtgcgtgttccaggaggaggacggcgagggccaccgcgggatcaacctgtccaaggacctgatggccatcgccggggacgcgctcaaggccaacatcaccgccatcggcccgctggtgctgccggcgtcggagcagctgctgttcgcgctctccttcatcgcgcgccgcgtgctcagcgaccgccgcgtcaagccgtacctgcccgacttccgcacggcgttcgagcacttctgcatccacgcgggcggccgcgccgtcatcgacgagctgcagcgcagcctggggctgtcggaccaggacgtcgaggcgtcgcggatggcgctgcaccggttcggcaacacgtccagcagctcggtctggtacgag

SEQ ID NO: 27518 - protein, 429 aa, Panicum virgatum
  misc_feature: Ceres CLONE 1877722
  misc_feature (73)..(365): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature: The sequence is a functional homolog of SEQ ID NO 2 in US patent 7038112
MGSPAARQLRQLKPLYQHAVNHFVAVLAAPLAVAAAVVAARAGPGELLVRLQALRAAHVLLAACVPAAAAALYLLLRPRAVYLVDYACFRTRPNCRVPFATFLEHAKLVTFVEGASIDERSVRFMTRLLERSGLGEETCLPPAHHYIPPYRNMEASRAEVELVIFSAIDDLLAKTGLSPGAIDILVVNCSLFAPVPSFTDMIIRRYGMREDIRNVHLSGMGCSAGLISVGLARNLLQVAPRGAHALVVSTETITPNYYVGKERAMLLPNCLFRMGGAAALLSTSRARARFRLARVVRTLTGAGDSAYRCVFQEEDGEGHRGINLSKDLMAIAGDALKANITAIGPLVLPASEQLLFALSFIARRVLSDRRVKPYLPDFRTAFEHFCIHAGGRAVIDELQRSLGLSDQDVEASRMALHRFGNTSSSSVWY

SEQ ID NO: 27519 - DNA, 573 bp, Panicum virgatum
  misc_feature: Ceres CLONE 1877722-R
  misc_feature: Encodes the peptide sequence at SEQ ID NO. 27520
aggccaagggccggataaggaagggcgaccgcgtgtggatgatcggcttcgggtccgggttcaagtgcaacagcgcggcgtgggagtgcatcgcgccggcgcgcaccgccgaggggccctgggaggacagcatctgccgctaccccgtcgacatcccggaggtgctcaagcactagcatgttgttggtgccggcgacgaggaaagaggccggccaggtctccgacgtcacagcgtgttggtggtgccggcgggcggccacggccaggccggccgggcgcgttgaatgccgagcctgtcgcgtccatgtgtgcgctcctcgccggcgggggcaggtggttgcgcgcgggtacgccggggttaaacccccggccgtttacacacgtagcacagcactcgtggtcctctagatcatatcgatcctgtacccttccttcctttcaacttcttttcgctttccctttctcttcttttttttaccccatttgtttatttgggtcaccaccactaataattttacgttgtctgtattcaaaaacaagtcaagaaatgtactgcgagagctggatccgtcg

SEQ ID NO: 27520 - protein, 57 aa, Panicum virgatum
  misc_feature: Ceres CLONE 1877722-R
  misc_feature: SWISSPROT Homolog: EC 2.3.1.119 Icosanoyl-CoA synthase
  misc_feature: The sequence is a functional homolog of SEQ ID NO 2 in US patent 7038112
AKGRIRKGDRVWMIGFGSGFKCNSAAWECIAPARTAEGPWEDSICRYPVDIPEVLKH

SEQ ID NO: 27521 - DNA, 651 bp, Panicum virgatum
  misc_feature: Ceres CLONE 1877724
  misc_feature: Encodes the peptide sequence at SEQ ID NO. 27522
atctcaaacagatcctcagagagaagagagaagctcctcgagagagatacagagaaagagctagcgcagagttgaacggagagctgaagttcaattagtcccctgcttgcttcttccatggagagagttgcatcaagctgcgtcggcctcctggctcaaaggagggcctactccgtggccgcggccatggcgaagggagccgggcggagggccgacggcgagaagaaagcggcggccaagcgcgtgatgggcaagaaggaagtgaacaccgcagctgcggagaagacggcgtgggtgccggacccggtgaccgggtactaccgcccggcgggtggcgccaaggaggtggacgcggcggagctgcgcgccaagctgctcacgcaggcggccaactgatgagcccaagtcactttgacttttcgaaccatgagttaccagccgaggtagcttgtcttgctttgagatccccgctccttgatcgccgggctccgtggcctagagcgtgagggcgctgtatctttgcagcatatagtagtatcgtcggcgactgctccatctgatttatgttttgagacatacaagtctgcaatcttgttgcctggctcgtgaccttgactacagagtccaggaagaaagaaccaaacgttcaag

SEQ ID NO: 27522 - protein, 92 aa, Panicum virgatum
  misc_feature: Ceres CLONE 1877724
  misc_feature (1)..(88): Pfam Name: LEA_3 Pfam Description: Late embryogenesis abundant protein
  misc_feature: Functional homolog of the protein sequence given in SEQ ID NO 50428
  misc_feature: Useful for making plants with modulated nitrogen use efficiency
MERVASSCVGLLAQRRAYSVAAAMAKGAGRRADGEKKAAAKRVMGKKEVNTAAAEKTAWVPDPVTGYYRPAGGAKEVDAAELRAKLLTQAAN

SEQ ID NO: 27523 - DNA, 2251 bp, Panicum virgatum
  misc_feature: Ceres CLONE 1877725
  misc_feature: Encodes the peptide sequence at SEQ ID NO. 27524
aaccaccgagaattaaagacgcggacgaggcccggaggacgccattgccgcccctcctccatctccttctccttcccctccttggcttcaactccactcctcccatgcttgctttccaacccaagggataaccgcccgtccaagcgcctccacgtacgccccaactgcaccgagcatgaacagcaagtagtggaggacggcgtgatccgtcgatctgtcgaccgcccatggggaagcttaggagcctctgctgcatgggccctccgcgggcggcctcgccggccggcgccgccgtcgatgccaccgccggcgtcagggtcaccgtcagcgaccgatatgttgagataaaaaatggcatctttgagctgacgctgtccaaccctgacgggatcgtgaccggcgtgcgctacaatggtgtggataacctcatggagatccttaacaaggaagacaacagagggtactgggaccttgtttggaacccaccagggcagaaaactggcatctttgatgtgatcaaaggtactgagttccgcatcatataccatgatgaaaaccaggctgaggtctccttcaccagaaattgggatccttctctagaaggcaaagctgtccccttgaacattgacaagaggttcatcgttctccggggttcttcaggattctacacatatggaatctatgagcataaggaaggctggcctgattttggcttgggagagacgagggtggctttcaagctccggaaagacaagtttcattacatggcattggctgatgacaggcagagaattatgccaatgccggacgaccgactgcctccccgaggtcagccattagcataccctgaggctgtgctccttgtggacccaatcaatcctgatctcagaggggaggttgacgacaagtaccagtactcctgcgaggaccagtacaacaatgtccatggatggatgtcattcgatcctcccattggcttctggcagatcactccaagtgatgagttcaggactggaggacccctgaagcagaatttgacctctcatgttggccccactacgctggctatgtttcttagcgcacattatgcgggggatgacctttcacccatgtttacgaatggagaatactggaaaaaggtccatggaccagtattcatgtaccttaactccagttgggacgggagtgacccaactatgctctgggaggatgcaaaagttcagatgatgattgagaaagaaagctggccatattgtttcgcactttcagaggattttcagaagactgagcaaagaggatacatctctggtagattattagttcgagacaggtatatagatgatggggacctttatgcctctggagcctatgtaggcctggctctaccaggagaagctggatcctggcaaagagagtgcaagggataccaattctggtgtagagcagacgtagatgggagcttctacataaggaacataataactgggaactataacctgtatgcatgggttcccggtttcataggggactacaaattagatgctacactgacgatagtttcaggggatgatatttatctgggtgaccttgtgtatcaaccaccaagagacggtccaacaatgtgggagattggagtacccgatcgatctgccgctgagttctatgttccagatcctaaccccaaatatgtcaatagattgtatatcaaccaccctgacaggcaatatggactttgggaacgatatgcggaactatacccagacagtgatctggtgtacacaattggccagagcgactatagcactgattggttctatgctcaagttaacagaaaagttgatgagaacacttaccaaccaactacatggcaaatcaagttcaatcttgacagtgtgagtccaggcagcacttacaagttccgagtagcgcttgcgtcttcggcacgtgctgagttacaggttttcttcaacgataaagacaggggtgttcctcacttcgctactgggctgatcggcagggacaacgccatagcaaggcacgggatccatgggctatactggctgtttaacatcaatgtgaatagtgactggcttgtccaagggatgaacacaatctacctgaagcagcccaggaaccagagcccgtttcaggggctgatgtatgactacctgcgtttggaggaaccgtgtggctgctaatctgttgtacaacaaactagttgagttttcacatttggccgaccattcagtct

SEQ ID NO: 27524 - protein, 656 aa, Panicum virgatum
  misc_feature: Ceres CLONE 1877725
  misc_feature (10)..(224): Pfam Name: Rhamnogal_lyase Pfam Description: Rhamnogalacturonate lyase family
  misc_feature: Functional homolog of the protein sequence given in SEQ ID NO 50582
  misc_feature: Useful for making plants with altered carbohydrate content
  misc_feature: Functional homolog of the protein sequence given in SEQ ID NO 51249
  misc_feature: Useful for making plants with altered cell wall content and/or composition
MGKLRSLCCMGPPRAASPAGAAVDATAGVRVTVSDRYVEIKNGIFELTLSNPDGIVTGVRYNGVDNLMEILNKEDNRGYWDLVWNPPGQKTGIFDVIKGTEFRIIYHDENQAEVSFTRNWDPSLEGKAVPLNIDKRFIVLRGSSGFYTYGIYEHKEGWPDFGLGETRVAFKLRKDKFHYMALADDRQRIMPMPDDRLPPRGQPLAYPEAVLLVDPINPDLRGEVDDKYQYSCEDQYNNVHGWMSFDPPIGFWQITPSDEFRTGGPLKQNLTSHVGPTTLAMFLSAHYAGDDLSPMFTNGEYWKKVHGPVFMYLNSSWDGSDPTMLWEDAKVQMMIEKESWPYCFALSEDFQKTEQRGYISGRLLVRDRYIDDGDLYASGAYVGLALPGEAGSWQRECKGYQFWCRADVDGSFYIRNIITGNYNLYAWVPGFIGDYKLDATLTIVSGDDIYLGDLVYQPPRDGPTMWEIGVPDRSAAEFYVPDPNPKYVNRLYINHPDRQYGLWERYAELYPDSDLVYTIGQSDYSTDWFYAQVNRKVDENTYQPTTWQIKFNLDSVSPGSTYKFRVALASSARAELQVFFNDKDRGVPHFATGLIGRDNAIARHGIHGLYWLFNINVNSDWLVQGMNTIYLKQPRNQSPFQGLMYDYLRLEEPCGC

SEQ ID NO: 27525 - DNA, 655 bp, Panicum virgatum
  misc_feature: Ceres CLONE 1877731
  misc_feature: Encodes the peptide sequence at SEQ ID NO. 27526
gtctcgtctcctcgctccactcgccacccaacgcggaccgaatccgccggccgaatagagtaatccccgtccgaatggaggccgcgtgagagagagaagactagaagagagagagagagagcgaggagagatcggggcggcgatgcgggcgtgggagatgcacccgctctgctgcctcgccggggagtggccgggctcgggcggggggctcgcggcgggcggcggccgctccccgccgccggagacgccggaggaggcgccggcggtggcgggcgtgctgtacaagtggaccaacatcggcaagggctggcgcccgcggtggttcgcgatccgcgggggcgtgctcgcctactccaagatccgccgccgcgtcgcggccgagccgcaccccgccgccgaggccgcgggcggcgccaggctcatcggggtggcgcgcggcgccgggggagccgcggagcggcccatcggattcgtgcatctcaagatatcatcatttagtgaaagtaaatcagatgacaaacggttctatataattactccaaccaaaacacttcaactgaggactggttgtgccaaggatcgggcgacttggattgaagcgcttgtcactgcaagaagtgaatattcttttaatggggatttatcgggtgaccag

SEQ ID NO: 27526 - protein, 170 aa, Panicum virgatum
  misc_feature: Ceres CLONE 1877731
  misc_feature (40)..(159): Pfam Name: PH Pfam Description: PH domain
  misc_feature: SWISSPROT Homolog: EC 2.7.11.1 Non-specific serine/threonine protein kinase
MRAWEMHPLCCLAGEWPGSGGGLAAGGGRSPPPETPEEAPAVAGVLYKWTNIGKGWRPRWFAIRGGVLAYSKIRRRVAAEPHPAAEAAGGARLIGVARGAGGAAERPIGFVHLKISSFSESKSDDKRFYIITPTKTLQLRTGCAKDRATWIEALVTARSEYSFNGDLSGD

SEQ ID NO: 27527 - DNA, 630 bp, Panicum virgatum
  misc_feature: Ceres CLONE 1877750
  misc_feature: Encodes the peptide sequence at SEQ ID NO. 27528
tgtgaatacagcacgtagctctcttgaggaagaccatgtcaacacctgtgctagtggccacagcagagcagacgctggaggaggttgaatgccactttgaggtcgtctcagggcttccagtagtagacagcagcctaagatgtgttggggtggtcgtcaagaatgaccgggccaaagcttctcatgggccaaaaacaaagattgaagaagtaatgacctctccagccatcacactatcatcagataaaacagtgatggatgctgcggttcttatgctcaagaagaagattcacagactaccaattgtaaatcaggataagcaagtgataggtatagttacccgtgctgatgttcttcgcgagttggaaggactgctgaagatttagaagggcagcattccatgctccgaagtcataacttcttgtaaatatgtccatggcgctttgagtggcagcaagcagatctataatctgcaggtatgcgctgtagaatcggcggaaataagccaggaagagtttgagatcttatccttgtaaaagtagcacgccaggaaacttcttctctgtgttgtactgcttgcgcaaccaaatgttgtaacaagtcaaatatttctagagcaaatataaatag

SEQ ID NO: 27528 - protein, 116 aa, Panicum virgatum
  misc_feature: Ceres CLONE 1877750
  misc_feature (1)..(111): Pfam Name: CBS Pfam Description: CBS domain pair
  misc_feature: SWISSPROT Homolog: EC 1.1.1.205 IMP dehydrogenase
MSTPVLVATAEQTLEEVECHFEVVSGLPVVDSSLRCVGVVVKNDRAKASHGPKTKIEEVMTSPAITLSSDKTVMDAAVLMLKKKIHRLPIVNQDKQVIGIVTRADVLRELEGLLKI

SEQ ID NO: 27529 - DNA, 669 bp, Panicum virgatum
  misc_feature: Ceres CLONE 1877756
  misc_feature: Encodes the peptide sequence at SEQ ID NO. 27530
aaatctcgcagcaacgaattcccatttcgcccacctccaccccactttcccttccgcccccttcctcggcgcgatccaaatccggccatggacggcggggcgcagccgccggacacggagatgacggacgccggcgcgtgcggcggcgggcagccgccgcagcagccggcgggcgggggaggcgggatgatggataacatccaggcgacgctgagccacggcgggcgcttcatccagtacaacatcttcggcaacgtgttcgaggtcaccgccaagtacaagccccccatcctccccatcggcaagggcgcctacggcatcgtctgctcggcgctcaactccgagacgggggagcaggtggccatcaagaagatcgccaacgccttcgacaacaagatcgacgccaagcgcacgctccgcgagatcaagctgctccgccacatggaccacgagaatattgttgcaataagggatatcatacctcctccacagagggaggcattcaatgatgtttatattgcgtatgaattgatggatactgatctgcatcaaattattcgttcaaatcaagctttatcagaggagcactgccaggtgcttgtttatttcaatctaagaaatgcatacttcctattatttctcttggtgtttctttagctattgtttgat

SEQ ID NO: 27530 - protein, 189 aa, Panicum virgatum
  misc_feature: Ceres CLONE 1877756
  misc_feature: SWISSPROT Homolog: EC 2.7.11.24 Mitogen-activated protein kinase
MDGGAQPPDTEMTDAGACGGGQPPQQPAGGGGGMMDNIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQREAFNDVYIAYELMDTDLHQIIRSNQALSEEHCQVLVYFNLRNAYFLLFLLVFL

SEQ ID NO: 27531 - DNA, 706 bp, Panicum virgatum
  misc_feature: Ceres CLONE 1877785
  misc_feature: Encodes the peptide sequence at SEQ ID NO. 27532
gaaccctgctgtcgacgttcacttttctgttttatttgtgctttggttggtggggggattcgggttgagttcctaaccgaatgtccgaaccctagcgtggcacggcaggagactcgcgaaagaaatccaatccaatccggcacgatttgatttttgctgatcctcgatctcatcgattcactcctgcctgaggcagcttgacaaggaaaaggaagccttcaccatgggcaacaaagcacctttcttcctcttgatcctcttgttgctcgtcgccagggcacctgcacaagccagggatgctgaccacagccctgtctacaaggaacatgtccctgtccatctcaagagcagcagcccgctatgctctgcttgtgaaaacttagcgagtggagctgtcacttatctaagtgagaaacaaacacaagataagatcatggaattacttcatcatgcttgttctcagtcattctccttggaacagaagtgtgttgaattgatggactcctatgcaactctgctgtttgccaagatttcagagatcaagccagaagagttctgcaaacagtatggcctgtgcagggataccgcccttttctctggtgtgggaagtgacagcacttgtgtgtcttgccaccacctgcttgatgaaattatgtccaaactgaaagatccagattcggagtttgagataattcaaattctcatc

SEQ ID NO: 27532 - protein, 160 aa, Panicum virgatum
  misc_feature: Ceres CLONE 1877785
  misc_feature (44)..(83): Pfam Name: SapB_1 Pfam Description: Saposin-like type B, region 1
  misc_feature (85)..(118): Pfam Name: SapB_2 Pfam Description: Saposin-like type B, region 2
MGNKAPFFLLILLLLVARAPAQARDADHSPVYKEHVPVHLKSSSPLCSACENLASGAVTYLSEKQTQDKIMELLHHACSQSFSLEQKCVELMDSYATLLFAKISEIKPEEFCKQYGLCRDTALFSGVGSDSTCVSCHHLLDEIMSKLKDPDSEFEIIQIL

SEQ ID NO: 27533 - DNA, 2430 bp, Panicum virgatum
  misc_feature: Ceres CLONE 1877792
  misc_feature: Encodes the peptide sequence at SEQ ID NO. 27534
agagcgtgaggaaggaggcggggcttgctcggctgggatcccccgcccggggcccacatggcggcgtcgccctgagcccggctctccccaccgcgacgaccgcggccgcggcgtcccgagatgccgccgcggggagcggcgctgctgctcttcctcctcgtagtctccgcgcaactcggaacttcaagctcaacaagtattacagcatacttatttggattcttgagtagaacccatcagcatcgctttcctgccctagccccaggcccagccccttctcctcaaccccaaggccccattattgctcccccagttcataggcatcacagaaaaaggcatcatgcttccccaccaccttcttcggcatcatcagaaagacaagattgcagtggaacaacttgttcggctccacttacgtcgactccaatcggttcaccttgtggttgtgtatatcctatgcaaattcagcttgaccttggtgtggcaccatatcagttatttccgagaatcgatgagttagaaattgaggttgcagcaggtacattcctgaaacagagccaagttcggataatgggtgctgggagtagtcttcaagatcctgaaaagacaacggtaaccattgacttggtgcccctaggtcagaagtttgataggacttcagccttattgatcagcaacagatttttgcaaaagaaggtgccaataaactcatccatttttggtgactatgttgctacatatgttcattatccaggccttccttctctggtacctattcctggatccttgggtccagtaagcagcaatgaggacccttttggtgcaaatatacacaatagaagccatcataagattaactctaaagtgattgccataattgctctgtcagctgtggtttttgttttgatgtgctttgccattggcatcgcttggagatttaaaggattaaaaaaatctcatgctacaggacctatttcaaattcgtctatcaccagaaaaggaggtatgaggtcatcattctctggtacaagcagctcgacagcatcatttgcctcaacgataggaacttgcccatccaccgttaagacatttacgataaccgagcttgagaaggccacagaaaacttcagcttcagcaaaataataggtgaagggggttatggacgcgtttaccgtggcataattgaagatggtgttgaggttgctgtcaaattgctcacaaggaaacatcaaaacagagatcgcgagttcattgcggaggttgagatgctaagtcgtttgcatcaccgcaatcttgtcaagcttattggtatatgcattgaaaggagcacgaggtgtttggtatttgagcttgttccaaatggaagtgttgaatctcatctacatggctcggataaaatatatggtccccttgattttgacactagaataaaaatagccctcggcgctgcaagaggactagcctatctgcatgaggatgtcaatccccatgtcattcaccgggatttcaaggctagcaatgttctattggaaaacgatttcacccccaaggttgctgattttgggctggcaaaggaagcatcggatgggatggatcatatttctactcaggtcatgggaactttcgggtacgttgccccagagtatgcgatgacggggcatctgctcgtcaagagtgacgtctacagctacggtgtggtgctcctggagctgctgtcaggccggaagcccgtcgacatgacccagccaccggggtccgagaacctggtcacctgggcgcgcccactcctcaccacccgggagggcctgcagcggctggtggacccgtcgctgccggcgggctacgacttggagaagctggccaaggcggcggccatcgcgtccatgtgcgtgcacgtcgaggcctcgcagcggccgttcatgggcgaggtcgtccaggcgctgaagctgatccacggcggcgggggcggggccggcgacgagacctgcagcgggtccttgggcggcggcgcgacggaggagtccccctggcacgacggcagcaggagcacgtggaacgacgaccccgccacgccgggcccggcgctccccctgggctacggctacggctcggaccccgccggcggcgcggacgagcggaggccgcggtcggcgtcgagcgccgtgctggacaagatcgagtccctgtccatgtacgactggtccggcccgctgcgcgccaaggggaggctcagcttctaccgactgagggggagcatgagcgagcacggccggccctccgacgacggcagcgtggaaggctacttgatgtagccggcgaccatcccgcagattgccgcggcgggcatgcctgcctcgcgattgttgtctcgatctagaattgtatagctgctgctgctgcttcttgacgagattttggtccctgttgcc

SEQ ID NO: 27534 - protein, 618 aa, Panicum virgatum
  misc_feature: Ceres CLONE 1877792
  misc_feature (224)..(496): Pfam Name: Pkinase Pfam Description: Protein kinase domain
  misc_feature: SWISSPROT Homolog: EC 2.7.11.1 Non-specific serine/threonine protein kinase
MQIQLDLGVAPYQLFPRIDELEIEVAAGTFLKQSQVRIMGAGSSLQDPEKTTVTIDLVPLGQKFDRTSALLISNRFLQKKVPINSSIFGDYVATYVHYPGLPSLVPIPGSLGPVSSNEDPFGANIHNRSHHKINSKVIAIIALSAVVFVLMCFAIGIAWRFKGLKKSHATGPISNSSITRKGGMRSSFSGTSSSTASFASTIGTCPSTVKTFTITELEKATENFSFSKIIGEGGYGRVYRGIIEDGVEVAVKLLTRKHQNRDREFIAEVEMLSRLHHRNLVKLIGICIERSTRCLVFELVPNGSVESHLHGSDKIYGPLDFDTRIKIALGAARGLAYLHEDVNPHVIHRDFKASNVLLENDFTPKVADFGLAKEASDGMDHISTQVMGTFGYVAPEYAMTGHLLVKSDVYSYGVVLLELLSGRKPVDMTQPPGSENLVTWARPLLTTREGLQRLVDPSLPAGYDLEKLAKAAAIASMCVHVEASQRPFMGEVVQALKLIHGGGGGAGDETCSGSLGGGATEESPWHDGSRSTWNDDPATPGPALPLGYGYGSDPAGGADERRPRSASSAVLDKIESLSMYDWSGPLRAKGRLSFYRLRGSMSEHGRPSDDGSVEGYLM

SEQ ID NO: 27535 - DNA, 2011 bp, Panicum virgatum
  misc_feature: Ceres CLONE 1877845
  misc_feature: Encodes the peptide sequence at SEQ ID NO. 27536
aaaccgcacgcacgccgcccggaacgtcggatccacgcacaccagccgccgccgccgcctcatcctcccagatggcggcggcctcgccggagaagaggcctcctcgctcgctattcgaccttccgtctgagttcttcgattcaacagctctcctccgggctcatccctccacggccccctccgcagtggaaccgtccgagccctcccgcccaccgccgacgactcagcagcagcagcaaccgtcagaggctgtggggtccaggtggacgtgcaacacctgcgctgccgagtttgaatcgctgcaggagcagcgcgagcacttcaaatccgacctacaccgcctcaacgttaagttgagcattgctggtaaagctattataaaggaagaattcaggaagaagctttattttcggcatcaattgggtgacacaatttcaatctggagatgcatactgttgaaagaacatgaagaaccatttattgattgcaagtctggtcagatggacagtgcatcttgtgtagaagaggatgaggtgataaatagggtgaagtgtttgacatgtgaacctcgtgatgcgtcacatttgaggattgttctactaacaagtggtggacattttgctggatgtgtttttgacggtaattccgtcatagcacataaaacatttcataggtatgtggtaagagcaaaggctggaaagaggcaatctggaaaagatgctactggcaaagttgcgcactcagcaggctcttctcttcgacgctataatgaagcagcattgaaaaaggaagttcaagaattaattgtttcgtggaaatcatactttgacacctgtgtttgtgcctttatatacgctccatcaaagaaccgccagatgctctttgatggcgataagactcagtcggtaattcaggcttgtgatattcgctcagttcccttgactgttcatcggcccaccctgaaggaagctaagcgagtatacagtaacctaacacagctccattatgagatggaatgttcaactacagatgaaaccttaccccatggtcaaagtgtgacaagtgttgaagaaagtgaagggaaaaaaaaggaagtggctgtggacaccgcggaatctatttctaacttatctgtcagtttggagttgttgaacaaaaatgaagaagtaatcataccattatccaataagaaagaaacaacccctcttcacgaggcagcaaaatctggcgatgcacagctgaccctggagttacttgagcagggtttggatccttgcatcaaagatgcaaggggaaagactccttacttggtagcttcggataaggaagttagaaatacattcagaagatttatggctctcaaccttgacaaatgggattggcatgctgcagatgtgcctagtgcactgacaaaggaaatggaagaatcacaagctgcaaaacaggcagagaaggatgccaagaagaaagcgcgtgcgaaagaattgaagaagttaaagaaagcaagagaaaaggaggaggagaaggaaaaagaaaaagcaaaggctcaagcatcacaatcccaaacttcgatgggccaaatggccaacagaactacttctgtgccaggccttaaaccaaagcatcagacgccacagcagatccttattgcaaaggaggaggaacgacaaaggaagctagcggaagaaagagagaagagagcagcggcagcagagagaagactcgcggccctggctgctcaatctgcgggcacatcaggtgcagctgcagaaccagcaaactccgtgcagaaggcagcgccagacgacaattcttgttcgtgctgtttcacttccttggccggcaaagtgctgttccaccgatacaactacaaatactgcagcactacgtgcatgcatcttcattcagaaatgctgcaagatgagtgaggaaattgtatgctgagattcacatgattttttatggtatatttacctcatatcaatggcagacggttcacccagtttttcat

SEQ ID NO: 27536 - protein, 618 aa, Panicum virgatum
  misc_feature: Ceres CLONE 1877845
  misc_feature (374)..(406): Pfam Name: Ank Pfam Description: Ankyrin repeat
MAAASPEKRPPRSLFDLPSEFFDSTALLRAHPSTAPSAVEPSEPSRPPPTTQQQQQPSEAVGSRWTCNTCAAEFESLQEQREHFKSDLHRLNVKLSIAGKAIIKEEFRKKLYFRHQLGDTISIWRCILLKEHEEPFIDCKSGQMDSASCVEEDEVINRVKCLTCEPRDASHLRIVLLTSGGHFAGCVFDGNSVIAHKTFHRYVVRAKAGKRQSGKDATGKVAHSAGSSLRRYNEAALKKEVQELIVSWKSYFDTCVCAFIYAPSKNRQMLFDGDKTQSVIQACDIRSVPLTVHRPTLKEAKRVYSNLTQLHYEMECSTTDETLPHGQSVTSVEESEGKKKEVAVDTAESISNLSVSLELLNKNEEVIIPLSNKKETTPLHEAAKSGDAQLTLELLEQGLDPCIKDARGKTPYLVASDKEVRNTFRRFMALNLDKWDWHAADVPSALTKEMEESQAAKQAEKDAKKKARAKELKKLKKAREKEEEKEKEKAKAQASQSQTSMGQMANRTTSVPGLKPKHQTPQQILIAKEEERQRKLAEEREKRAAAAERRLAALAAQSAGTSGAAAEPANSVQKAAPDDNSCSCCFTSLAGKVLFHRYNYKYCSTTCMHLHSEMLQDE

SEQ ID NO: 27537 - DNA, 1195 bp, Panicum virgatum
  misc_feature: Ceres CLONE 1877857
  misc_feature: Encodes the peptide sequence at SEQ ID NO. 27538
gcccgcccgtctcgcccctcgcctctccctcctttctgccggtaaaactgctgccaaatctccccccgctcccgaggtcggtcgggtgcgcgtggtgctcgccagctgccttgctagctacgacgcgctcgggggtggtggtgccgccgccgccagagtctcctccgcgagtgccctccatcatcccatcaacctgcgtgcttgtgtgtgcttggcttggcgattcggaggacttggactgggatccgcgcgtggctgcctctcctcgagagctgcgctgcgcgcgggggacggattttggggggcggatcggcgcggcgcagatctggaggcgcatgaggaggcggcggcggaggggtagcgggagcgatgcggtgctgctgctgcggaggagggcgacttgagccggcgtgggaaggtgatcctggaggaggaggtggcggcggagggggaggctggaggagggatggaggacgccgccgtggcggtggcggtcgcggccccgctcgccgcgccggcgtttagccccgccgtcacgctgatcgccgccgcagccgcggacccgatcgcggcggcggcggccgtggagggggtctccgtgcccccggtccggacggcgtcggcggcggaggacgacgtgctgctggcgccggatggggaggggggcggggaggcgtcggtggcggggagcccgtgctcggtcgccagcgactgtagcagcgtcgcgagcgccgacttcgaaggggtcgagctgggcttctttgccgcggtggaggccggcgtccccgtggtgctcgaggacgcggtcgcgtcggcagccacggtcgaggccgaggccagggtcgcggcggccggtaggagcgtcttcgccgtcgactgcgtcccgctgtgggggtacacgtccatatgcggccgcaggccggagatggaggacgccgtcgcctcggcgccgcgattcttcgacgtgccgctgtggatgctcacgggcaatgccgtcatcgatgggctcgaccccatgacgttccgcctacccgcacatttcttcggtgtgtatgacggccacgggggtgcacaggttgccaattactgtcgggaacgccttcatgtggcgctggtggagccgctgggcaggatacaggggaccgtgtgtgcagctaacttgggggatgtagagttcaagaaacagtggcgaaat

SEQ ID NO: 27538 - protein, 242 aa, Panicum virgatum
  misc_feature: Ceres CLONE 1877857
  misc_feature: SWISSPROT Homolog: EC 3.1.3.16 Phosphoprotein phosphatase
MEDAAVAVAVAAPLAAPAFSPAVTLIAAAAADPIAAAAAVEGVSVPPVRTASAAEDDVLLAPDGEGGGEASVAGSPCSVASDCSSVASADFEGVELGFFAAVEAGVPVVLEDAVASAATVEAEARVAAAGRSVFAVDCVPLWGYTSICGRRPEMEDAVASAPRFFDVPLWMLTGNAVIDGLDPMTFRLPAHFFGVYDGHGGAQVANYCRERLHVALVEPLGRIQGTVCAANLGDVEFKKQWR

SEQ ID NO: 27539 - DNA, 510 bp, Panicum virgatum
  misc_feature: Ceres CLONE 1877857-R
  misc_feature: Encodes the peptide sequence at SEQ ID NO. 27540
gggtcggtgattccgcagacccagcggctcaagcggccgctgaatgcttgtcgaagcttgctcttcagaaggggagcaaagacaacatcaccgttgttgtggttgacctgaaagcacatcgtaagttcaagagcaaaacctaacccaggatggctcgatgaacaactgcagcgacaagttgttaggaacctatagatttggagaatccaaattcgtcagttttagtccgcagtacattacttagcccagttctttttttctcagttctttttaaagccatctgggctgccaagggctgtatcccacgtatatggtaccgattgcgaccatcagggtttatgcttcctggtcgcggtgatggtcctattttccattcttcttacttcgttgccctgtattctttttgtcaagctgggcgtccatgtatctggcaatgtatatttgagcttgtagggtgcaaaagaaacaagtgttataaagggttctgtgtcctgcctgatttaatttgtg

SEQ ID NO: 27540 - protein, 46 aa, Panicum virgatum
  misc_feature: Ceres CLONE 1877857-R
  misc_feature: SWISSPROT Homolog: EC 3.1.3.16 Phosphoprotein phosphatase
  misc_feature: Functional homolog of the protein sequence given in SEQ ID NO 51250
  misc_feature: Useful for making plants with modulated drought sensitivity
VGDSADPAAQAAAECLSKLALQKGSKDNITVVVVDLKAHRKFKSKT

SEQ ID NO: 27541 - DNA, 1633 bp, Panicum virgatum
  misc_feature: Ceres CLONE 1877864
  misc_feature: Encodes the peptide sequence at SEQ ID NO. 27542
aaatgaatcgattgtccatctcctttcggaggacaataatagttgcgtaggcagcatggccatccacctaaaattgcttttcacccaacgccttctcctgcttctttcttattacgtcgctgccgcagtgtctgatcctgcgtctcttcaagaactctctgacgatgtggcgatccaacatcctatactaggagacctaaacccagagcacttccccaacgagcggctctacgaagcctacctggccattcagcatttcaagagcactatcactagtgaccccaagaacatcacagcaacctggactggccatgacatctgcggcgagaagacctacctcggcttctactgcgcaacgccgccagggttagctgggaagctaacagttactcaggttcttttaaatggatttggcctgcgtgcgccccgtttgcaaggcttcatcgatcagctcccggatatcgctcttttccatgcagcctccaactactttggtggtgatatccctcaactcagcagcctgccttacctgtacgagttcaatatcgctaactacgatcagcctctgcagccttctggtactgacttgagattcgttggtggagctggtggagggaatggggggggatatggcccaccaccatgtgttaaagggtatcttaattttacatttggcatccgcgctggcaacgctacttcaggaggcctcattccgggcattccgaatccaaggattccgggccttccagagcatccaaagtttccgggcataccgggcgccacggattctaaggcgctcctcctcaactacaacaacctgtccgggcaacttccggcgaacctcggcctctccaagttgagctacctcgccctcgccaacaacaggctcacggggccaatccctccgtcgatcgagcacctgcaagactccctcttcgagctcctcctcctcaacaaccagctctccggctgcctcccccacgagctcggcatgctccgcaaggcggccgtcatcgacgccggcatgaaccagctcaccggcccgatcccgtcatccttctcctgcctcagcagcgtcgagcagctcaacctcgccgggaaccgcctttacggcccggtgcccgacgcgctctgcaagctcgccgggcccgccggccgcctcgccaacctcacgctgtccggcaactacttcacctccgtcgggccggcgtgcgcggcgctgatcaaggacggcgtgctggacgtgaagagcaactgcatcccgggtctcgccgaccagaggcgcccggcggagtgcaccgcgttccagagccagcccaagacgtgcccggcggcgagcactccggtggcctgccccgccgcagctgcggccaagggcgaggtggcgccgggggagaggaaggctagggactactccagctacgtgacctacgctactctgcatgagtgagaggcctcagctcggcatgcagtaggagacagatcgtctcggtggcgttttggctatttgttcttgtattcttatgtactagtaccgtgtggttggagtgtttgctgtctattttctattgctgtccaacctagatctatttgtatccattatatttgagtgaaaatttgttgccgttgttgt

SEQ ID NO: 27542 - protein, 464 aa, Panicum virgatum
  misc_feature: Ceres CLONE 1877864
  misc_feature: SWISSPROT Homolog: EC 2.7.11.1 Non-specific serine/threonine protein kinase
MAIHLKLLFTQRLLLLLSYYVAAAVSDPASLQELSDDVAIQHPILGDLNPEHFPNERLYEAYLAIQHFKSTITSDPKNITATWTGHDICGEKTYLGFYCATPPGLAGKLTVTQVLLNGFGLRAPRLQGFIDQLPDIALFHAASNYFGGDIPQLSSLPYLYEFNIANYDQPLQPSGTDLRFVGGAGGGNGGGYGPPPCVKGYLNFTFGIRAGNATSGGLIPGIPNPRIPGLPEHPKFPGIPGATDSKALLLNYNNLSGQLPANLGLSKLSYLALANNRLTGPIPPSIEHLQDSLFELLLLNNQLSGCLPHELGMLRKAAVIDAGMNQLTGPIPSSFSCLSSVEQLNLAGNRLYGPVPDALCKLAGPAGRLANLTLSGNYFTSVGPACAALIKDGVLDVKSNCIPGLADQRRPAECTAFQSQPKTCPAASTPVACPAAAAAKGEVAPGERKARDYSSYVTYATLHE

SEQ ID NO: 27543 - DNA, 709 bp, Panicum virgatum
  misc_feature: Ceres CLONE 1877865
  misc_feature: Encodes the peptide sequence at SEQ ID NO. 27544
aagcccattgccttcttcctcaacccacctctctctttcacacacgcctctccctcctcctctctctttctttctctgtgaggcagccatttccgcttcctgtcgtgggggcttgcagcggaaggagggagagaaaagggggctgctgctactgctgctgctgtttcggtgcggcggagatgtctgaggtgtcggtgataaaccaggcggaggtggaggacgccggccagctggacctgccgccgggcttccgcttccaccccaccgacgaggagatcatcacgcactacctcacccacaaggccctcgaccaccgctacacctccggcgtcatcggcgaggtcgacctcaacaagtgcgagccgtggcacctcccaggcagggccaagatgggggagaaggagtggtacttcttctgccacaaggatcgcaagtacccgacggggacccggaccaaccgcgccacggagaccggctactggaaggccaccggcaaggacaaggagatcttcaggggccgcggcatcctcgtcggcatgaagaagaccctcgtcttctaccgcggccgcgccccccgcggggagaagaccggctgggtcatgcacgagttccgcctcgagggcaagctgccccacccgctcccgcgctccgccaaggtccggcgggccccgtcccgtcgcgcctcccttcatctccctcgtcggtgagc

SEQ ID NO: 27544 - protein, 175 aa, Panicum virgatum
  misc_feature: Ceres CLONE 1877865
  misc_feature (20)..(147): Pfam Name: NAM Pfam Description: No apical meristem (NAM) protein
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Functional homolog of the protein sequence given in SEQ ID NO 50639
  misc_feature: Useful for making plants with altered terpenoid content
  misc_feature: Functional homolog of the protein sequence given in SEQ ID NO 51052
  misc_feature: Useful for making plants with altered lignin content
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Functional homolog of the protein sequence given in SEQ ID NO 50641
  misc_feature: Useful for making plants with altered carbohydrate content
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Functional homolog of the protein sequence given in SEQ ID NO 51019
  misc_feature: Useful for making plants with altered cell wall content and/or composition
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Functional homolog of the protein sequence given in SEQ ID NO 50732
  misc_feature: Useful for biocontainment applications
  misc_feature: Useful for making plants with modulated biomass
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1729 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 853 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 50326
  misc_feature: Useful for making plants with modulated light quality response
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 1012 in the 11/435,388 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 854 in the 11/435,388 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 886 in the 10/412,699 US patent application
  misc_feature: The sequence is a functional homolog of SEQ ID NO 344 in the 10/666,642 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MSEVSVINQAEVEDAGQLDLPPGFRFHPTDEEIITHYLTHKALDHRYTSGVIGEVDLNKCEPWHLPGRAKMGEKEWYFFCHKDRKYPTGTRTNRATETGYWKATGKDKEIFRGRGILVGMKKTLVFYRGRAPRGEKTGWVMHEFRLEGKLPHPLPRSAKVRRAPSRRASLHLPRR

SEQ ID NO: 27545 - DNA, 620 bp, Panicum virgatum
  misc_feature: Ceres CLONE 1877866
  misc_feature: Encodes the peptide sequence at SEQ ID NO. 27546
aacgggcggtgtgcgcctctcctctcctctgcgatgtggtacggaacacgggaacagcgtgctcctccctgactcctccatcttccttcgcgcgaggcctgttcgatcggatggctggttccctatccggccggactcggtgctccaggcgaacctatcggaatacgccgctcgcgccgttcgattgggacaagaacaacccaccgacgcctacgactgccgcggccggtgcgacacatccctcgccgtcgccgtctcggcgactgccagacttccagccctcggtgccgttcaagtacctgaaactggggtaccactacctcatctaccagacgtatgtacctgctcgctcgccccgctgatggtgctcgaggtcgggcacctctccttactctccccgcgctacgtggactaccgtgtgcgcgcacctccgtctcaacgttgtctccatgctcgcctgctactcgctcctcttcttcctcgccaccgcttacttgctcgcgcggtccctcaccgcgtacccgtgccacatctgcagcaacacgatatcgctcaatagcatcagctcgcgcgaccttttcatgctgtgttcacacttcacggtctacttcaccgacgga

SEQ ID NO: 27546 - protein, 83 aa, Panicum virgatum
  misc_feature: Ceres CLONE 1877866
  misc_feature: SWISSPROT Homolog: EC 2.3.1.119 Icosanoyl-CoA synthase
MAGSLSGRTRCSRRTYRNTPLAPFDWDKNNPPTPTTAAAGATHPSPSPSRRLPDFQPSVPFKYLKLGYHYLIYQTYVPARSPR

SEQ ID NO: 27547 - DNA, 581 bp, Panicum virgatum
  misc_feature: Ceres CLONE 1877870-R
  misc_feature: Encodes the peptide sequence at SEQ ID NO. 27548
aaagagcactgaccacatgggcatcatggatcgaccgttacatcaatccacggcaaactcaagtgttcttccgaagctcatccccctctcactttagcggaggcgagtggaattcagggggacactgcagagcgagtacactagcccctaacgacggtcgtgtgtggccaatgccggagataaacgtgatgcttgaacagatctcgaagcagatgaagactcctgtgacaattctgaacattaccgatctgtcccggctaaggaccgatggccacccctctatttatcgacggaagggagtagatttaacagcatccagcggccaggattgcagccattggtgccttcctggggtgccagatacatggaatgagctgctgttctaccatctagtgtcttgaaaagaaatgcttggaacaagatagtgactgaattgtcggtcccttttctttggttgtagagagggcattgtgattttttttcctgtaaatgtaatttgattgcgaaaagagagcacaatcatgtatatgttggcacctttatcctctgctgataatatgtcgagcacacagtcagatgcc

SEQ ID NO: 27548 - protein, 132 aa, Panicum virgatum
  misc_feature: Ceres CLONE 1877870-R
  misc_feature: Functional homolog of the protein sequence given in SEQ ID NO 50418
  misc_feature: Useful for making plants with altered cell wall content and/or composition
RALTTWASWIDRYINPRQTQVFFRSSSPSHFSGGEWNSGGHCRASTLAPNDGRVWPMPEINVMLEQISKQMKTPVTILNITDLSRLRTDGHPSIYRRKGVDLTASSGQDCSHWCLPGVPDTWNELLFYHLVS

SEQ ID NO: 27549 - DNA, 1425 bp, Panicum virgatum
  misc_feature: Ceres CLONE 1877870
agaggagccacgcctcttgctccagctcgtaccactgccacctgctgaacccgaagagcctcctcctcgtctccctcgcctcgttacccctcttcttggcgctccgccacggccgcccgctccaccttcccttggcgttcgccgctgccccagcgccggttcttgtggctggtaggtggggctacccagcggcggaggtcgaagaggcagttgttggtctcgggagaggggattcggtcgctgagggagcgagccccgctgttgccggaggcttgtcggtgcggggcgtgggctcggcagcagaggctcaaggaggaggaaatggtggaactccttcgaatggtgaggatttgaatgggcaggaggttgcggaagctcgaaatctcacacttggaggcttggattcggaagtgaaagaagctgctcctcaacctcaaggcagtggtggcgagaggctggcgaaagcgaaatatttgatttcggagaggccaaacttagaagagggcaagaatcttagcaaagaaagtcttggttcgtcagctgcatcagcaaagaaattggagggaaaggggtctccgcgggatgtcaatttctccactgaagcttcaggtcctgcaaaggggacgacagacgaattcttgcaagatgaccatgttgatgatgggcgcaattcctccctacatatagcttatgcttctcaacaggggagacgcagggaaagctcagataattcaatgttagggtacagccctggagcagctccagtcaatccagataaacaagaaacggccaagagcaacatggattttgcaagaagcaatgctgcacagtgtgatgtttctgacgggagttgggtgttcgatgaaagctatccactctatgagagcaattcttgcccttttatagatgaagggttcagctgccaagctaatggaagaatggatgaaagctacatgaagatgcggtggcaacctaagcattgcagtgtcccaaggttcgatgcaaggaaaatgcttgagatgctgcgaggaaaacggctagtgtttgtcggagactccattaacagaaaccaatgggaatccatgatgtgcttgctaagcacggcaatctcatatccttcaagaattcgtgaaactcgtggccgcaagattactaaagagaaagggtattacaacttcaagttcctggtttgtatgatctactatagctaatgtacagctagtcccgttcagtgtctagactactgtgtaatagtcatctcagtatggttgttgcaggactacaattgcagtgtggagtatcatacgacacatttcttggtgcatgaaaccaaggcaagaattggccaaaagcgcacaatgacactacgaatcgataccatagatcagagctcatcaagatggaaaggtgctgatgtgcttgtgt

SEQ ID NO: 27550 - DNA, 1355 bp, Panicum virgatum
  misc_feature: Ceres CLONE 1877878
  misc_feature: Encodes the peptide sequence at SEQ ID NO. 27551
tcgcggagcggagatgcagcagcctcaggggcaggcggcggcgctcgcggtggtgccgtcggcgtcggcggtggcccacccgaacgatccggcatggggagacgcgccgccgaagcaggtcgcgcaggcgatggagcgtctggggcgtgcggggcggctcatcgcggaaatccggctcggcgcggaccgcatcctcgaggccctcttcgtcgccggcggcgcgccccagcacatcgacaggacatcgcgcgctatcgtccaggaggaggccgccatgcgtcgccacttccaggacctccgcgcgctcggcaggcaattagaggagtctggagttcttaatggggcccttaaagctcgaggaaattcatggggcttgcacatgccacttgtttgtccagatggtgctgttgtagcttatgcttggaagcgtcaactggcaggtcaggctggtgcatctgctgtggacagaactaggttagctttaaaggccttcactgaccagaaaagaagattctttcctcatctagaagatgaagtccttagccatctccatgatggtgagcctggtgtcgccaaaaagccaaggttgtctgccagtaatggagagcttggggaatctttatctgaaatactgaaaaatctggaaaatgaagtgcctaacatgaaaatattcacataccggcatctggattggtctaaaagagcttcgtcattagcatctctgatggatgatgagtttgtggatccatctaaagagttgaacctgcaaaattttggcaaatcgagatccagtgctctgacaacttccatagaccaggttgcagtgattgagttgttggttccttcaatatttcgagctatagtgtcattgcaccctgctggatctactgatcctgatgcagtggctttcttctctaccaccgagggaggaagctaccttcacgcaagaggcacgtcaatgcatcatatctttaagcatgtaaaggagcattctgacaaggcattgcagtactttgtcagtgtggagcccagtaaagcactgtctctgcttttgcgttggattgccagctatcagactctgtttacaaaggtttgcagcaaatgcagacggcttctgatgatggacaaatccttggctttgcttttgccaccagtgcaccgcccatatcaccagacttcaaatgttggcccagatcttcaggaggcgtatcacattggatgttcttcctatgarggctagctaatgattcttacgaacactcgagactctttaagatagcatagattggttcaaacgctgtcacctaacaaagcacatgtgcaagaatcgttctatgtacaacagtgtttttttt

SEQ ID NO: 27551 - protein, 408 aa, Panicum virgatum
  misc_feature: Ceres CLONE 1877878
  misc_feature: Functional homolog of the protein sequence given in SEQ ID NO 51251
  misc_feature: Useful for making plants with modulated oxidative stress sensitivity
MQQPQGQAAALAVVPSASAVAHPNDPAWGDAPPKQVAQAMERLGRAGRLIAEIRLGADRILEALFVAGGAPQHIDRTSRAIVQEEAAMRRHFQDLRALGRQLEESGVLNGALKARGNSWGLHMPLVCPDGAVVAYAWKRQLAGQAGASAVDRTRLALKAFTDQKRRFFPHLEDEVLSHLHDGEPGVAKKPRLSASNGELGESLSEILKNLENEVPNMKIFTYRHLDWSKRASSLASLMDDEFVDPSKELNLQNFGKSRSSALTTSIDQVAVIELLVPSIFRAIVSLHPAGSTDPDAVAFFSTTEGGSYLHARGTSMHHIFKHVKEHSDKALQYFVSVEPSKALSLLLRWIASYQTLFTKVCSKCRRLLMMDKSLALLLPPVHRPYHQTSNVGPDLQEAYHIGCSSYEG

SEQ ID NO: 27552 - DNA, 2858 bp, Panicum virgatum
  misc_feature: Ceres CLONE 1877884
  misc_feature: Encodes the peptide sequence at SEQ ID NO. 27553
actgcctgctctctctctctctctctctccccctcgtggactcctgccctgcgccgccgcccctttcgccggcggttgggagcaagcgcctccggcctccggccctttcgctggcggcttccagcgagcacctccgcctggatctacagccgccggccgccggccgctggaatcccagatgtcattacatattggtcggctttcccaagatgtgcggcaaagttatctggaacatcttttccagaggtttggccgttgcactgtgaacctgaaagatggatatgggtttgcagtgtatgattctgatgatgatgcaactcgggccctgcgggccctgcatgggaaatatgtttgtggggagcgcatcactgtcaattggtcaaaacagcagcccagattttctcagggtttgaggaggagttcaagattcgttgaaccatttcgtggaaggaactttagagatgctcggaacaatattagattcagggattctgtagctcggaagaatcacccagcagatcacgatcagggtcataatcctgatgctgtgccagaaaaggaatctgataagtttgcggagattgtcaatgatgctggagaaaatgatggtggtgatctagaggaggtaaagagggatgaaggtggtacaattgatgaagatccaggagaaatgaagacggaagaaggtggaaaagatgatgcaaatgcaattgaacatgacagatgggctgagactggaaaaggtacccctggtggagatggtgatgattttgatcgctatgagccttatcatggatatgataagcaagaagaaacagaaaatgtgactaaagcaagctcttatgattctcgtgaacaaaggcgttcttcagacaagtggcaagagcactcggataggcgtgttaacataagccatgataaatcaagatctcctccaacctgttacagttgtggcattaccggccatattgcacataattgtcctcagggagtagatgataacttcaaagcaaggagagatggattgaacttcagggagaaatggcagctgaggcagagaagatttgggtctccctcaaggaggcggccagaatttcatgttgatcctttggatcaaacaaattatagagttcaagatgagaggaaaccattttctgataggaatatgagagtgcctgggttgagtactgcacccagagacagcagaagacatgcccactgcagtgaaaacatgccacaaaccaataaggaagcacgcaagagaagcagatctgaaagatcacgtggatcatccccctcttctgaaccttcaaggcactctcaccatgataatgttaagggatcacattccaacaggacttgctcagattcaagatctaggtctcgatcccggtctcgattcagagcacattctccatcatattctgcacattctagtgcaaaatcagctcaaccaactgagcaggaaggatcaagatcaaatatcaatcatcctgttccattttcagtatctgcttcaccacagcataagtcatcatctgatgtagagaacaaaaatctagatggcatgacaaattctcccttggaggacaatttggagttcaggacaagatctgaagaaaaaaatatggatggtaacaagcaagaaggaaagggttcagtactgaacagcacggtcctgaataggaaagcgcttgctcctgctaaggatgctaatgctgctggttgcacaggagttaactttgataagaacttgattgatgataatgctgccaatggaatgcaaagccagaatgccaactttgatgactcttcatcaatgaagtcaaagcaggatgttgtggtcaaaaatgggagaaacaagtcattgaagctaacaactaatgaagtgatcacagctctgaagcactatggggtggaggcacaagaggattcatcagatcaacctgtggagaagtactttggtgctgcacgcctgtggccttgggaaatcatttactatcgcagacgtaagaaaggtccaatatctacagagaattatgctaagcgacttgagcagaacaaagaatttggtattgtggatcagtatgtcagaagcagcagtggttggtgggagtgcgattaaagtgtcaggtgtctacttggttccaaggctctacatgaatatgtcctttgcactcatgatgcattttaaggatgacaaggtttgtgtgctctttctaggtttcattctggcttgttttagggcatgtttggatgtgcagattagacccaatcccttcaaacttggagggaaaataatctaattttcctgccaacctgaggggatcaagtgtgaaacctaccaaacaagcatgctattttcattcccagtattagtgttctgtgaaccacaagtgattggtgtttccatacctacatgaatagatccattaaaactagaaccaaaagtgataggtcctttcattgctatgattctcttgggtaaagtttatgcctaaaggcttcatgttggaaaatggcaatacaatctttttgtcagtgttatacaatcatcacggcacatgtagatgttggtatcttttgtccatctcatgtgtcttttgagtcgcgggttcgatcccagtaggttcattttggtgggcaacagacatcaaggaacagcctcgtgtttagcaaatccatgatgaagctgaaaaagttccctctccatcaaggtctggatatgtaaggatattatatcacaagtaatatatggaagcggctaccttggctttatgtatgacattaggcttacatttgtcatcaagagcacattaatgagagatatatggtccttcccgaggctttcttgctag

SEQ ID NO: 27553 - protein, 648 aa, Panicum virgatum
  misc_feature: Ceres CLONE 1877884
  misc_feature (3)..(65): Pfam Name: RRM_1 Pfam Description: RNA recognition motif. (a.k.a. RRM, RBD, or RNP domain)
  misc_feature (253)..(270): Pfam Name: zf-CCHC Pfam Description: Zinc knuckle
MSLHIGRLSQDVRQSYLEHLFQRFGRCTVNLKDGYGFAVYDSDDDATRALRALHGKYVCGERITVNWSKQQPRFSQGLRRSSRFVEPFRGRNFRDARNNIRFRDSVARKNHPADHDQGHNPDAVPEKESDKFAEIVNDAGENDGGDLEEVKRDEGGTIDEDPGEMKTEEGGKDDANAIEHDRWAETGKGTPGGDGDDFDRYEPYHGYDKQEETENVTKASSYDSREQRRSSDKWQEHSDRRVNISHDKSRSPPTCYSCGITGHIAHNCPQGVDDNFKARRDGLNFREKWQLRQRRFGSPSRRRPEFHVDPLDQTNYRVQDERKPFSDRNMRVPGLSTAPRDSRRHAHCSENMPQTNKEARKRSRSERSRGSSPSSEPSRHSHHDNVKGSHSNRTCSDSRSRSRSRSRFRAHSPSYSAHSSAKSAQPTEQEGSRSNINHPVPFSVSASPQHKSSSDVENKNLDGMTNSPLEDNLEFRTRSEEKNMDGNKQEGKGSVLNSTVLNRKALAPAKDANAAGCTGVNFDKNLIDDNAANGMQSQNANFDDSSSMKSKQDVVVKNGRNKSLKLTTNEVITALKHYGVEAQEDSSDQPVEKYFGAARLWPWEIIYYRRRKKGPISTENYAKRLEQNKEFGIVDQYVRSSSGWWECD

SEQ ID NO: 27554 - DNA, 2085 bp, Panicum virgatum
  misc_feature: Ceres CLONE 1877885
  misc_feature: Encodes the peptide sequence at SEQ ID NO. 27555
attccttgatctttcgctcgctccaagacgcccattccagctccggagatccgagcacctcctgtggtttccgagctcggagaggcccaaattcagctcgaattggagctgtttctggccgctgagctcgaatcaatccaagaacaagcggctcggcaacaagtgtccttggcttcccccgatccccgggcttcgattcggtcgaatccgacctaattttattgtttttccgttatctcgctgcgcttttcctttctccttcctgtcgcaaagtgggttccatcgcgtcacccccacggctcctccgatcgggcggcgaaagaaagcggcacaaaagggataaaaaggagagctcttgatgcggttttggtcgtagcagcaccagcaaccccactgcttgtggcttctcccgctgtttgtcctcacggagcagcggcgggctccccggagtcggcagcgcgctcctccgccggcgcgcgctgatgtttgccctgctcgccgccttcgtcgttgcctgcctgctcttcctgtccaagccatgcgcgcgtgacatgagactgttcctcgcctccctgttccagcaactcgcgctctcactgctcgggttcctggcgggcctccgcctgctcggcggcgtcgcggccgccccggagaccatgccgctcatgccgtccttcaagaggaagcgggcggcggcaatggtggggaatgcggaggaggtcgccgccgccgccggcggcgagccgtccgtgctcctcgacctgcccgagctggccatcgattgcattctcgagaggctgccgccggcggagctgcggagcatggccgccgtctgccgctccatgcgggagcgctgccgcagcgaccacctctgggagcgccacatgtcggacaagtggggccgcgtcctggggcgcgccgcccgggacgagtggagggcgcacctggcgtccgccagccagtccggcgccgcgggctccgcctcgggctgcggcggcggcaagcgccggaggtggctcgccgcgctgtcctgcgtctgtccggtggtgtcctggatgcggcccagggcggacagtggcaagtcctccggccctgtgctggatgattccatcatgtcgtggtatctgtccatggagagcggcaagttctggttcccggctcaggtttacaaccgcgagcatggccatgttgggttcatgatgtcatgctatgatgcagagctcagctacgattaccattccgacacattccgtgcaaggtatccaccacacgggcgacgaactgtggtcttggaggatggggtgcaatgggacagggtcagggcaccgcctgtcgacactcttgcacatgacctacatgcctccgattgcctacatgaactccggcctggcgaccatattgagattcagtggagaaggaacaaagaattcccatatggctggtggtatggagttgttggccacttggagtcatgtgatggaaatgagcacttttgtcggtgtcatcttagtgataccgttgtgctggagttcaatcaatacacgcccggctcaagatggaggcaagcgttggtgaacaggaaggaccacagggaagagggcaatgagggcgacgggttctacggcgggataaggaagctccacagcaagaatgacatctccaagtggaggcagctgtggccaacagacatcctggagtagcaaagaagagactatttcgccatcgccattcatcagattgctcaattgacacactttccattgaccattgctgtgctctgtggacggccacttcctctgtcgcgctgttgtacacgagttagaacatgaggtgacaaacaaatctggtagctggacacgggtgtaaacttatatcatcaggcatagacggccgcacggtcacaggctgcttcctattcagggggactgtaagccttcattgagcctccagccagtatgtgtacctgtggcctgtgcctttgcctgttgttgtagctgtagagcagaaagatcaaatgtaaattacattttttagctcagattcatgacagattgccagattggtataccgtggctcgtaatttcc

SEQ ID NO: 27555 - protein, 405 aa, Panicum virgatum
  misc_feature: Ceres CLONE 1877885
  misc_feature (89)..(136): Pfam Name: F-box Pfam Description: F-box domain
MFALLAAFVVACLLFLSKPCARDMRLFLASLFQQLALSLLGFLAGLRLLGGVAAAPETMPLMPSFKRKRAAAMVGNAEEVAAAAGGEPSVLLDLPELAIDCILERLPPAELRSMAAVCRSMRERCRSDHLWERHMSDKWGRVLGRAARDEWRAHLASASQSGAAGSASGCGGGKRRRWLAALSCVCPVVSWMRPRADSGKSSGPVLDDSIMSWYLSMESGKFWFPAQVYNREHGHVGFMMSCYDAELSYDYHSDTFRARYPPHGRRTVVLEDGVQWDRVRAPPVDTLAHDLHASDCLHELRPGDHIEIQWRRNKEFPYGWWYGVVGHLESCDGNEHFCRCHLSDTVVLEFNQYTPGSRWRQALVNRKDHREEGNEGDGFYGGIRKLHSKNDISKWRQLWPTDILE

SEQ ID NO: 27556 - DNA, 1911 bp, Panicum virgatum
  misc_feature: Ceres CLONE 1877888
  misc_feature: Encodes the peptide sequence at SEQ ID NO. 27557
ttcacagttgaacccaacctacctccacacacgcgcgctcgctcccggcctgggggcgataatttggcggcgccgcttacctgaggtggagggaggctgcccgcgcactcccgcagcggcggcggcggcgcgacgctcggccgttctgcgcaggcccgaaggaagacccagcgcttcagagatcggattgaggatggaaatctccgacgagctgcggtcgttcgaggccaccggcgtctaccgcctcaacgtcaccggcaccagcaccggagccgccttcctcgatccggtccgcatcctcaacgggtcctaccagcgcttccgcatcgttcctcctgcctactactccagaagcttcgagccgccgcgtcaggtaggcgacccagagaccgagccgctcgagaaacggaggaagcgcaagcgcaaccagaagccgaaacccagggagctcaatgccatggagcggatcgctgaagcgcggcaccaggaagcaaggcctttactcttgagtgcacatgaatcactcattaaggataaatatctactagagcacctttccaagaagatggagggcaaggagcacaaacttgatgtaggaagtggttctgagaataatttcgtcgagcttggaagctcatggcgatcacctttctatgagatcattatttgctttcggaaaccccatgttctgggcaatggggaaggttcctttgatgcccaaaagacatcctttccactatttaatagcataatcagtgttgaagcgattgacgaggtggagggagacttccagaacaggcactacattttaccacgaggaagttgcttcttgatgagcgacttcaaacgtgttcgagatctcattcctggtagttcaaatcaacggtataatcttatagttgttgacccaccttgggagaatggatgtgttcgtcagaaagaagcgtatcctacacttcccaacagacatttattgtatcttccggtgcaagaacttgcccatccagccggagcccttctcgttttatggattacaaatcgggagaaattgcggatgtttgttgagaaagagttgcttccttcttggggggtgaaagatcccactgtattttattggctgaaggtgaaacatgatggttctctaattggcgatctagacttgttccatcacaggccttatgaatgcctcctccttggctacataaatgtcgacacagatgctaagcaaggatcaaacttcaagttgttagaaggaagccaagtaattatgagtgttccgggtgctcactcaaggaaacctccccttgagaaattactttcagaatatattccaggtcctaaacctccaagatgcattgagctttttgccagagagttgtttcctggatggacctcttggggaaatgagccgctgcattttcaggattccatgtacttctcagagaagtaatttgattagcaagagcatgatatgagcgtctgaattgttgatgcaactgctacatgtgactaccactatatcttgtgtttttcactgctggtgaacactccagttccctgcattgatgtaatccgtgcttctgggaaactctgagcaagcagtaacaggcagtccaagagatgcagcagaaccagcattgcctgataaaaggttaagctcaccatcttcagaggattcagatatcacggtgatgtagttaaccactgaaatcagtctgatctttttttttatctatgatagtcataactcgtagcagtctgacagtacatcatagtaagtctgcaagtggcgtatacagtgtataagattgggagctttctggtgcggtgtgtgtgctctcacatgtatcatattggtattgcagaatgtacactgatttgccttgatgtaaagcgactcgtgttgttttc

SEQ ID NO: 27557 - protein, 418 aa, Panicum virgatum
  misc_feature: Ceres CLONE 1877888
  misc_feature (232)..(405): Pfam Name: MT-A70 Pfam Description: MT-A70
  misc_feature: SWISSPROT Homolog: EC 2.1.1.62 mRNA (2'-O-methyladenosine-N(6)-)-methyltransferase
MEISDELRSFEATGVYRLNVTGTSTGAAFLDPVRILNGSYQRFRIVPPAYYSRSFEPPRQVGDPETEPLEKRRKRKRNQKPKPRELNAMERIAEARHQEARPLLLSAHESLIKDKYLLEHLSKKMEGKEHKLDVGSGSENNFVELGSSWRSPFYEIIICFRKPHVLGNGEGSFDAQKTSFPLFNSIISVEAIDEVEGDFQNRHYILPRGSCFLMSDFKRVRDLIPGSSNQRYNLIVVDPPWENGCVRQKEAYPTLPNRHLLYLPVQELAHPAGALLVLWITNREKLRMFVEKELLPSWGVKDPTVFYWLKVKHDGSLIGDLDLFHHRPYECLLLGYINVDTDAKQGSNFKLLEGSQVIMSVPGAHSRKPPLEKLLSEYIPGPKPPRCIELFARELFPGWTSWGNEPLHFQDSMYFSEK

SEQ ID NO: 27558 - DNA, 515 bp, Panicum virgatum
  misc_feature: Ceres CLONE 1877892
  misc_feature: Encodes the peptide sequence at SEQ ID NO. 27559
tcgtagggtgccaccgtctcccctctgccccctgaaggaagagagagcgagcatctccgtctctcttcgtcggtggcgcgggtgcccagccctcccccagcgagatctccctgcacttcctccagatctggttacacatctccctgtcctgatggcgaacatctgctgcttcagtgctgggtatgttcgtggccccgccatggccgtcattgacctcgggtgcccacaccttggagtcgacgtcgttgacatatccgaaccaaggattgaggcctggaaccgcgacaccctccccatcagcgagcctgtgctccatgatgttgtgaaggactgcatgggcaagaacctcttcttcagcaatgatgatgacgacgccgctcgctgaagctgagttcttctttgtctcactgacctctcccaccaagagctctggtctatggagctggaaatgttgccaacctcaattactggaagtagcgctgctcgcatgatcactgatgtgtccaagtctgaca

SEQ ID NO: 27559 - protein, 77 aa, Panicum virgatum
  misc_feature: Ceres CLONE 1877892
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MANICCFSAGYVRGPAMAVIDLGCPHLGVDVVDISEPRIEAWNRDTLPISEPVLHDVVKDCMGKNLFFSNDDDDAAR

SEQ ID NO: 27560 - DNA, 2288 bp, Panicum virgatum
  misc_feature: Ceres CLONE 1877894
  misc_feature: Encodes the peptide sequence at SEQ ID NO. 27561
catacatcatcgaagaccacaagtagggctgcagctaactcaatgccacccaactaacttacgtgtttcactctacgcctcatgacctgatatatagtgaaagcttgaaataaagggtttgcaaaggcatggctttgtacaacctgctgacatttttcagtttgagctgcttgaggctttcctgagtcaaaacatttgctctcgaagctctcagtatcagggaaggatttttggttgacacttatagctaggcgctcgcgccattttgctggaacgagattcttgaaacgaggtgttaatgaaaagggcagggtcgccaatgatgttgagactgaacagattgtttttgaagacacatctgatggaatcccaagtcacatggcttctgttgtacaacatagaggatcaatacctcttgtctggtttcaggaaacttcaagacttaatattagaccagatatcatattaaaacccgatgtggactacaaggcgacccgccttcattttgagaaccttgcacttagatatgggaatccgataatcatcttgaacttaataaagacccgcgagaagaagcctcgtgaatctttgctccgcgcagaatttgcaaaggctattcattacattaataaggggctaacagaggacaaacgtctaaaatttttgcacatggatctgagtaagctttctcgaaggaaaggcaccaatgtgcttgcactgttgaacaaggtggcatccgatgtgttggatctaactgaattcctccactgcgaaataagtacatcagcaaaatctgagggtgccccaagtggtgaacgaaccgttgccaaaccacgtgatgacaaatgtagcagtgatcaaagcgaatgtgtagctaagttggtacctcttttgttacagaagggtgtcctcaggacaaattgcatagactgcttggaccgcacaaatgttgcacaatttgcatacggtttaactgctttagggcgtcaacttcatgctctggggattattgaatcacctaaaattgaattgcatgctcctctggctgatgatctgatggatttctatgaacggatgggtgatacattagctattcaatatggtggttctgccgctcacaacaagatcttctgtgagcaaagaggccagtggaaggcagcaacccaatctcaggagttccttcgaaccctgcagcggtactacaataatgcctacactgataacgacaagcaggatgctataaacgtattcttagggcattttcaacctcaacaagggaaacctgcattgtggaagctggactcagatcagcattacaacattgggaggcaaggaactttaaaagaagagattgcgagatcattcataaagaggtcgctatcagatggtaatattctgttggagaacagcttacctgtatctaactgcaacaatggagaaaagacaggattgctccctatgcaacaactggatgatattagagagccttctgattccgcaccagatatctccatatgtgaacctaacccaagttccagtatgaactatggcactgtgcctggaggaaggcactccatgtcagaagagtggcagaattatttgaaaagattaggctaccctgagttacattcttcgaattttcttgacctggatttgctgtcgtcttcggggaattcctgcgatgaggaagatgaggaagttttcgagaggtcgtcactaatcaattcacctatggatgagatcagtgttgaatcatctacgtcatatagcgaacaaggacatgtcgatgagggaagggatgacacggacctgtctcgctcaagcagccagctctcagacactagggactattctgatcgctttgcgcactggatcgctaatggaggcatgctttgctactaggtggttactttttgtcttggtgactgtagaaattttgatgcagcaggaaatggctgacaaatagagcaagatcaaacggctgactgctaggcgcatctgcctgcacaaaaggcgagactgaagagatggcggtcatgggagaagcctcgcaccatcgtggttgtgatcaatggaaggcttgatgaccttgataatcagacgaggagatggtggcggctggggtgggtacagaattcaatttgctatggtgaagaatttgaccatagtttagacaataaataggccaaactatatctgattcttttagcttagcttaccccttttttttctcctttctccatagaaattatcaaaagaaaaaagaaaaaaggggaaaaaatcgtacc

SEQ ID NO: 27561 - protein, 507 aa, Panicum virgatum
  misc_feature: Ceres CLONE 1877894
  misc_feature: SWISSPROT Homolog: EC 3.1.3.36 Phosphoinositide 5-phosphatase
MASVVQHRGSIPLVWFQETSRLNIRPDIILKPDVDYKATRLHFENLALRYGNPIIILNLIKTREKKPRESLLRAEFAKAIHYINKGLTEDKRLKFLHMDLSKLSRRKGTNVLALLNKVASDVLDLTEFLHCEISTSAKSEGAPSGERTVAKPRDDKCSSDQSECVAKLVPLLLQKGVLRTNCIDCLDRTNVAQFAYGLTALGRQLHALGIIESPKIELHAPLADDLMDFYERMGDTLAIQYGGSAAHNKIFCEQRGQWKAATQSQEFLRTLQRYYNNAYTDNDKQDAINVFLGHFQPQQGKPALWKLDSDQHYNIGRQGTLKEEIARSFIKRSLSDGNILLENSLPVSNCNNGEKTGLLPMQQLDDIREPSDSAPDISICEPNPSSSMNYGTVPGGRHSMSEEWQNYLKRLGYPELHSSNFLDLDLLSSSGNSCDEEDEEVFERSSLINSPMDEISVESSTSYSEQGHVDEGRDDTDLSRSSSQLSDTRDYSDRFAHWIANGGMLCY

SEQ ID NO: 27562 - DNA, 436 bp, Panicum virgatum
  misc_feature: Ceres CLONE 1877899
  misc_feature: Encodes the peptide sequence at SEQ ID NO. 27563
catccggctccgccttgcgctcacagctcatgccaaaggggacgagatcttgatccgtcccgcgccggccgacgctcttcgagctttcatcggttatgtagttccttagctgcggcgccttcaagccgccatgcacgctgctcccgtggccctcctggagcgggagcgcttgacgggcgacatggccttccccgacccggacgggggcgagccggagcccgggatcgtgatcaagatccgccggcggctcccggactccgcgcggaacatcaagctcccgtccctgcagctcgggatccgccacggcggcagccccacgtcggtgctgccgatgctctgcggtgtccgcgctcgccgccgccgcctactccttcgtccgcctcgacgtcatctactactccatccgacctgctcacctgcgtcgactggctctgca

SEQ ID NO: 27563 - protein, 101 aa, Panicum virgatum
  misc_feature: Ceres CLONE 1877899
  misc_feature: SWISSPROT Homolog: EC 2.3.1.119 Icosanoyl-CoA synthase
MHAAPVALLERERLTGDMAFPDPDGGEPEPGIVIKIRRRLPDSARNIKLPSLQLGIRHGGSPTSVLPMLCGVRARRRRLLLRPPRRHLLLHPTCSPASTGS

SEQ ID NO: 27564 - DNA, 2084 bp, Panicum virgatum
  misc_feature: Ceres CLONE 1877920
  misc_feature: Encodes the peptide sequence at SEQ ID NO. 27565
accaaacatcactagattttttaggagcgttctgctcgaaggactacacgattcactggacgtcgtattcagatctggaaaaacatttcttttcttttgagttggattccgacatcccattttttttcgttcgatttcgtttgatagcactgttgtgttgtgctcgtgctagtcttcagaaagaactcgagggaaagaagatggtattgcccgcgcagagcgccgctgtcctcgctgcggccgttgccatagccgccgccgccgccgccgccttcctcctcccaccgtcttcccgcctctcatgggcgcagcggggccgcttcgccgacatgatcctggccaacgccaccatctacaccgccgatcccgcccgccccttcgccggcgccatggccatccgtgccggccgcgtgctccgcgtcggggcctacgaatccgtcaaggagctcaagggtcgccacacgcacgagttgaatctcagcgggaacgtcgtgctgccggggttcatcgactcccatgtgcacttcatcgatggcggcctgcagttagcgagggtgccacttcgaggggtcacaagcaaagatgacttcataagcagagtcaaggaagctaccagagataagcatcctggacagtggattttaggaggaggttggaacaatgatttttggggaggtgattttccggatgcttcttggctagacgatatatcaccagataatccagtctggctctcacgcatggatggtcatatgggcatagccaactcattagctatgaagattgctgggattaacaggagcacaaatgatccaatcggtggaactatcatgagaacagcagaaggagagcctactggtcttctagtggatactgctatggtgcttatgtttgatgttattgaaaaagtttctccccatgaaagaagggaggcgcttcttagagcaagtaggcatgccctaatgaggggggtgactactgttgttgatgttggaagttacttccctggagtctcagctgagaaaacatggcaagatttttcagatgtctatgagtgggctcacactatgcaaaaaatgctgatcagagtatgcttattcttcccaatgcccacatgggatcgtgtttctaatcttatcggtgaaaatggtcgatcgcttagtcaatggatctatctaggtggtgttaaagcttttcttgatggttctctgggttcttcaagtgcattgttccatgagccttatgagggtgatcctggcaattatggtcttcaagtgacagatatggatagtcttctaaatagaactttagaatctgacaaatctggacttcaggttgcaatacatgcaattggggataaggctaacgacatgctgctggatatggtcgacaaggttgttgatttgaatggagtgaaggaccgtagatttcggattgagcatgctcaacatcttgctccaggtgcagcaaaccgctttggcaagcaaggtatcattgcatcagtgcagccagaccatctattagatgatgccgactctgccgcaaagaagattgggtttgaccgcgccgagcgaagttcctatacatttcggtcactgttaactggtggcgcgcagctagcttttggttctgactggcctgtttcagatatcaaccccatgcaagcgattcaaaccgcaatctcccgtaagcctcctggatgggaggtcccctggatccctgcagagcgtttgtcgctcgatgaatcgctgaaagcgcatacgatatctgctgcctacgcctgcttcctggaccacgccgtgggcagcctctctcaagggaaatacgccgattttgtggtcctgccttccacttcgtgggacgacttcgccggcgatctgccggcgcacgtcctggccacgtatgtgagcggcaagctggcctacccgtgaagcatgcccagatcgagtggcgctcgaaagaatcttatgagaagttcttcagatgcacctatgcgttgcgtaatcaccaccattcttaatagaatttgtagaatcaccattgtttgacaatgcagtatatggagtgttttctgttctttgccc

SEQ ID NO: 27565 - protein, 576 aa, Panicum virgatum
  misc_feature: Ceres CLONE 1877920
  misc_feature (97)..(547): Pfam Name: Amidohydro_3 Pfam Description: Amidohydrolase family
  misc_feature (62)..(140): SWISSPROT Homolog: EC 3.5.2.7 Imidazolonepropionase
  misc_feature (465)..(575): SWISSPROT Homolog: EC 3.5.4.28 S-adenosylhomocysteine deaminase
MVLPAQSAAVLAAAVAIAAAAAAAFLLPPSSRLSWAQRGRFADMILANATIYTADPARPFAGAMAIRAGRVLRVGAYESVKELKGRHTHELNLSGNVVLPGFIDSHVHFIDGGLQLARVPLRGVTSKDDFISRVKEATRDKHPGQWILGGGWNNDFWGGDFPDASWLDDISPDNPVWLSRMDGHMGIANSLAMKIAGINRSTNDPIGGTIMRTAEGEPTGLLVDTAMVLMFDVIEKVSPHERREALLRASRHALMRGVTTVVDVGSYFPGVSAEKTWQDFSDVYEWAHTMQKMLIRVCLFFPMPTWDRVSNLIGENGRSLSQWIYLGGVKAFLDGSLGSSSALFHEPYEGDPGNYGLQVTDMDSLLNRTLESDKSGLQVAIHAIGDKANDMLLDMVDKVVDLNGVKDRRFRIEHAQHLAPGAANRFGKQGIIASVQPDHLLDDADSAAKKIGFDRAERSSYTFRSLLTGGAQLAFGSDWPVSDINPMQAIQTAISRKPPGWEVPWIPAERLSLDESLKAHTISAAYACFLDHAVGSLSQGKYADFVVLPSTSWDDFAGDLPAHVLATYVSGKLAYP

SEQ ID NO: 27566 - DNA, 1056 bp, Panicum virgatum
  misc_feature: Ceres CLONE 1877922-R
  misc_feature: Encodes the peptide sequence at SEQ ID NO. 27567
gttctgcttctacatcttcctacttacttactgcagacactgaagtgtagaatagcacatgggtatatatacacacactaactacttgctgcctgtctcattgattactgtatctctatctatgttctgtgttccctcagttatcagtctacctgcttccacacacatcctgtttccaatctcctacttccatcattcgtgcagggaggatcccctttctctacctggaggatatccagatgaggttcatgaagaactacggcagagtcgcgcactccgcgctcgcctatgccatgaacgatgagttctccagggtcctccaccaccaaatggagttcttctccagcaaccccagcgccgacacgctcaaccgtctccgtggagaagtcagcgagatacacaccgttatggtcgacaacatagagaaaattctagacagaggtgaccgcatctcactccttgtcgacaagacatccaccatgcaagacagcgctttccacttccgcaagcaatccaagaggctccgcagagcgctttggatgaagaatgccaagcttctagctgtgttgacggttgccatagtagtgctactctacttgctcatttctgctttctgtggaggcctttccctaccatcatgcagatcatgaataatggctgtccctcgttcggagcatacacggttccccaccgtattgagcgcctgagctcgcagagccagaacggatgctttgagaagtaggcttgcaatgtggtttccagttagagggagtttgttttttgccggcatgagctttctgaagtgattcctgcaaaaacgggttcagaatgtacagtagtgaacagttgtttcaaggagcggagttgccctttgctgtacttatctctttcctgatgtggcctttcgtggatgagtctaatgtcttggattgtgcttgtgtggatgggtttggggtctagtgctgcctgctatctatatatattacatgtgtactctgcagtgaatgttaattgtatacttttgttagcagtctatcagaattaatacatactacg

SEQ ID NO: 27567 - protein, 136 aa, Panicum virgatum
  misc_feature: Ceres CLONE 1877922-R
  misc_feature (39)..(127): Pfam Name: Synaptobrevin Pfam Description: Synaptobrevin
MRFMKNYGRVAHSALAYAMNDEFSRVLHHQMEFFSSNPSADTLNRLRGEVSEIHTVMVDNIEKILDRGDRISLLVDKTSTMQDSAFHFRKQSKRLRRALWMKNAKLLAVLTVAIVVLLYLLISAFCGGLSLPSCRS

SEQ ID NO: 27568 - DNA, 670 bp, Panicum virgatum
  misc_feature: Ceres CLONE 1877922
acgccgctgcgctgcgccccaaatccgaatcccccaaccccaaaccaaacccccaattcctcagggaggcgaattcgagtgaggtcagatcagaccccgcagccatcaggggatccaaatccaaatccatctgatcagatctctccgacccccatccccatggcgatcgtgtacgcgctggtggcgcgcggcaccgtcgtgctggccgagttcgccgccgtctcgggcaacgccggcgccgtcgcccgccgcatcctcgagaagctgccgcccgacgccgactcccgcctctgcttcgcgcaggaccgctacatcttccacgtcctccgcgccgacgccggcatcaccttcctctgcatggccaacgacaccttcggaagtatacctcctgcattcaatctgctactctatctatctatgtactgtactctactgtatgattcatcttgctttggaccaccaaccatttccctgccgcatacctcctccactagttgcttctaatctcctactacttactggagatacggcaatgctattcaccttctattatactagaaaaaataatcatcaaaatactcaactaaatttaccaggttactcaacattactggttacttaactactaaaaatttattcagtaattctatctatattctgcttctaatct

SEQ ID NO: 27569 - DNA, 1936 bp, Panicum virgatum
  misc_feature: Ceres CLONE 1877935
  misc_feature: Encodes the peptide sequence at SEQ ID NO. 27570
aggccccggcctctcgtcgcacactcactctcctgctgctgctcctgcttagctccatgtcaccaaccctcgactgtcaagctcgcgatgctgccactacaagaagcgttatggcgcattgccacccatcatgctagcgcctgttccgctccgccagaccgtcacggagttttgctcgcactcgcagcgccttagctagctcaccggcccaacgaagccagccaagacacgccggcggcggggcaccatgacgtcgtctccgcaagctgccggcacccgcgccgtcgagcccgccgcccacgcttcctcccctgagccgtcacggtgctcctactccgccgccgccgccccctcgcgcgccagcgacgactcgtgcgtggtcaacgacgtcgacgccttcgcgcgcaccatcgccgccatccggtccaagccgcccgcggccgccgcggcgggcacgggcggcagcctcgcctccgtcctgtcgcactacgcggcgaggtggctcccggacgcggcctcctccccgtccggccgcttcctgctgccccccgagagccccaccgccgcgtggctcaagaagcgcctcctcctcgagtccctcgtcgccgcgctcccgcccgacgacgacgccgccggcggcggcggcgagggcatcacgtgcgacttcctgctccggctgctccgcgcggggagcacggtgggcgcggaggccgcgctgctcggggacctggaggcccgcgcggcgcggcggctggaccaggccaccctgggcgccctgatgatcccggcgttcggcgggctggcccgcggtgccacgtccccgcgcgcgccgtcgccgacgctgctggacgtgccgcttgtgctccgcctggtgcggggcttcctccgggagggcgccaaggccggcgggggcggcgcggcggccgccagggtggcgaggctggtggacgcgtacctggcagaggcggcgctggaggccgggctgcggccggccgagttcgaagagctggcgcgcgcggtgccggcgcacgcccgcgctgccgacgacgggctgtaccgcgccgtcgacacctacctcaaggcacacccgcgggcgagcaaggaggagcggcggtcgctgtgccggctgatcgacgcgcgcaagctgtcagcggaggcggccgcgcacgccgtgcagaacgaccgcctgccggtgcgctgcgtggtgcaggtgctcttcctgtcggagcacggcggccgcggcggggccaggctcagccaccaccgcctcgccgagtggaccggcggctccttccgcgacctgcaacagatcaggagccccgcccccgccctcgacctcccctccgccgccgtcgtggcgaccggcgcgcggtgcccgtcgaagcgggaggtcgtcgccgcgcagcaccacgagctgcgccgcctccgcgaggacgtcgcccgcctccaggtgcagtgccacgcgctgcaggcgcaggtggaccggctgagctcggagggccgccggcggcgggggctgttcggctggggcgccaccctcctgttccgcggcgggccgggcgcggcgagggtggacgactccgacagcggcgcggacaggacgccgctcagcggggggaagcagcagggccggcacgcgccgacgccggccacgggcacgccgacggtggcgaggtggcgcaggtcacactcctgaaggccagcatcgacgcggaagtctttgaaaatcaagtgaaattgtgctgtagtttttcatatttgttttcatttgctcatgcatgtgtgatgtgttccttcaaatctcgaaggaaataaatggaggcctcgccacgagcctgtgcgtggcgcctgtcccgccgcactagtacgctactgattgagtgattggttactgcttgtttctttgtgtttgaagtatcttttctgcggattggcg

SEQ ID NO: 27570 - protein, 482 aa, Panicum virgatum
  misc_feature: Ceres CLONE 1877935
  misc_feature (35)..(305): Pfam Name: NPH3 Pfam Description: NPH3 family
MTSSPQAAGTRAVEPAAHASSPEPSRCSYSAAAAPSRASDDSCVVNDVDAFARTIAAIRSKPPAAAAAGTGGSLASVLSHYAARWLPDAASSPSGRFLLPPESPTAAWLKKRLLLESLVAALPPDDDAAGGGGEGITCDFLLRLLRAGSTVGAEAALLGDLEARAARRLDQATLGALMIPAFGGLARGATSPRAPSPTLLDVPLVLRLVRGFLREGAKAGGGGAAAARVARLVDAYLAEAALEAGLRPAEFEELARAVPAHARAADDGLYRAVDTYLKAHPRASKEERRSLCRLIDARKLSAEAAAHAVQNDRLPVRCVVQVLFLSEHGGRGGARLSHHRLAEWTGGSFRDLQQIRSPAPALDLPSAAVVATGARCPSKREVVAAQHHELRRLREDVARLQVQCHALQAQVDRLSSEGRRRRGLFGWGATLLFRGGPGAARVDDSDSGADRTPLSGGKQQGRHAPTPATGTPTVARWRRSHS

SEQ ID NO: 27571 - DNA, 1653 bp, Panicum virgatum
  misc_feature: Ceres CLONE 1877937
  misc_feature: Encodes the peptide sequence at SEQ ID NO. 27572
agcttcttcttccatcgatctctttcctcctcctatccctcacctcatcgtcgtcttcctccctccctccctccctcgctcacctgtagctagctagctagctagcagctgctatacacacactcaccaccagctcgccggccaattgagccctccaccacctgtatccagagagagagagagagagagagagagagagagagagagagagagagagagagagagagagagagagagagagagagagagagagagagagagtacagaacgaagagccggccggccggcgagggatcaatcaatataatgagcatctcggtgaacgggcagtcgtgcgtgccgccggggttccggttccaccccacggaggaggagctgctcaactactacctccgcaagaaggtcgcctcccaggagatcgacctcgacgtcatccgcgacgtcgacctcaacaagctcgagccatgggacatccaagagaaatgtaagatcgggtccgggccgcagaacgactggtacttcttcagccacaaggacaagaagtaccctacggggacgcgcacgaaccgcgccacggcggccggcttctggaaggccaccggccgcgacaaggccatctacaacgccgtcaagcgcatcggcatgcgcaagacgctcgtcttctacaagggccgcgccccgcacggccagaagtccgactggatcatgcacgagtaccgcctcgacgacccggcagccgtcgtctccggcgacgacgccgccgccacggtcgccgctgctgctgccgcgtcgtcggacgccggccaggaggacggctgggtggtgtgcagggtgttcaagaagaagcaccaccacaaagagtcgggaagcgggggcggcggcaggcacggcagcggtcgagtgggcgacggcggcaagtcggcggcggcggcgcaccgcggcctgcagtactcctccagcgacgacacgctcgaccagatcctgcagtacatgggcaggtcgttcaagcaggagcacgagcaggtcctctcgccgcagggcggcggcgcggggccgaggtacctccggcccatcgataccgtgctgggcgggcacgggttcatgaagctgcccccgctggagagcccgtcggcggccgcgctgacgccgcacctctcggcagccggcgacgcggaggcggcgtccgccggggacgacctcctccacggcgccgggacggcgaacgggatcacagactgggccatgatggaccggctggtggcgtcgcacctcaacgggcaggcggccgaccccgccgcgccgccggcgagccaccaccagctctgcttcgacgacggccccggcgccgacgacgacgcggacgggctcgccttctacgccgccgccaccacgaggctccacgccggtggcggctccagcgacgacgacctgtggagcttcacgcggtcgtcggctcggccgggcgctgccacgtcgacggagcggctgagccacgtgtcgctgtagccgtccggccgtcgccggccggcctagctactatatatacatacgtaaagccccccactagctagctacaacgtgacatggccagcagctgcatgctgccctgctgtgccttggtacagtaaagagacaagcaacaccaacaacacc

SEQ ID NO: 27572 - protein, 399 aa, Panicum virgatum
  misc_feature: Ceres CLONE 1877937
  misc_feature (11)..(140): Pfam Name: NAM Pfam Description: No apical meristem (NAM) protein
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: Functional homolog of the protein sequence given in SEQ ID NO 50907
  misc_feature: Useful for making plants with altered carbohydrate content
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
MSISVNGQSCVPPGFRFHPTEEELLNYYLRKKVASQEIDLDVIRDVDLNKLEPWDIQEKCKIGSGPQNDWYFFSHKDKKYPTGTRTNRATAAGFWKATGRDKAIYNAVKRIGMRKTLVFYKGRAPHGQKSDWIMHEYRLDDPAAVVSGDDAAATVAAAAAASSDAGQEDGWVVCRVFKKKHHHKESGSGGGGRHGSGRVGDGGKSAAAAHRGLQYSSSDDTLDQILQYMGRSFKQEHEQVLSPQGGGAGPRYLRPIDTVLGGHGFMKLPPLESPSAAALTPHLSAAGDAEAASAGDDLLHGAGTANGITDWAMMDRLVASHLNGQAADPAAPPASHHQLCFDDGPGADDDADGLAFYAAATTRLHAGGGSSDDDLWSFTRSSARPGAATSTERLSHVSL

SEQ ID NO: 27573 - DNA, 645 bp, Panicum virgatum
  misc_feature: Ceres CLONE 1877938
  misc_feature: Encodes the peptide sequence at SEQ ID NO. 27574
gtatcgccgctccctttctccccccctgcctgcggccctgtccctgaatccgcggcggctcctgaggcgggcggcgcagcggcgagcggcgaggcgccggatctgcggcggcgatggaggcgtgatttgggcgggaggtaggcgaggcggggtgctggttttccgccgcgcaggagatggcggaggcgcggggaggggacttccccgtggggatgaaggtgctggtggtggacgacgacccgacgtgcctcgtcgtgctcaagaggatgctcctcgagtgccgatacgacgtaacaacatgtcctcaggctacaagagcactaactatgttgcgagagaataggcgtggttttgatgttataataagtgatgtccacatgccagatatggacggattcaggttacttgaacatgttggccttgaaatggaccttccagttattatgatgtctgctgattcaagaacagatattgtgatgaagggaataaagcatggagcatgtgactatttgataaaacccgtcagaatggaggaattgaaaaacatctggcagcatgttgttaggaaaaaattcaatgaaaacaaggatcatgagcattcaggtagcctagatgacactgatcgtaacagaccaaccaataatg

SEQ ID NO: 27574 - protein, 156 aa, Panicum virgatum
  misc_feature: Ceres CLONE 1877938
  misc_feature (13)..(126): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: The sequence is a functional homolog of SEQ ID NO 934 in the 10/666,642 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1410 in the 10/666,642 US patent application
  misc_feature: The sequence is a functional homolog of SEQ ID NO 476 in the 10/412,699 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 936 in the 10/666,642 US patent application
  misc_feature: Functional homolog of the protein sequence given in SEQ ID NO 51192
  misc_feature: Useful for making plants with altered lignin content
  misc_feature: The sequence is a functional homolog of SEQ ID NO 1104 in the 11/479,226 US patent application
  misc_feature: The sequence is a functional homolog of SEQ ID NO 2404 in the 10/374,780 US patent application
  misc_feature: The sequence is a functional homolog of SEQ ID NO 550 in the 10/225,066 US patent application
  misc_feature: The sequence is a functional homolog of SEQ ID NO 937 in the 10/666,642 US patent application
  misc_feature: The sequence is a functional homolog of SEQ ID NO 580 in the 10/666,642 US patent application
  misc_feature: The sequence is a functional homolog of SEQ ID NO 935 in the 10/666,642 US patent application
MAEARGGDFPVGMKVLVVDDDPTCLVVLKRMLLECRYDVTTCPQATRALTMLRENRRGFDVIISDVHMPDMDGFRLLEHVGLEMDLPVIMMSADSRTDIVMKGIKHGACDYLIKPVRMEELKNIWQHVVRKKFNENKDHEHSGSLDDTDRNRPTNN

SEQ ID NO: 27575 - DNA, 1726 bp, Panicum virgatum
  misc_feature: Ceres CLONE 1877940
  misc_feature: Encodes the peptide sequence at SEQ ID NO. 27576
accctctcctcgccgcgcggggaacccgaccccgacgccgacgaggcggagccggagcccgcctcagccgggagcggggcgggcccgggggaggaggagtcctcgccgcgcggccgcggcgctagccgggaccccggcgccgaggaacccgagcagcagccctgcacgccgagccgcggcgtcaagggcgacatctccgagctcaccgagaccctcacccgccgcctctggggcgtcgcatccttcctcgcgccgccgccagaagtgtcgaccccgcgcgccggcgccgcggctccggcggagggccgggaggatgaggaagccggggacgggggtgcggacggggaggaggaggccgaggcgctgtccccgcggatcgcggggatacggagcgatctggcggagatcggcgggagggtgaggagcggcttctcgatgctgcagagcaacctggccgtggccgagatctccaagatcgcctcgtcgctcctgccgttcgggcaggggggcgacgacgagggggagcccgttcccggcgtcaccgaggaggtggtggtgttcgttaggcacatctccacgcggcccgagacatggctcgatttccccctcttcatcagcgagcgctatgccgatgattttgaattgtcagatgctcaatatgtgcatgcattatctatagagcaccttgtcccaggcttatcagatttaaagattcagatttgctctactgatatgactgaagcgtgtttttggaagatctactttgttcttttgcactcaaaactcaaccagcaagatgctgaacttctttcaacaccacagatcctgcaagcaagggagcaattgctgcaaagtttacaggctcagaataagcggggatccaagttttctggtgaatcatcagagaatgtgaatgcatccactgctcctgctgaagagaaggtgattcaaccttcaagcatccaagataaagctgagacatcagagatttcatcatttgaagaacccacttccgatatcacgccagaaattgagtctgaaatttttttgatttcaaccactgacgtcgaaatagttgacaagtcagtgattgaggaagagttggcagtgaaaaacgagagcaagacatcacccgtccagtccaagcttcggtttgaaactgacaaagatgaagttgatgagtggcctgatgatgatcctgcagaagaggttagtgcagcaaacaatagaacttcattagggcgtgaggaagacgtgtccttcagcgatctggaagacgacgaggacgatgatgcgactaaaagggatgggcaatagccaagtggacaggttagctcaaaatctggtcctgttgcacaatcatctctgatccgacagaccgacactcccgcaaccacatgctggcttcatgggagtaggggccagatcacatccaaggatcattgctttgttatactattattagagcccggaattaatgaatccaaaggcgtagctcagtcttggataccctagatgcggaatcgtaatgataagcatatgcctatgcagctcgtgttagtgttaatggcgagcactgcatctgtattattaacctcgccctgtacatagagagcgccctatgggccttcttctttgtattgtaaacctaccactgcccatctgaacttcattgcctcctggtccatttcatacgagcaataattgagatctgaatctttggtct

SEQ ID NO: 27576 - protein, 438 aa, Panicum virgatum
  misc_feature: Ceres CLONE 1877940
  misc_feature (202)..(268): Pfam Name: BSD Pfam Description: BSD domain
TLSSPRGEPDPDADEAEPEPASAGSGAGPGEEESSPRGRGASRDPGAEEPEQQPCTPSRGVKGDISELTETLTRRLWGVASFLAPPPEVSTPRAGAAAPAEGREDEEAGDGGADGEEEAEALSPRIAGIRSDLAEIGGRVRSGFSMLQSNLAVAEISKIASSLLPFGQGGDDEGEPVPGVTEEVVVFVRHISTRPETWLDFPLFISERYADDFELSDAQYVHALSIEHLVPGLSDLKIQICSTDMTEACFWKIYFVLLHSKLNQQDAELLSTPQILQAREQLLQSLQAQNKRGSKFSGESSENVNASTAPAEEKVIQPSSIQDKAETSEISSFEEPTSDITPEIESEIFLISTTDVEIVDKSVIEEELAVKNESKTSPVQSKLRFETDKDEVDEWPDDDPAEEVSAANNRTSLGREEDVSFSDLEDDEDDDATKRDGQ

SEQ ID NO: 27577 - DNA, 1442 bp, Panicum virgatum
  misc_feature: Ceres CLONE 1877952
  misc_feature: Encodes the peptide sequence at SEQ ID NO. 27578
aacgcaacctccccccaccccggctgcgctgcggcatcatcccttcaagaagagagagaaaaatccaacgccgcgccacaccacaccgcaccacaccaccaggcaggccaccacaactctctctctttcccccctccaccctcgccgcgagttgctcagtcgcaagcgaggcgcgggccacagagcggggcgagcgttccggctgcgggggggctgcgtcgcgtcgcgccgcgcggggttcgatccgggacgggaggggaggggaggggagatcgaaatctgccttccatctctctcgctgcctctcctcgcgctcttcctcctggggggcgggagggcctcgcatgcggcggcgcggcggggcaaatgcgggtagcctcgcgggcggcggaggagcgctgaggacgcggcggccggggagcgatgcaggcgacggagcaccaccaccaccagcagcagcagcagcggaggaagggttcaccagagatggacttcttcagtgaatatggtgatgctaacagatacaaaatccaagaggtcattggcaaaggaagttatggtgttgtttgctcagctgttgaccagcatacaggcgacaaggtggcaatcaagaaaatacataatatctttgagcacttatccgatgctgcccggatcctccgtgagatcaaactacttcggctattgcgacatcctgatatagttgagatcaagcatataatgctgcctccatcaaggagggacttcaaagatatctatgttgtgtttgagctgatggatacagacctgcaccaagtcatcaaggcaaatgatgacttaaccaaagagcatcatcagttctttctatatcagatgctccgtgcactcaaatacattcatactgctaatgtttatcatcgtgatttgaagccaaagaatatattggctaatgctaactgtaaacttaaaatatgtgattttggattggcaagagtggcattcaatgatactcctacaacagtattctggacggattatgttgctacaagatggtatagggctccagaactgtgcggatctttcttttctaagtattcaccagctattgacatatggagtattggttgcatttttgcggagatcttaacagggaagccattgtttcctggaaaaaatgtggtccaccaattggatctgatgactgatctcttgggtactccatcgcttgatacagtttccaggattcgcaatgagaaggcaaggaggtacttgactagcatgaggaaaaaacagccagtaccattttctgagaggttccctaaagcagatccagctgcactcaaacttttgcagaggcttttagcatttgatcctaaggataggccaactgctgaagaggcgttggctgatccatattttaaaggcctcgcaaaagtagagagagaaccatcgtgccagcaaat

SEQ ID NO: 27578 - protein, 339 aa, Panicum virgatum
  misc_feature: Ceres CLONE 1877952
  misc_feature (34)..(325): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MQATEHHHHQQQQQRRKGSPEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLTSMRKKQPVPFSERFPKADPAALKLLQRLLAFDPKDRPTAEEALADPYFKGLAKVEREPSCQQ

SEQ ID NO: 27579 - DNA, 629 bp, Panicum virgatum
  misc_feature: Ceres CLONE 1877952-R
  misc_feature: Encodes the peptide sequence at SEQ ID NO. 27580
agaacctgactgctgttgatccatacaaccaacgaagagtggcaaggaatccagtacttcctccagccacttctaatctatcagcgtacacttaccaccggaagtctgacaactcagacagagagctccaacaggagcttgaaaaagatcgcatgcagtaccagccagcacagcggttcatggatgccaaggtagtgcctcagatgtctcctgacttgaggtcttcctactacatacccaaaggtgtcccgaaagctgatgttgtggaaagagctgcgttgcagtccagcatgattcatggaattgccccttttaatggcattgcagctgtaggaggtggaggaggttataataaggtcaatgcagttcaatatggagtttctaggatgtattagttgtaggtgtgcattggcgatctccacaatcctcagcggagttgaagtaataacatggcaaagagcgaaaagatgtcggctgccttactggctctatggcccgaagatagagaccatggaccgaggatcaaggaggacgtgcgatgtctcattgaaattgatgtcaggaaaacaacattcatcatcctgcccatttgatccagcttgttgaaaatggaatgccattaccccacg

SEQ ID NO: 27580 - protein, 130 aa, Panicum virgatum
  misc_feature: Ceres CLONE 1877952-R
  misc_feature: SWISSPROT Homolog: EC 2.7.11.24 Mitogen-activated protein kinase
NLTAVDPYNQRRVARNPVLPPATSNLSAYTYHRKSDNSDRELQQELEKDRMQYQPAQRFMDAKVVPQMSPDLRSSYYIPKGVPKADVVERAALQSSMIHGIAPFNGIAAVGGGGGYNKVNAVQYGVSRMY

SEQ ID NO: 27581 - DNA, 664 bp, Panicum virgatum
  misc_feature: Ceres CLONE 1877983
  misc_feature: Encodes the peptide sequence at SEQ ID NO. 27582
aaaccatccgatccaactcgatctcacgctccaagaactcaactgcaccggaagaagcagcagtgatcgatttgttagttgcactcgatcgatcgatcgcgtcaagaactgcatcagcgccaccagtacgtccaccaccaccggcacctcagctcagctagctcgccggggaagaagaagaagaaagattaactaggactagtcaccatgaggatgctgctccgctgcttcgtgggctcggaggcggcgggggccgggagcgagagcggcgacgagacgagggagaagaaggcggtgcggcgggtgcggagcgcgacggcgcggctgcggtcgctgtcgctggacgacctgtcgcggacgctggcctcctcgggcctgcacgccttcaccctggcggagctccggtccgcgacgcgcaacttctccagcagccacttcatcggcgagggcgggttcggccccgtgtacaagggcttcctcgacgagcggctccggcccggggagctcccgccgcagcacgtcgccgtcaagtacctcgacgccgacgggccgcagggtcaccgcgagtggctggcggaggtggtgtacctggggatgctcagccacccgcatctggtgaagctcgtcgggtacggctgccaggacgagcagaggatgctcgtct

SEQ ID NO: 27582 - protein, 152 aa, Panicum virgatum
  misc_feature: Ceres CLONE 1877983
  misc_feature: SWISSPROT Homolog: EC 2.7.11.1 Non-specific serine/threonine protein kinase
MRMLLRCFVGSEAAGAGSESGDETREKKAVRRVRSATARLRSLSLDDLSRTLASSGLHAFTLAELRSATRNFSSSHFIGEGGFGPVYKGFLDERLRPGELPPQHVAVKYLDADGPQGHREWLAEVVYLGMLSHPHLVKLVGYGCQDEQRMLV

SEQ ID NO: 27583 - DNA, 692 bp, Panicum virgatum
  misc_feature: Ceres CLONE 1877995
  misc_feature: Encodes the peptide sequence at SEQ ID NO. 27584
atagcctacaaatagcataacccactggatcgaattagtgtgtactggcaacatggctcttcacttgccctcccagcgtctatcagcttgcctcctgatttgctttagtttcatgatgatcagagcagatggatctcgcaagttatacatcgcctacctgggtgacaagaaacatgatgaccatactcttgtcactgcttcacatcatgaaatgctcagcaccattcttggaagcaaggaagaggcaatagactccgttgcttacagctacaagcatggcttctcaggatttgcagcaatgttaactgaagatcaggctgaaaaacttgcagagttacctgaagtaatcagtgttactccaaatcagaagcatgaacttatgaccacccgaagctgggatttcatagggctgaattaccaacaacctagtgaacttctgcagaggagcaattatggagaagacataattattgggataattgacacaggaatctggcctgaatcaagaagtttcagcgatcatggatatggagtaataccgccacaatggaagggtgtgtgtcagctaggagaagcatgggggggcaccaattgcagcaggaaaatcattggtgcaaggtattatgctgcaggtcttgacaaagccaaactcaagctgaattacatgtctgctcgagacatgaatgggcatg

SEQ ID NO: 27584 - protein, 213 aa, Panicum virgatum
  misc_feature: Ceres CLONE 1877995
  misc_feature (30)..(110): Pfam Name: Subtilisin_N Pfam Description: Subtilisin N-terminal Region
  misc_feature: SWISSPROT Homolog: EC 3.4.21.25 Cucumisin
MALHLPSQRLSACLLICFSFMMIRADGSRKLYIAYLGDKKHDDHTLVTASHHEMLSTILGSKEEAIDSVAYSYKHGFSGFAAMLTEDQAEKLAELPEVISVTPNQKHELMTTRSWDFIGLNYQQPSELLQRSNYGEDIIIGIIDTGIWPESRSFSDHGYGVIPPQWKGVCQLGEAWGGTNCSRKIIGARYYAAGLDKAKLKLNYMSARDMNGH

SEQ ID NO: 27585 - DNA, 713 bp, Panicum virgatum
  misc_feature: Ceres CLONE 1878008
  misc_feature: Encodes the peptide sequence at SEQ ID NO. 27586
actcaccaccagcaatcgcctctgctccaagcgcagccgcgagaaccctaaccctagcagccgcctcctcatccaatcagccttcgccgccgctgcgagcgatctagagggcagcaagggcgccgaccaagggggaggggccggcgatcggcatcgacctgggcacgacgtactcgtgcgtcggcgtgtggcagcacgaccgcgtcgagatcatcgctaacgaccaggggaaccgcaccacgccgtcgtacgtcgccttcaccgactccgagcgcctcatcggcgatgccgcgaagaaccaggttgccatgaaccccatcaacaccgtctttgatgctaagcgtcttattggcagacggttttctgatgcctctgtccagagtgatattaagatgtggccatacaaggttattccaggctcaggggataaaccaatgattgtagtgcagtacaagggtgaggagaagcagttctccgctgaagaaatttcttctatggttcttatcaagatgcgcgagatcgctgaagcttaccttggatcaactgtgaagaatgctgtggtcactgttcctgcttacttcaatgattcccagaggcaggcaactaaagatgctggtgttattgctggtctcaatgtcatgcgtatcatcaatgaaccaactgctgctgcaattgcctatggtcttgacaagaaagctactagtgttggcgag

SEQ ID NO: 27586 - protein, 134 aa, Panicum virgatum
  misc_feature: Ceres CLONE 1878008
  misc_feature: Functional homolog of the protein sequence given in SEQ ID NO 50352
  misc_feature: Useful for making plants with modulated drought sensitivity
  misc_feature: Useful for making plants with modulated heat sensitivity
MNPINTVFDAKRLIGRRFSDASVQSDIKMWPYKVIPGSGDKPMIVVQYKGEEKQFSAEEISSMVLIKMREIAEAYLGSTVKNAVVTVPAYFNDSQRQATKDAGVIAGLNVMRIINEPTAAAIAYGLDKKATSVG

SEQ ID NO: 27587 - DNA, 798 bp, Panicum virgatum
  misc_feature: Ceres CLONE 1878009
  misc_feature: Encodes the peptide sequence at SEQ ID NO. 27588
atacaactcctactacaaaaccagcgcccccgaaagcctcgcctcctgccgcatcgacacccacccgcctcaccaccacacccagatttcctctcctctcctcgccgcggcctccattgaccgcccgcgattcccccgcgcgccgcgccagcccagccaccttcttcgtgccgccgccgagctagggacggccgccctcactcgccgctgcgccctgctgcttctcttcgtcctcgcccgtccggatctgaactggcctttcgataacaaggaaacaccttagggaatgcagaaagatgtgcttgcatgttaaagagctacctagtgagggacttggcagggtagccgcccatatttcttctttgccgcctcttgatgacattggggctcatcaacacgcacagctcctgctccttgtgcttctgcacaatggggttcgacgtggcagctcaaccatcttcttagagaaccaccttgggggagacggttgaagtcttcaataaacacttgcaggcttcttaaatatgagatgggaaagatgcttggacaagggacctttgcaaaggtctaccatgcccgtaacatgaagactttagaaagtgtggcgataaaggtgattgacaaggagaaggttatgaaggttggcctcatcgatcagatcaagcgggaaatctctgtcatgaagctagtgaggcatcccaacattgtccaactatatgaggttatggctactaaaaccaagatatactttgtgttgaagcatgtgagaggtggagaattgtccaataaagttaatcg

SEQ ID NO: 27588 - protein, 89 aa, Panicum virgatum
  misc_feature: Ceres CLONE 1878009
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MGKMLGQGTFAKVYHARNMKTLESVAIKVIDKEKVMKVGLIDQIKREISVMKLVRHPNIVQLYEVMATKTKIYFVLKHVRGGELSNKVN

SEQ ID NO: 27589 - DNA, 527 bp, Panicum virgatum
  misc_feature: Ceres CLONE 1878009-R
  misc_feature: Encodes the peptide sequence at SEQ ID NO. 27590
  misc_feature (432)..(432): n is a, c, t, g, unknown, or other
gaagaatctgacaagaagagagagtccaagttcacgtccaccaagacaagctcaacgattatatcaaagattgaggatatggcgaagaacttgcgactgaagctcacaaagaaggatggtggtttactgaagatggaaggtgccaagcctggaaggaaaggggtgatgggcatcgatgctgagatatttgaggttagcccgaatttccatcttgtggagataaagaagacaaacggtgatactctagagtaccagaaggttttcaaccaagagatgaggccagcgctagcggacattgtatgggcttggcaaggtgagcagccgaagcagcagcaacagacgtcatgttaaatattgtgataagtgcaacgtttccaacattaatgtagtatttgtttttaccattatgtgatttgtttttgcaaccccccnccccctcctgtattaccaatataaacatctgtgttaggagtatcttgtaagacaattttatctcaaaggtaaacaagtatcgtctcattttatcg

SEQ ID NO: 27590 - protein, 116 aa, Panicum virgatum
  misc_feature: Ceres CLONE 1878009-R
  misc_feature: SWISSPROT Homolog: EC 2.7.11.1 Non-specific serine/threonine protein kinase
EESDKKRESKFTSTKTSSTIISKIEDMAKNLRLKLTKKDGGLLKMEGAKPGRKGVMGIDAEIFEVSPNFHLVEIKKTNGDTLEYQKVFNQEMRPALADIVWAWQGEQPKQQQQTSC

SEQ ID NO: 27591 - DNA, 1374 bp, Panicum virgatum
  misc_feature: Ceres CLONE 1878037
  misc_feature: Encodes the peptide sequence at SEQ ID NO. 27592
aataattagctggggctcaaaacgtgcgcctggtctccccttcccttcttctcggcttcttgcttggacccagacccagccggagctggagtagcaacctccacttcttgcggcggcggaggagaggaggagctctgaggcgccgccgccatggacgccgagagaggagatgcccagtctcccctgctgctgcagcaccagcctccgaaccagacgcaggtttccccagcgaatcagcactataacaagcccttcagctggaaggctcctgccattgttttggccttcgaattcttggagagcattgcttactctggcatagcgctcaacttggtcgtctatcttggaaccgtcctccatggaaccactgcctccagtgcagcaaacgtagatgcgtggaatggcgccacgttccttacaccggtccttggagcctttcttgctgatacatattggggaaagtacaagaccgtagcaatctctataatattctacgttggtgggttgcttgtaatcaccgcctctgctgtcattccatccctacggcctgcctcttgtgaaggaggttcttgcccacctgcaacggggtttcagtattttgtgctctttgcctcattgtacctcatctcgatcggtacggggggcgtcaagtcagctctacttccctttggagcagaccaatatgatgattccaaccttgaagagagtaaaaacaagcaattgttcttcagttggtttttcattgctgtcaacctcggagtgtttatctcgggcactgtccttgtctggatacagcaaaatgtcgcttggtcccttggatttggcatctccttgatctgccttctcattgcaacagtcacctttttcattggaacaccagcctacagggttcagcttccaactgggagcccgctgaagagcattgtaatggtatttgttgcctcctttaagaagagaagagtggcagttcctgctgatagcacgctgttgtttgaaggggatgatgctgaatcgagcaacacggtaccaaacaaattagaacacaccaatgaattcaggtgcttagacaaggctgctgtggttttagaggatcaagagattaagggcagccgccgtccatggatgctatgcacagtaactcaggtggaggaagtgaagatcctgatccggatgctcccgatatggttcacctgcgtcttctactcggccgcgatgtgccagaccgccacaacgttcgtccagcaggggaatgcgatgaacaccaagatcgggtccttctcggtgccggccgcctccctgaactccgcggaggtcatcttcatgatggtctgggtggtgttccaggacagcgtggtcatcccggtcgcgaggcgg

SEQ ID NO: 27592 - protein, 407 aa, Panicum virgatum
  misc_feature: Ceres CLONE 1878037
  misc_feature (105)..(407): Pfam Name: PTR2 Pfam Description: POT family
MDAERGDAQSPLLLQHQPPNQTQVSPANQHYNKPFSWKAPAIVLAFEFLESIAYSGIALNLVVYLGTVLHGTTASSAANVDAWNGATFLTPVLGAFLADTYWGKYKTVAISIIFYVGGLLVITASAVIPSLRPASCEGGSCPPATGFQYFVLFASLYLISIGTGGVKSALLPFGADQYDDSNLEESKNKQLFFSWFFIAVNLGVFISGTVLVWIQQNVAWSLGFGISLICLLIATVTFFIGTPAYRVQLPTGSPLKSIVMVFVASFKKRRVAVPADSTLLFEGDDAESSNTVPNKLEHTNEFRCLDKAAVVLEDQEIKGSRRPWMLCTVTQVEEVKILIRMLPIWFTCVFYSAAMCQTATTFVQQGNAMNTKIGSFSVPAASLNSAEVIFMMVWVVFQDSVVIPVAR

SEQ ID NO: 27593 - DNA, 542 bp, Panicum virgatum
  misc_feature: Ceres CLONE 1878037-R
ggagttcttctacgcggaggcgccgacgtcgatgcgcagcctgtgctcggcgttccagttcctggccatgtcgctggcgtactacgtgaacacgctggtggtgtcagtggtggcagcggcggcgacggcgggcgggcggcccgggtggctccccgtgcacctgaacgacggccacctcgactactacttctggctgtggacgggcatcagcgcggtgaactacgccgtgtacacggcgttcgccaggcgctacacgctcaagaaggtggtccgtcagtagctccatcggccactgcacgagctagtatcctgctgtactatacggtgtacggtgtacagtgtacactactcctactctactccgggaccaagactgttgccgattgtaaagaccgtcagaattcattgtagcctgtcaatttgagcaccgtgtcatctgtactagtatcttgtatggcgatttgtatcttgtacggcgatttgtattgattttccggaaagaataagaggaaaaaaaatctgtagcctggtgcttgatgctc

SEQ ID NO: 27594 - DNA, 1512 bp, Panicum virgatum
  misc_feature: Ceres CLONE 1878055
  misc_feature: Encodes the peptide sequence at SEQ ID NO. 27595
aaacccacccatctgctgatctgccatccccttcgtccccttcccccacccaccactccacccattgccctcccggaaccttctagaacccctgtccagaaccctacccccatggcggcgtccctcctctcccgcgccgccgctgccgccgcggcgctccgcggcgcggctcggccccaccacctcctcctgcggtcctccctccccaagagtcgggtcggatgggcggcgcgcgcggcgcagggcgccggcgggtacgggtgcggggcgccgccgctggcctcgggcgcgttcgggatcgcggcgcggtgcaacgccacgtcgtcgtccgcggtgtcggaggccgccggcgtgcacgcgctgccgcggaccgagcccgtggtgtcgcccgagtggctgcacgccaacctcaaggaccccgacgtcaaggtacttgatgcctcttggtatatgcctgcagaacaaaggaatccactacaagagtaccaggtggctcatattcccggtgccttgttctttgatgttgatggaatatctgacagaacatctagtttaccgcacatgctgccatctgaaaaggcattttcggctgctgtatctgctcttggcatctataacaaagatgggatagtagtttatgatggaaagggactgttcagcgctgctcgtgtttggtggatgttccgcgtatttggacatgataaagtttgggtgctagatggaggtttgcctcaatggcgcgcttctgggtatgatgttgaatcaagcgcctccagtgatgccatcttaaaggccagtgctgctggtgaagcaattgagaaagtttaccagggtcaatcgattggtccattcacatttgaagcaaagttgcagccccatcttatttggagtcttgatcaggtgaaagagaacatcaagacccagacacatcaacttatagatgctcgatcaaaacctagatttgatggtgcagttccagagccgcgcaaggggattagaagtggtcatgtgcctgggagcaaatgtgttcctttccctcaggtgcttgacagctcacaaaagctattgcccccagatgaactccggaaacgatttgagcaggaaggaatatcacttgatcaaccccttgtgacctcttgcggcactggcgtaacagcatgtgtattagccttgggcctccatcgccttggtgaaactgatgtcgctgtatatgatggatcatggaccgaatggggagcccatcctgacactccagttgcgacagccgtctagtcccacatcttgctcttggaggctcttgattgtacttcccttgtgcccttgatcccatgggtaaaggcgaaggaaactgaaggtcggatgtgtgcaaggttagggaagcgaagccttttggtcatcactgtaaatgcttaaacagaaaatgtcatatacacatacactggtgaattgtagggtcataatttcccttgccgagcaccccttttcttggtggaacaataataatgaaatggc

SEQ ID NO: 27595 - protein, 386 aa, Panicum virgatum
  misc_feature: Ceres CLONE 1878055
  misc_feature (92)..(212): Pfam Name: Rhodanese Pfam Description: Rhodanese-like domain
  misc_feature (260)..(377): Pfam Name: Rhodanese Pfam Description: Rhodanese-like domain
  misc_feature (246)..(383): SWISSPROT Homolog: EC 2.8.1.2 3-mercaptopyruvate sulfurtransferase
  misc_feature (90)..(240): SWISSPROT Homolog: EC 2.8.1.1 Thiosulfate sulfurtransferase
MAASLLSRAAAAAAALRGAARPHHLLLRSSLPKSRVGWAARAAQGAGGYGCGAPPLASGAFGIAARCNATSSSAVSEAAGVHALPRTEPVVSPEWLHANLKDPDVKVLDASWYMPAEQRNPLQEYQVAHIPGALFFDVDGISDRTSSLPHMLPSEKAFSAAVSALGIYNKDGIVVYDGKGLFSAARVWWMFRVFGHDKVWVLDGGLPQWRASGYDVESSASSDAILKASAAGEAIEKVYQGQSIGPFTFEAKLQPHLIWSLDQVKENIKTQTHQLIDARSKPRFDGAVPEPRKGIRSGHVPGSKCVPFPQVLDSSQKLLPPDELRKRFEQEGISLDQPLVTSCGTGVTACVLALGLHRLGETDVAVYDGSWTEWGAHPDTPVATAV

SEQ ID NO: 27596 - DNA, 1695 bp, Panicum virgatum
  misc_feature: Ceres CLONE 1878073
  misc_feature: Encodes the peptide sequence at SEQ ID NO. 27597
gtgggtggcgcactcgcttctcctccgtcacggtcatggccgcccccgacccctcgccgctcccgtggccgcgcccggcgcccctcctcctcttcctcgccctgctcgccgcctcctacctcgccctcacgcgcctctgtccgcgctcctgatcgcgcaccctcctcctgctccccgcggcgaacccaccaccaccagcagctgcgccgggttctacgccggcgcgcggcgtttccgcgtcggttgaggagttcggcggcgttccggcgcgcggtggcggagctggacgagagggccaggggcggcggcggacgaggagccaggctggaggtgccgccggggaggtggctcacgggaagcttcaacctcaccagccgattcaccctcttcctgcaccaaggcgcggtcatcctcggctcccaggatctagaagagtggcctctcattgcccctttgccatcttacgggcgtggaagggaacgattggggccacgccatatcagcctcattcatggagagggcttaaatgatgttgttgttactggcaacaatgggaccatagatggccaaggagagatgtggtgggagatgtggtggaatcgaactttgaattacacaaggggccatcttgtcgagcttgcgaactcaaccaacatcctaatctctaatatcacactacgcaactccccattctggacagtgcatccagtctacagcagcaacgtggtgatcaagggtttgaccatactggctcccctaaatgctccaaacactgatggcattgatccagattcgagctcagaagtttgtattgacgactgctatattgaaagcggagatgatctagtagctgtcaaaagtggctgggatcagtatgggatctctgttggcaaaccaagtacaaacattgtcatccagagggtttcaggcacaactccaatgtgctcaggtgtaggttttggaagcgagatgtcaggaggcatatctaatgtgcttgtccgtgacctccacgtgtggaattcggcacaagcagtgaggctgaagaccgacgtagggcagggtgggtacataaccaacatcaccataaccaaggtgacaatggagaaggtcaaggtaccgataaggtttagtcggggtgcagatgaccattcagatgacaactatgaccgaaccgcactgccaaggatcagtaatgtgcttatcagtggtattgttggtgttgacctgcagcgtgcgccaatgctggaggcagtggctggtgcagtttatgaagggatctgctttcggaatgttagcttaagaggcataaggcggcagggtagatggcattgtgagtccgtgtacggagcggcgcatggagttttccctgcaccctgtgaagagttgaggaagaatcggtcttcatcgtggtgtggattttcatgaccagttgtacagattacagaagtcagaagtttctctcagtgactgatacttgaaatgtagggtattcatattggtgtgccaggaaggaaggataggacatagggttttgggatagacagatagtatagtcaaattcaacatttactcatttagccttagtcttctagcattttaaaggggggttacaaacagtttacaaacatcatgtgtgggcacagctcactgcaaaaaggaaaggaacagttattaatacagagaagttacttattg

SEQ ID NO: 27597 - protein, 474 aa, Panicum virgatum
  misc_feature: Ceres CLONE 1878073
  misc_feature (104)..(459): Pfam Name: Glyco_hydro_28 Pfam Description: Glycosyl hydrolases family 28
  misc_feature: SWISSPROT Homolog: EC 3.2.1.15 Polygalacturonase
  misc_feature: Functional homolog of the protein sequence given in SEQ ID NO 51252
  misc_feature: Useful for making plants with altered carbohydrate content
  misc_feature: Functional homolog of the protein sequence given in SEQ ID NO 50779
  misc_feature: Useful for making plants with altered cell wall content and/or composition
VGGALASPPSRSWPPPTPRRSRGRARRPSSSSSPCSPPPTSPSRASVRAPDRAPSSCSPRRTHHHQQLRRVLRRRAAFPRRLRSSAAFRRAVAELDERARGGGGRGARLEVPPGRWLTGSFNLTSRFTLFLHQGAVILGSQDLEEWPLIAPLPSYGRGRERLGPRHISLIHGEGLNDVVVTGNNGTIDGQGEMWWEMWWNRTLNYTRGHLVELANSTNILISNITLRNSPFWTVHPVYSSNVVIKGLTILAPLNAPNTDGIDPDSSSEVCIDDCYIESGDDLVAVKSGWDQYGISVGKPSTNIVIQRVSGTTPMCSGVGFGSEMSGGISNVLVRDLHVWNSAQAVRLKTDVGQGGYITNITITKVTMEKVKVPIRFSRGADDHSDDNYDRTALPRISNVLISGIVGVDLQRAPMLEAVAGAVYEGICFRNVSLRGIRRQGRWHCESVYGAAHGVFPAPCEELRKNRSSSWCGFS

SEQ ID NO: 27598 - DNA, 2019 bp, Panicum virgatum
  misc_feature: Ceres CLONE 1878082
  misc_feature: Encodes the peptide sequence at SEQ ID NO. 27599
acacgcatccattccatttccatcccccgctgcgcgctgcgccccgctcgccgcgccgcgcaatgcccgcccacgcgctcgccgggggccgcgcgcggcggcttcccatcccgcggcgctgacgagggggcctctcgggtggggcggacgccgctgcgggtgcttatttggggctcggggaacggggagtggctgctgaggcgatgggggagcggcagcaggaggggaagcggcgcggggtggaggacgggaagcggaaggggacggggaaggctaaggcggcggcggtggtggcggaggacgcggcgccggtgaccgggtgctggatccgcttcccgcgcctccgcggctgcatgtcgtcgcgcgccaaggtcgactcctccaccaccagcggcggcggcggcgaaaacaaactagcaactgacggctgccaagaccaatcagtcccaccaggttctggttccacgacaaccagtaacactggaagtctctcaccttcttccatagttggagaggagcttaaactagcattccaactgcgtagatttacttttaatgaactgaagtgtgccacgagaaacttccgacctgagagtcttcttggtgagggaggttttggctgtgtctttaaagggtggattgaggagaatggaactgctcctgttaagccaggcactggattaactgttgctgtcaaaacactcaaccatgatgggctgcaggggcataaagagtgggtggcagaagttgattttcttggaaaccttcagcatccacacctagtgaaattggtcggttactgcattgaagatgaccagaggttgcttgtatatgaatttatgccccgtggaagtttggagaatcatctttttagaaagtcattgcctctcccatgggccattagaatgaaaattgctcttggtgctgccaaaggccttgcttttcttcatgaagaagccgaaagaccagtaatatatcgggatttcaaaacatccaatattcttttagatgcggactataatgcgaaactctctgattttggactcgctaaagatggtcctgagggtgataagactcatgtatcaactagagtcatgggaacgtatggatatgctgcgcctgaatatgtaatgacaggtcacctgacctcgaagagcgacgtatatagctttggtgtggtgctactagagatgatgaccggtagaaggtcaatggacaagaacaggccaaatggggaacataacctggtcgaatgggctcgcccctatctcggagaacggcgccgattctataagcttgtagatcctcgtttggatggaaacttctcaataaaaggcgctcagaagacagctcagctggcccacgcttgcctcagccgtgaccccaaggctaggcctctgatgagccaagtggtagaggtcctgaagcctctccagaacctcaaggacatggccagctcttcctacttcttccagtccatgcagcatgagcggcgcacagcccttgccagcccacatggcagtcaaagcatgaaggcgcagagcacctttgcacggaacgggcagcagccactgaggagcctctcatatggtcctcatgcttccccgtaccgccagtccccaaggcctgatggcaagcggcagtgaaactcattgtcctacagcgatcaatttcagacctgtgttccatcctgaactggtggatccatgggacttgccaagcattacgaccgtggcatcatagctgcctatgccgtggataaagcaacaacgatgattgaaacttcgcagatatcatctgcggtgtgaaaattatttcttgttattgcttagatgttagctgtcctatgtttacaactctttgattccttgactcgaaaggtgggatcaaacaggaatcggtcatatttcaaacaatgctcttaaggcagcggtaggaattgttccattcagagaaatcaacaataggtaagtctgttatatatatatatatatatatatatatatttgtatgcctcag

SEQ ID NO: 27599 - protein, 480 aa, Panicum virgatum
  misc_feature: Ceres CLONE 1878082
  misc_feature (127)..(407): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
MGERQQEGKRRGVEDGKRKGTGKAKAAAVVAEDAAPVTGCWIRFPRLRGCMSSRAKVDSSTTSGGGGENKLATDGCQDQSVPPGSGSTTTSNTGSLSPSSIVGEELKLAFQLRRFTFNELKCATRNFRPESLLGEGGFGCVFKGWIEENGTAPVKPGTGLTVAVKTLNHDGLQGHKEWVAEVDFLGNLQHPHLVKLVGYCIEDDQRLLVYEFMPRGSLENHLFRKSLPLPWAIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMMTGRRSMDKNRPNGEHNLVEWARPYLGERRRFYKLVDPRLDGNFSIKGAQKTAQLAHACLSRDPKARPLMSQVVEVLKPLQNLKDMASSSYFFQSMQHERRTALASPHGSQSMKAQSTFARNGQQPLRSLSYGPHASPYRQSPRPDGKRQ

SEQ ID NO: 27600 - DNA, 1852 bp, Panicum virgatum
  misc_feature: Ceres CLONE 1878085
  misc_feature: Encodes the peptide sequence at SEQ ID NO. 27601
acaaacagttcgccgtacggccggggatccatggcaaaggagatcaggacgacgtgaattgaagggcgatgatggcctcgccgtcgccgcacatgatgttgttgttattcctcacatcagctctactagcagcagccgtgcggccagcaacgagctcgtcgtcgccgccgccgtccggcacctcgccggagcacgtaccgaccttctgctccgggcaggctcctgactccaacaactcctcctcctccctggctgtcgacgccgtgttccgcgaggacgagtacacggcgaccgtcgtgttcaacgcgaccccaccgcgtttgcctgcgccggctgcacatcctcctccccttgcgccgccccctgccggtcataccccaccaccgcgtttgcctccgccggctgcagtacatagtccccttgcgccccctgcaggttattcgccacggcctccaccagccgcatcgcccgttgaaacacagctcgcgcaacaaagccacgggaagaagacgccgaagacactcataatgctgatcctttctattgcaaccggaatagtggttatcaccgtcatccttcttgtacacatctggtatcgtcgtcgaaagcattcaaataagatgcaacatgtcgtagcagctggcattccaggtgagaacatgtatgaccaagaagacgggcaatggagcatggaagatgaagaggacaaggatggagagagaatgacctgccaactctacagctaccaagttcttgaggctgcaacatgtcacttctcaaatagaaacaagctagggagtggtggatttggaacagtgtacaagggcatacttgcgaacggaagagaagtggcggtgaaaagactcagggattccaagcggaacctgcaagaacttgagagggagatctccatcgtggccactttgtgccataagaacctcgttaggtttttagggtactgcttccaagacgaagggaagtttctcgtctacgagtatgtacccaataatagcctcgacaaattcgggtacaaagcatgttcccagtcacagaagctagaatgggctacatggttcaacatcatcttaggggtcgcccgtggcctccagtttctccatgacaagggaatcattcatagagatttgaagccacacaatgtacttctcgatgaaaacgtcacccccaagatcgccgacttcgatctcatgaggacgtacgataaacagaagacccacgagagcacggagaaggtcgccggaacatttggttacatagcgcctgaatgcacgtccggccggaagttcctgctgtcgatcaagtccgacgtgtacagctacggcgtcctggtgctggaggtcatcaccggccacaagatctacacgttcgaaggccaaaaatccgaaggcctcgtcgaatacgtgtggcagcactgggaagagaagagagcaggagacatcatggacgacgacctgctgggcgtcgcgggccaagagctcgcggcgcggcaggcacagaggtgcgtgcacgtcgcgctgctctgcgtgcagtcagatcggtcaaggaggccgaccatggggcaggtcatcgccatgctgacaagtgacgacggcgggatggagctgccagagccgtctctgcccgggtaccttgtcgtcgtccacccaagggctctggtccggctgccatgtctcgggtataggtagctagggatgaaaatgaaaatggtaatttcgaagtatcagaaatcgttttcgagattttatcgatttttgtggctaaacggaaactgtagcggttaccgtgaaaacggaaacagaatcggtaatgcaatccgaaaatgagaatgttttgt

SEQ ID NO: 27601 - protein, 391 aa, Panicum virgatum
  misc_feature: Ceres CLONE 1878085
  misc_feature (83)..(356): Pfam Name: Pkinase Pfam Description: Protein kinase domain
  misc_feature: SWISSPROT Homolog: EC 2.7.11.1 Non-specific serine/threonine protein kinase
MLILSIATGIVVITVILLVHIWYRRRKHSNKMQHVVAAGIPGENMYDQEDGQWSMEDEEDKDGERMTCQLYSYQVLEAATCHFSNRNKLGSGGFGTVYKGILANGREVAVKRLRDSKRNLQELEREISIVATLCHKNLVRFLGYCFQDEGKFLVYEYVPNNSLDKFGYKACSQSQKLEWATWFNIILGVARGLQFLHDKGIIHRDLKPHNVLLDENVTPKIADFDLMRTYDKQKTHESTEKVAGTFGYIAPECTSGRKFLLSIKSDVYSYGVLVLEVITGHKIYTFEGQKSEGLVEYVWQHWEEKRAGDIMDDDLLGVAGQELAARQAQRCVHVALLCVQSDRSRRPTMGQVIAMLTSDDGGMELPEPSLPGYLVVVHPRALVRLPCLGYR

SEQ ID NO: 27602 - DNA, 665 bp, Panicum virgatum
  misc_feature: Ceres CLONE 1878093
  misc_feature: Encodes the peptide sequence at SEQ ID NO. 27603
cccagctggacatatgcgggctccaagactagggttctcattactggtagattcttaaattctgatgaggttcaaagatggaagtggtcatgtatgtttggagaagtcgaagttccagcacagatttcagctgatggaactctcagatgctattctccgtcacacaaacctggctgggttcctttttatgttacatgctccaacaagttggcctgcatcgaaatccgagagtttgagttccgaccaagtaattccaaacacatggatgtccgaagtccacatgatgatgcgaagaaaacatatctccggatgcgtcttgatgacctgttgtctttgggacaagatgagtaccatgcaatagtatctaaccccacaaaggagatgattgatttgagcaataagataagctcgctaatgacaaaccaccattcctggaccgaattgctaaagttggcttgtgataaccagcttgccactgatgataagcatgatcagttctttgaccatcgcttgaaagaaaaattgcttatctggcttgtccactaaccaagtgatggtggctagggccccattgtgttacatgaggaagggcaggctgtgcttcatctggcagctaccctaggatacgattgggctataatgccaacaatttctgctggagtgag

SEQ ID NO: 27603 - protein, 181 aa, Panicum virgatum
  misc_feature: Ceres CLONE 1878093
  misc_feature: The sequence is a functional homolog of SEQ ID NO 1308 in the 10/666,642 US patent application
PSWTYAGSKTRVLITGRFLNSDEVQRWKWSCMFGEVEVPAQISADGTLRCYSPSHKPGWVPFYVTCSNKLACIEIREFEFRPSNSKHMDVRSPHDDAKKTYLRMRLDDLLSLGQDEYHAIVSNPTKEMIDLSNKISSLMTNHHSWTELLKLACDNQLATDDKHDQFFDHRLKEKLLIWLVH

SEQ ID NO: 27604 - DNA, 698 bp, Panicum virgatum
  misc_feature: Ceres CLONE 1878095
  misc_feature: Encodes the peptide sequence at SEQ ID NO. 27605
acgaccgcggcttcttcgcgtctcctgcagccgcgccgaggcgacacctcctggttcgcgtcggccgactggaagctaccgcccccgaggccgagcacgccggaccgcgggactgctgcggggcgccgccgaccgcgcgcggctctcctcccgcctcgggcgacggccctccgccagggtaggctgacgcccctccgccaggctcgcccgaccgcagcaagccgccgccgcatcagtactcctccaggccgtgaaagcgccagggatcagggagtgacctaccccggggtggggagttcattccttttccagttacaaggagggcaaactcgtattccatcatgatggaagaggacatggaaaatggaaggtcgtatcaggaaagaccaagaaccttttctacagtacgaagtaaatcatctataccactggtcttccgcttgttgatgaggataaatccccgtgccttgattattctctctcttttggtcttcagtggtgttctatatgtgggagccagtacatcgccaattgtggtctttgtattctgcatatgtactctcagtttattcttctctctttacctcacaaagtgggttcttgccaaggacgaaggacctccagaaatgtctgagatatctgatgccctaagagatggtgctgaaggattttttaggacacagtatggaactatttct

SEQ ID NO: 27605 - protein, 118 aa, Panicum virgatum
  misc_feature: Ceres CLONE 1878095
  misc_feature: SWISSPROT Homolog: EC 3.6.1.1 Inorganic diphosphatase
MMEEDMENGRSYQERPRTFSTVRSKSSIPLVFRLLMRINPRALIILSLLVFSGVLYVGASTSPIVVFVFCICTLSLFFSLYLTKWVLAKDEGPPEMSEISDALRDGAEGFFRTQYGTI

SEQ ID NO: 27606 - DNA, 580 bp, Panicum virgatum
  misc_feature: Ceres CLONE 1878103
  misc_feature: Encodes the peptide sequence at SEQ ID NO. 27607
atgttaccttactccatacaacacccccgccgctaagatactgagatgcaaggcactgtgacgatgaccaccttatccctgagacctgcagggcagtgcaatgggagctgcctgctcgcacctgccacaggacggcaaccacgtatttcttggcggcgtcggcagcatatcccaccctccctgcatccccagcaaatgcaacagtgttcagtggcaacattacacaatgataaggctgacgatcgcttgggcaagaatccatgcaattttcatccttctctatggggagatttcttcctacactactaccactcctcagcttcctccaaacagcagacgtggatggtagaacaagcagatgaagtgaaccaagacgtggcaaaaatagtagcaagttcagttgcttgggaccttcatcataggctacaacttatcgatgcgctgcagcgtctgtgcttgtatcatttgttccaagatgacattaatgctgcactgactcaaattaggacagttcatcttactgactgtgatcttcacacggtggctatgtggttttatctgcttcgtaagcacggacaca

SEQ ID NO: 27607 - protein, 128 aa, Panicum virgatum
  misc_feature: Ceres CLONE 1878103
  misc_feature: SWISSPROT Homolog: EC 4.2.3.13 (+)-delta-cadinene synthase
MQQCSVATLHNDKADDRLGKNPCNFHPSLWGDFFLHYYHSSASSKQQTWMVEQADEVNQDVAKIVASSVAWDLHHRLQLIDALQRLCLYHLFQDDINAALTQIRTVHLTDCDLHTVAMWFYLLRKHGH

SEQ ID NO: 27608 - DNA, 1919 bp, Panicum virgatum
  misc_feature: Ceres CLONE 1878113
  misc_feature: Encodes the peptide sequence at SEQ ID NO. 27609
atcctcctcctctcttgtatttctccccctctaggctccctccctccctccctccccaaaccccctcgccgctcctgtcgggacgccccaaacccctagccctaagcccgacgaggaggatgtcgaccatcgccgcctcccgccgcgcctcctccgccaccgccaagcgccccgccatggccgagagcgccggggggcccaaggcggcgagcgccgccgccgcgcaggccaagaagcgcgtcgcgcttggcaacatcaccaacgtcgccgttgccgcgcaagcgggcagggccgccgggaagctcgcgccaccgccggccagcgcgaagttgaattcagttacctcagctgcacccttgaagaagccatcattggcaagtgctcgcagtgtgagctccgttcggggtcctgatttgaaatcagcttcaatcaagccagctccacccctttctcgccatgacagcacgacgcagaaccataatgttcctcttcctaaagtgcctaccgttctccaggcgcccagtcgcatacctgctttggttccctgcaacacctttgtgtctcctggaccctctggagactcggtttctgtcgatgagacaatgtcgacttgtgactccatgaaaagcccagactttgagtacatagacaatgaggactcctcaatgctcgcctcattgcagcgacgcgcaaatgaacacctacgtatctcagatgatagagatgttgaagaaaataagtggaagaaaaatgcctctgccccaatgaaaattgaccgcatttgtgatgttgacaatgacttagaggatccacagttgtgcgctactctggcttctgacatttacatgcatatgcgagaggctgagacgaagaaaagaccatctactgatttcatggaaacaattcaaaaggatgtcaacccaagcatgagggcaattttgatagactggcttgttgaagttgctgaagaatatcgtcttgtccctgatactctgtacctgacagttaactacattgaccgttatctttctggcaacgaaatcaaccgccaaaggctgcaattacttggtgttgcttgcatgcttatagctgcaaaatacgaggagatatgtgcaccacaagtagaagaattctgctacataactgacaacacttacttcagagatgaggttttggaaatggaagcttctgtactgaattacttgaagtttgaaatgaccgcaccaacagcgaaatgctttttgaggagatttgctcgtgctgcacaagcgtgtgatgaggatccagctctgcatcttgagtttctggccaattacatcgctgagctatcactccttgagtacagcctactctcataccctccatcgctaatagctgcctcagctattttcttggcaaagtttgtactccagccaacaaagtatccttggaattctacccttgctcactgcacacaatacaagccgtcggaattgtgcgattgcgtaaaggcattgcaccgcttattcggtgttagtcctgggagcaaccttcctgctatcagagaaaagtacagtcaacataagtacaaatttgtggcaaagaagcactgtccaacattgattcccaccgaattcttccgagatgtggtgtgctaggcttagaagaagcccaggagtagttccagttgcttactgaattcttgctcttgtggctgaaatgcccagtagcacccgcactgactgtgcaggtggttagttgatgcaggaggttggtgatgcccccctgttgtttcaggggattagaagagtgtagattctagattgaggctttgaagtttgtggccatgtattcctgtcctgcttcctgctgtaatcttcctgtatctagacccatgtttgcaggtgcatgtaaattggagttctgtagaagtagatgat

SEQ ID NO: 27609 - protein, 505 aa, Panicum virgatum
  misc_feature: Ceres CLONE 1878113
  misc_feature (240)..(367): Pfam Name: Cyclin_N Pfam Description: Cyclin, N-terminal domain
  misc_feature (369)..(496): Pfam Name: Cyclin_C Pfam Description: Cyclin, C-terminal domain
  misc_feature: Functional homolog of the protein sequence given in SEQ ID NO 50735
  misc_feature: Useful for making plants with modulated oxidative stress sensitivity
  misc_feature: Functional homolog of the protein sequence given in SEQ ID NO 50284
  misc_feature: Useful for making plants with modulated nitrogen use efficiency
MSTIAASRRASSATAKRPAMAESAGGPKAASAAAAQAKKRVALGNITNVAVAAQAGRAAGKLAPPPASAKLNSVTSAAPLKKPSLASARSVSSVRGPDLKSASIKPAPPLSRHDSTTQNHNVPLPKVPTVLQAPSRIPALVPCNTFVSPGPSGDSVSVDETMSTCDSMKSPDFEYIDNEDSSMLASLQRRANEHLRISDDRDVEENKWKKNASAPMKIDRICDVDNDLEDPQLCATLASDIYMHMREAETKKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEMTAPTAKCFLRRFARAAQACDEDPALHLEFLANYIAELSLLEYSLLSYPPSLIAASAIFLAKFVLQPTKYPWNSTLAHCTQYKPSELCDCVKALHRLFGVSPGSNLPAIREKYSQHKYKFVAKKHCPTLIPTEFFRDVVC

SEQ ID NO: 27610 - DNA, 1882 bp, Panicum virgatum
  misc_feature: Ceres CLONE 1878120
  misc_feature: Encodes the peptide sequence at SEQ ID NO. 27611
atccgcttcctcctcccgcacccctcctcccgcttctgaaactccttccccgcagcctcaccgcgcccctgctcgtccacgcgttcactttcacttacgccgctcggccgcgaccccctcgacgcacatttgccgagaggctgcctgctacgggccaccgtcgatggcgttcctcgcgccgccgcggttcaagtgccccacttccacccgcgcggcggtgttcagggagcccgccggcggcgcaggctcccgccccggccgtgtaaattgctccgtgacatccacggcaatcgtcgatgcgcagcttatcgagtgcttatccgtcgggtcgccgccttcgcttcaccgaacacttccggggggtttcggtgaggcgcttctcaacaaggaggccatggtgacggccgcagccgcggaggccgtcgctctagctcgagcggcggccgagctcgccggagaagtagcccggatggcgcgaagggaccaccggacagactcgcctcagcgtgatgactcggaggacggcttcttggcaagagaggttcgccgcaccgaggcgaggtgggagtccaggcgcgccggcctcgaattgctggggggcgaagagttcagcagcattttcagcgacgagtccgaggatgaaggcgagtgcacggagggcgtcgtagcggtgaagtcggcgcgccggtccgagagaagggctcggagagttagggcagcgatgaaggcggctaagtctttcagcaagggtaaacccggcggaacgtcctcctcgacctcgagtaagaagcggttgaagggttgccggaatcctctggggtgcttctataagatgaccggcccgaggcttctgacggcgaagcaggaagtcgagttctctgaaggcattcaggaccttctgaaactggaggcaatccagaaggagcttgcacactacaatggtggtgaaccaacattctcccagtgggcagcagcagctggaaccgacgagcgcactttgcggaaacgcctgaattacggagtttactgcaagaacaggatggtgaaatctaatgtgcgacttgtgatctcaattgcaagggagcatgaaggccccggaatggagctttctgatcttattcaggatgggatgcaaggcttgatacgaggtgcggaaaagtttgatgcttcaaagggttttagattctcgacgtattctcactggtggatcaaacaagcaatacgcaagtctgttttagaacagactcagataattcggctgccatcgcacatggccgatgcaagttcccgagtgaaggaatgctggcgccggctccaccgtcagctgaaacggctgcccagcaacgaagagatcgcgctggacaccggcatgccgatccggcgggtggaggcggcgatgagcctcccaaagtacaccgtctccctcaccggcaaggtcgggtgcacggacgtgacataccaggagatcatgccggacgccagcgcggagacggcggaggaggtgctgcaccggtggctgatgaaggaggaggtggagagggcgctgggcagcctgagcccgcgcgagaggcaggtgatgcggtaccggttcggcatcgagggcgggcggccgcggaccctgcacggcatcgggcagctcctcggggtgagccgggagcggatccggcagatcgagctgggcgccttccggaagctgcggggcaaggacaaggtgcggtcgctgcagcactacctgcagccggcggagagctggtagcggcagcggccttttcctgacgactatacgatttctagtacgtgtataatcgtatcatttttagtacgtgtataactaacgtacataagatgtatatacaccatctttttgaaagggatttaacgc

SEQ ID NO: 27611 - protein, 530 aa, Panicum virgatum
  misc_feature: Ceres CLONE 1878120
  misc_feature (460)..(513): Pfam Name: Sigma70_r4 Pfam Description: Sigma-70, region 4
  misc_feature (293)..(363): Pfam Name: Sigma70_r2 Pfam Description: Sigma-70 region 2
  misc_feature (367)..(448): Pfam Name: Sigma70_r3 Pfam Description: Sigma-70 region 3
MAFLAPPRFKCPTSTRAAVFREPAGGAGSRPGRVNCSVTSTAIVDAQLIECLSVGSPPSLHRTLPGGFGEALLNKEAMVTAAAAEAVALARAAAELAGEVARMARRDHRTDSPQRDDSEDGFLAREVRRTEARWESRRAGLELLGGEEFSSIFSDESEDEGECTEGVVAVKSARRSERRARRVRAAMKAAKSFSKGKPGGTSSSTSSKKRLKGCRNPLGCFYKMTGPRLLTAKQEVEFSEGIQDLLKLEAIQKELAHYNGGEPTFSQWAAAAGTDERTLRKRLNYGVYCKNRMVKSNVRLVISIAREHEGPGMELSDLIQDGMQGLIRGAEKFDASKGFRFSTYSHWWIKQAIRKSVLEQTQIIRLPSHMADASSRVKECWRRLHRQLKRLPSNEEIALDTGMPIRRVEAAMSLPKYTVSLTGKVGCTDVTYQEIMPDASAETAEEVLHRWLMKEEVERALGSLSPRERQVMRYRFGIEGGRPRTLHGIGQLLGVSRERIRQIELGAFRKLRGKDKVRSLQHYLQPAESW

SEQ ID NO: 27612 - DNA, 653 bp, Panicum virgatum
  misc_feature: Ceres CLONE 1878124
  misc_feature: Encodes the peptide sequence at SEQ ID NO. 27613
tggaagaggcaaatagaattttaaggcaaaagattgctgaggatcagtttcttgatcttgtgagtgttgagactgaagtgcgctcagtttacaaagagctctacagcatttacaaaactacactcaaatccaagagttcaataaatgaggtgaaccaggttgctcagctgcggatcatcataaaaccaaaatcctgtaatggtgttgggccattgtgcactgcacaacagatttgctatcatgttcttggtctcgttcatggcatatggacacccattcctcaagctgtaaaagattacattgcaactccaaaacctaatggctaccaaagtctacacacaacagtgataccatttcttaatgagagtatgttccatttggaagttcagattagaacagaagatatggatttaatagcagaaagaggcattgctgcacattacagtggaaggggagtggtttctggacctgttcgtcctggaatatcaagtggaagaaattccaagggaaaagtaatctgcctcaacaatacaggatttgctctgaggattggttggctcaacgcaatccgcgaatggcaagaagagtttgttggtaatatgagttctcgggaatttgttgatacaatcacccgagatcttctgggaagtcgt

SEQ ID NO: 27613 - protein, 216 aa, Panicum virgatum
  misc_feature: Ceres CLONE 1878124
  misc_feature (28)..(151): Pfam Name: RelA_SpoT Pfam Description: Region found in RelA / SpoT proteins
  misc_feature: SWISSPROT Homolog: EC 2.7.6.5 GTP diphosphokinase
EEANRILRQKIAEDQFLDLVSVETEVRSVYKELYSIYKTTLKSKSSINEVNQVAQLRIIIKPKSCNGVGPLCTAQQICYHVLGLVHGIWTPIPQAVKDYIATPKPNGYQSLHTTVIPFLNESMFHLEVQIRTEDMDLIAERGIAAHYSGRGVVSGPVRPGISSGRNSKGKVICLNNTGFALRIGWLNAIREWQEEFVGNMSSREFVDTITRDLLGS

SEQ ID NO: 27614 - DNA, 2293 bp, Panicum virgatum
  misc_feature: Ceres CLONE 1878134
  misc_feature: Encodes the peptide sequence at SEQ ID NO. 27615
aactccccccgacacccaaccgaagccgtagagggaggcagcgaaaagcttgctcttttataccctccctagggtttcgggcctcgcctccctcgcttcgcgccatctcccgcctcccctcgccgccgatcgattcgccgcccggagccccaattcgatcccctggtcgctcgatctgggatccgctagattcgttgtcccggtgatgaggaggtgatgggggcgatggcggcggaggtggtgcaggaggggtgcgtggagaatcggcagcccctggcggcgtcgagctcctctttgtctgatggcagcaactgtggcggcggaggccaggccggggcgtcgccgccggtatcaagctcggggaattccatctccggcctgaggcgaacaagtgggcccataagaagagctaagggtggctggacaccagaagaggatgaaacactgcggaaggcagttgaaactttcaagggtagaaactggaaaaaaatagctgaattcttccatgataggacagaggtacaatgtttgcatcgctggcaaaaggttcttaatcctgagcttatcaaaggcccttggactcaagaggaagatgataaaatcatcgaccttgtgcgcaagtatggaccaacaaaatggtctatcatagcgaagtcattgcctggccgcataggcaagcaatgccgagagaggtggcataatcatctgaatccagaaataaggaaagatgcatggactcttaaggaggaaagggcactcattaatgctcatcgagtgtatggaaataagtgggcagaaatagcaaaagctcttcctggaaggactgataattctataaagaatcattggaacagttctttgagaaagaagctagatgtctacggtgccaacagtgttctcgcaactccaaacctgctagctcatgatgatttcaaggatcaaatgaggcctgtagctattggcagccatcttgatctgaacaaagtgcccaacattggttcaaaagatgtccctggaagagctcatcgctccattatggggccacttttacaggcatacaatttgaaatctatcgaggactctggtggtctcctttctctttctataccaactgtgcaggcttcatactcatcactagttgatggttctgctgttactctagcggtacaaggtctggaaagtgactctgtccgtgagaagggcctagaaattaattccattcattcgaagcatgagaagtgtactgagattagctccacacctgatcctgtggaggaaggctgtgccattcagtcagaatctgctccaggcaaaagtggtaccaaaccatctttgaagaatgagttgtattctacccttggtcctctttgttatcagattcctaatatggaagaagttgccccaatcagttcctcactccgttctgaacatcatggtgcacatcaaacaacacagcatagcagggatgggcttatgtcacctgatggttatacttccccatctccaacaattggcaaagtatcaagtccactaactgtcgattcaattttgaaaactgctgctgacagctttccatgcactccttcaatattaaggaaaagaaaacgtgataaatcaacacctacttcagacaactttttcactcctaatgggacaagagcttctacaaattctccagagtcatttaaaactgcatcatttttgtcattgggccctattgatgatgggttattgacatctgtcaggagttctgatgcttcacctccctatcagatcaggtcaaaaagaatggttgccctaaaatcagttgagaaacagctagatttttcagcagatggattggatacttctggttctgaaatcctgaactctccttgccataattctcaaggcgcaaattctaaggggacgtagcgcatacagtgattggatgtaaccaactatccttaatttgcaggaaccaatctcaatcttacgaagcacgatgggacacatggaagttgctttctgaactaacatgcttcacaaaaatgtcccagttcaagccaaaatgcaaatcaaacaccactagtggagaaaagagcctccaacaattgaaacgacggactgagtgcaaaagggccatcaattaccctgtcatctcttgtaatcagggtgtacaaaatactgtctagattgaaatgatacactccatagaggattacactgtttgcaccattttgtgaacttaacagctaggagttaagattgtagaagcccacagctgtgtacaaacaagaaaacatagctttag

SEQ ID NO: 27615 - protein, 565 aa, Panicum virgatum
  misc_feature: Ceres CLONE 1878134
  misc_feature (118)..(164): Pfam Name: Myb_DNA-binding Pfam Description: Myb-like DNA-binding domain
  misc_feature (66)..(112): Pfam Name: Myb_DNA-binding Pfam Description: Myb-like DNA-binding domain
  misc_feature (170)..(215): Pfam Name: Myb_DNA-binding Pfam Description: Myb-like DNA-binding domain
  misc_feature: Functional homolog of the protein sequence given in SEQ ID NO 51253
  misc_feature: Useful for making plants with modulated water use efficiency
  misc_feature: The sequence is a functional homolog of SEQ ID NO 2684 in the 10/374,780 US patent application
  misc_feature: The sequence is a functional homolog of SEQ ID NO 844 in the 10/225,066 US patent application
MGAMAAEVVQEGCVENRQPLAASSSSLSDGSNCGGGGQAGASPPVSSSGNSISGLRRTSGPIRRAKGGWTPEEDETLRKAVETFKGRNWKKIAEFFHDRTEVQCLHRWQKVLNPELIKGPWTQEEDDKIIDLVRKYGPTKWSIIAKSLPGRIGKQCRERWHNHLNPEIRKDAWTLKEERALINAHRVYGNKWAEIAKALPGRTDNSIKNHWNSSLRKKLDVYGANSVLATPNLLAHDDFKDQMRPVAIGSHLDLNKVPNIGSKDVPGRAHRSIMGPLLQAYNLKSIEDSGGLLSLSIPTVQASYSSLVDGSAVTLAVQGLESDSVREKGLEINSIHSKHEKCTEISSTPDPVEEGCAIQSESAPGKSGTKPSLKNELYSTLGPLCYQIPNMEEVAPISSSLRSEHHGAHQTTQHSRDGLMSPDGYTSPSPTIGKVSSPLTVDSILKTAADSFPCTPSILRKRKRDKSTPTSDNFFTPNGTRASTNSPESFKTASFLSLGPIDDGLLTSVRSSDASPPYQIRSKRMVALKSVEKQLDFSADGLDTSGSEILNSPCHNSQGANSKGT

SEQ ID NO: 27616 - DNA, 707 bp, Panicum virgatum
  misc_feature: Ceres CLONE 1878143
  misc_feature: Encodes the peptide sequence at SEQ ID NO. 27617
acgaagccagcgaaaatccagtagagagagagaggggcagaggggagggaggcagccggcagccattactcccaccagccagcaccaccaccgctgctgctggggacgcctgcagcaagtacaggcggatatccgcttccattactgtatctcgcggcggcggaccagcggcggcagagggttcgcttcggcggccgcaataaattccgcaccccccccccacccccatggcaaggagggccgcctcctcgctcgtctcccgctgcctcctcgccagcagggccgcctcggcaggcgccgcgcccgctgtcccctccgcgctccgcaggccagatgggacgcgcggattgttgccaggggtccttcaaaggttcagcactgcagcagcagcagaggagcccatctcgcccccagtccaagtgaactacacaaagctcctcatcaatggcaactttgttgattccgcatccggcaagaccttcccaacactggaccctcgtacaggggaggtaattgctcatgtggctgaaggtgacgcggaggatgttaaccgtgccgtcgctgcagcacgcaaggcttttgatgaggggccgtggccgaagatgactgcatatgagaggtcccttatcctgctacggtttgctgatttgatcgagaagcacaatgacgagattgctgctttggagacatgggacaatgggaaacat

SEQ ID NO: 27617 - protein, 159 aa, Panicum virgatum
  misc_feature: Ceres CLONE 1878143
  misc_feature: SWISSPROT Homolog: EC 1.2.1.3 Aldehyde dehydrogenase (NAD(+))
MARRAASSLVSRCLLASRAASAGAAPAVPSALRRPDGTRGLLPGVLQRFSTAAAAEEPISPPVQVNYTKLLINGNFVDSASGKTFPTLDPRTGEVIAHVAEGDAEDVNRAVAAARKAFDEGPWPKMTAYERSLILLRFADLIEKHNDEIAALETWDNGK

SEQ ID NO: 27618 - DNA, 527 bp, Panicum virgatum
  misc_feature: Ceres CLONE 1878149
  misc_feature: Encodes the peptide sequence at SEQ ID NO. 27619
gttcccctccctccctcaccccgcgtcgccggacgaacgccggggcatcgccctgcggccgccgtgccagaggcgtcgatcggcgcggcgggcattgggtgggagagggtgttcgttgtcgtctaggcggggagggggcaggatgagcatgtacgggagggacccgtggggcgggccgctggagatatgccacgactcggccacggacgacgaccgcagccggaacctggacatcgaccgcggcgcgctgtcgcggacgctcgacgagacgcagcagagctggctgctggcggggcccggggacccgggccgcaggaggaagaagtacctctacatcggctgcctcgtcgtcagccgctagttcttcgtctggacgctcggggtgctcctcgccgccgccgtcttcgcgggggtcgtggccgggatcgccaaggccatacccaggcgccaccgcccgccaccgccgcccgacgactacatcgtcgcgctgcacaaggcgctcatgttcttccacccccagagatctg

SEQ ID NO: 27619 - protein, 72 aa, Panicum virgatum
  misc_feature: Ceres CLONE 1878149
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MSMYGRDPWGGPLEICHDSATDDDRSRNLDIDRGALSRTLDETQQSWLLAGPGDPGRRRKKYLYIGCLVVSR

SEQ ID NO: 27620 - DNA, 1361 bp, Panicum virgatum
  misc_feature: Ceres CLONE 1878156
  misc_feature: Encodes the peptide sequence at SEQ ID NO. 27621
aaccctcccctcgccccccaataaaaaaaaaacttccatctcccgcctccgcctccgcctccgcctcggcaggcactgccaatctcctctcccctctccctctccctctccctcctcgatcccaaggcgagagaccagggaacccgcgacgaccgcgcgcacgagccgctgcagtgagtgacctcgcaacccgcgcgcgtgagaggggagatcgagcagaaggtgccgggacccgaccgagccgaggactcgagaccatgaagtacgtgctggtgaccggcggcgtcgtgagcgggctgggaaagggcgtgacggccagcagcatcggcgtcctgctcaaggcctgcggcctccgcgtcacctccatcaagatcgatccatacctcaacaccgatgcaggaaccatgtctccgttcgagcatggcgaagtgtttgttttggacgacggtggtgaggtggacttggaccttggaaattatgaacggtttctggacatcaagttgactcgtgacaacaacataaccacgggaaagatctaccaggtgatgggagtaaacagtccatctcaaaagtccacacgagattttgagctaacttgctagtatatgtgctaaaagttggagtttatgctcactttgacatttacaaactgggaatattcggtgattttttcttttacaactcagatttggtgcttctttacctgaatttttcatggagcccacaaatctttttccatgttgctttatttaccctaagatctgctgcacttcaataatacatgtggacaatcatctgggccttagtcggccactcctgtctggagcaattggttggtggaaagtacatcagattaatagtgcaccagtcataggcttggactcattgtagaactaggtgcttcctttactgggacacagattcagtgcctttgttgagcaaaggcacgttgtaactttgctctatatccagccatctattcctaatctgacgtactccattcttttcagccatctattcctaacctgcagacctttttagccattggatgttcaattcacggtggatttgataggagaaggcaaggcgtgcctttaaggagccacggcactgaatctgtgtcgcctttactgtatctgcaagttgttgcagagatttactagcagttgaaattcgtgcaagatgaatttagcgtgaaatggtcccataatgtgacttagaataggtaatggaatcatgggactaatatacagtttaaatgcaaaagggaagctgttgtctatcactttgtggtcagacatagaactactggagcatatatgcttttatatataatatacacgtaccttgtatgagatgtc

SEQ ID NO: 27621 - protein, 114 aa, Panicum virgatum
  misc_feature: Ceres CLONE 1878156
  misc_feature (1)..(109): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQVMGVNSPSQKSTRDFELTC

SEQ ID NO: 27622 - DNA, 708 bp, Panicum virgatum
  misc_feature: Ceres CLONE 1878156-R
tgccaactcataggtttttgttggcgcacaatttcaccctgaattcaagtcaaggcctggcaaaccctctccacttttcctaggattgatagcagcagcatcgggtcagcttgatcacctgcttcaacgcccctgcggcgttttcagtccaacaggcagatgcacctgttttcccaacggacctcataagctaaaagtgtaccagaacgggcacgtcgtaaagccactgaagggcctggtgaacgggcactatccagcaaccggcaacggcgccattcccatctagcagcacaacgctgcaaggcgccaggttgtttgagatttcccttctaccgtttctgcttgattttttttttcctttctcccttcgcgcgcgttcttcaattctaccagtcccaactaaagaaaaggactgcttgctccagcgacacggcgagccggttccgatgttttaaaggaagcatttggcatataagctgtcgcgttgagaggcaaattagcaggttagctagggtttgattagtagtggttatctgatatgctggcttattatgtttgttcgtttgtttgctaagatgattacaagggccggtgatgtgcaactagctgtagtggagcctgccatctcgcctgattgtacattgtaaaacaactgctactctccatgtactgtatcgatggatgagtattaaaagaagttatgggacc

SEQ ID NO: 27623 - DNA, 704 bp, Panicum virgatum
  misc_feature: Ceres CLONE 1878163
  misc_feature: Encodes the peptide sequence at SEQ ID NO. 27624
atcgcatcgcatcgcaccgcaccgccaccacccaacccccgttcctcgcagttgcagcacgctcttctgctccaagccagaagagcaaggccgggcccaacgcgcggcggatggcggagacggagcccaccaccaacggcggcagcgctggcggcggcatcggggccatcctcgccgccggcgaccgggacttcctcgtccgcaactccggcgagcaggtgaagatcagcagcatagaggcgagccctgtggccctctacttctcagcctcatggtgcccgccatgcaggcggttcacacccaagctgattgaattatacaaagaactggcctctcagggcaagagctttgaggttgtatttgtttcaggtgatcaggatgaggaagcattcaattcatactttggaaagatgccatggttggctgtccctttctctgactctgaaggccgtgaaggccttgatggccggtttaaggtatctggtatcccacaccttgtcattcttgatgcaaaaactggtgaagtttacactgaagatggtgttgagtttgtgagcgagtatggtgtagaggcttaccctttcacaccagagaggatcaacgaactgaaggagcaggaaaaagcagaaaaggataatcaaactattcaaagcgttcttggcacatccactcggaactatctaatttcaaacaagggagacaag

SEQ ID NO: 27624 - protein, 197 aa, Panicum virgatum
  misc_feature: Ceres CLONE 1878163
  misc_feature (17)..(142): Pfam Name: AhpC-TSA Pfam Description: AhpC/TSA family
MAETEPTTNGGSAGGGIGAILAAGDRDFLVRNSGEQVKISSIEASPVALYFSASWCPPCRRFTPKLIELYKELASQGKSFEVVFVSGDQDEEAFNSYFGKMPWLAVPFSDSEGREGLDGRFKVSGIPHLVILDAKTGEVYTEDGVEFVSEYGVEAYPFTPERINELKEQEKAEKDNQTIQSVLGTSTRNYLISNKGD

SEQ ID NO: 27625 - DNA, 892 bp, Panicum virgatum
  misc_feature: Ceres CLONE 1878174
  misc_feature: Encodes the peptide sequence at SEQ ID NO. 27626
gtgcgtgcgttccttccgagctgctcgtccgatcgatcgcgatgggggacgacgacggtgcttgcgaggcggcgctgcatggccggcggcggcgaggtgaaggggaccgctgggatggcggcggcagctgggtgtctgcggggagcacggcggcggggtccgcgtccgccgggacggtgtctggcggcgggtcctcggccacgacgtcgccgctcttctcgtcggcgtccagcctcaccgacgaggagggcgacggcgacggcgccacgtcgtcctcctcccgcccggatcgtgccgtctcgtcgtcgtccttgtcctccttgacgtcgtcggggtcggaaacggtgcagatgggcgcggccggcggcgggacgcccgggccgctctacgcgctgtccacgatgctagatgatcttccggctctcagaacagggctgtccaagtactacaagggaagatcccagtccttcacatcgcttgccgatgtcagctgcgtggaggatctcgcgaagaagaccaccccttacatcagaaggaagaagcagacgcccaggtgctacgctgaagtgctgggcgccaagaaccggctgtcgaagacgatagccaaaaaggcgccgaggggcaagccacctgcataccagggcaagggagagatgcacagatgctaggccatggcaaaaaaaatgtaggcggctcatgccaatgaattgagataggtacagcactgagcacacgttcagtaggaaacctccttgtgttccctcgtcagtagagctttctcaaatcgatttagtatttgcctctcatgtacataggtcactgtccactgtccagtttgtgtctgcatccttgattggctgaacttaaagcagagcagattcttgtcaagctc

SEQ ID NO: 27626 - protein, 208 aa, Panicum virgatum
  misc_feature: Ceres CLONE 1878174
  misc_feature: Functional homolog of the protein sequence given in SEQ ID NO 51254
  misc_feature: Useful for making plants with modulated biomass
MGDDDGACEAALHGRRRRGEGDRWDGGGSWVSAGSTAAGSASAGTVSGGGSSATTSPLFSSASSLTDEEGDGDGATSSSSRPDRAVSSSSLSSLTSSGSETVQMGAAGGGTPGPLYALSTMLDDLPALRTGLSKYYKGRSQSFTSLADVSCVEDLAKKTTPYIRRKKQTPRCYAEVLGAKNRLSKTIAKKAPRGKPPAYQGKGEMHRC

SEQ ID NO: 27627 - DNA, 681 bp, Panicum virgatum
  misc_feature: Ceres CLONE 1878178
  misc_feature: Encodes the peptide sequence at SEQ ID NO. 27628
aaagccatctgctagtcaagtctcactagtcactcctaatcctaaaccacaacacaccttggtgttagaagtgctatggctaccaccaccatggccctctcctctacggccttcgccggcaaggccgtcaacgtgccatcgtctctctttggcgaggcccgcgtgaccatgcgcaagaccgcggcgaaacccaagccggctgcctccggcagcccgtggtacggcccagaccgcgtgctctacctcggtccgctctccggcgagcccccgagctacctgaccggagacttccccggcgactacggatgggacaccaccgggctctcggccgaccccgacaccttcgccaagaaccgggagctggaggtgatccactcccgctgggccatgctcggcgcgctcggctgcatcttcccccacctgctcgcccgcaacggcgtcaagttgggcgaggccgtctggttcaaggagggttcccatatcttcatcgagggcgggcttgactacctcggcaacccaagcctgatccacgcgcatagcatcctcgccatctgggcctgccaggtcgtgctcatgggcgccgtcgaggggtaccgcgttgccagcggcccactcatcgagatactcaaccctctctaatccgtctgcagcttcgacccgctcggcctcgccgacgatccc

SEQ ID NO: 27628 - protein, 182 aa, Panicum virgatum
  misc_feature: Ceres CLONE 1878178
  misc_feature (58)..(180): Pfam Name: Chloroa_b-bind Pfam Description: Chlorophyll A-B binding protein
MALSSTAFAGKAVNVPSSLFGEARVTMRKTAAKPKPAASGSPWYGPDRVLYLGPLSGEPPSYLTGDFPGDYGWDTTGLSADPDTFAKNRELEVIHSRWAMLGALGCIFPHLLARNGVKLGEAVWFKEGSHIFIEGGLDYLGNPSLIHAHSILAIWACQVVLMGAVEGYRVASGPLIEILNPL

SEQ ID NO: 27629 - DNA, 727 bp, Panicum virgatum
  misc_feature: Ceres CLONE 1878198
  misc_feature: Encodes the peptide sequence at SEQ ID NO. 27630
atcgatagtagagcacagcagagcagagcagagtcttcctcaacccatcctcgctcccctacaccaattcgttcagcgatctttcgtgcttggccctcctgcgctgcacatggcatcccccgccgccgccgccgccgccgccggagccgccgggcgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgcgccccgtctacgccgccatggacagcgcagggtacattatgacctcggacgtgctggcgagcgtggagcggcacgccagcgccgtctcggcggcggccgtcgacaaggccaggcgcctctgcgccgagcacccgcacgtggcggtggagacgctggtggagagcggggacccgcgggatgtgatctgcgacgccgccgacaaggtgggcgccgacctgctcgtcatgggcagccatggatacggcttcatccagagggcgttcctgggcagtgtcagcaaccactgcgcgcagaactgcaaatgcccggtcctcatcgtcaagaggcccaaggagtagaccggtccttgcaaatgctgcatcttgccagcctgtagcatcatatatgtaaatattttttttaatcctcccatggcaactggtttcttggccctgttctcttgtcttgtc

SEQ ID NO: 27630 - protein, 168 aa, Panicum virgatum
  misc_feature: Ceres CLONE 1878198
  misc_feature (15)..(164): Pfam Name: Usp Pfam Description: Universal stress protein family
MASPAAAAAAAGAAGRRIVVAVDEGEESAHALAWCLANVVSPAGGDTLVLVHARRPRPVYAAMDSAGYIMTSDVLASVERHASAVSAAAVDKARRLCAEHPHVAVETLVESGDPRDVICDAADKVGADLLVMGSHGYGFIQRAFLGSVSNHCAQNCKCPVLIVKRPKE

SEQ ID NO: 27631 - DNA, 1410 bp, Panicum virgatum
  misc_feature: Ceres CLONE 1878213
  misc_feature: Encodes the peptide sequence at SEQ ID NO. 27632
cactgcaccaccgcacacagcgcaccagaggcacacgctgacacgcatcatatctgcacaagctccagcttccttccggctcctcaagtgctaagcgcgcttcgatcggccgcggcgtttcgttcgacaatggcgatcctgtcggacgccgccacccaggtgctcgtcccgctcgccgcggtcgtcggcatcgccttcgccgtcgcgcagtgggtgctcgtctcgcgcgtcaaactctcgccgtccgcgcgcggcggcgccagggacaaggacgtgctcggcgagtcgctcatcgaggaggaggagggcctcaacgaccacaacgtcgtcgtcaggtgcgccgagatccagaacgccatcgcccaaggagccacatcgttcctcttcaccgagtaccaatacgtcggcatcttcatgtccatcttcgccgacgtcatcttcgtcttcctcggctccgtcgaggggttcagcacgaggggccacccctgcacgtacagcaaggacagggagtgcaagcccgctctcttcaacgccctcttcagcaccgtctccttcctgctcggggccgtcacctccgtggtgtctggcttcctcgggatgaagatcgccacgtacgccaacgcccggaccactctggaggccaggaaaggcgtcggcaaggccttcatcaccgcgttccgctccggcgcggtgatggggttcttgctggcgtcgaacggcctcctggtgctctacatcgccattaacctgtttaagctgtattacggcgacgattgggagggtctgttcgagtccatcaccgggtatggccttggtggatcttcgatggcgctgtttggaagggtgggaggcgggatctacaccaaggcggccgacgtgggcgctgatcttgttggcaaagttgagaggaacattcctgaagatgatcccaggaaccccgcagtgattgctgacaacgtcggagataacgttggtgacatcgctggaatgggctcggatctgtttgggtcatatgctgaatcttcctgcgctgcccttgtcgtggcatccatttcctcgttcggggtcaaccacgatttcactgggatgtgctacccgctgctagtcagctccgttggcatcattgtctgcctgatcaccacgctctttgcaaccgacatctttgagataaaggctgtaaaagagattgagcctgcactgaagaagcagctcatcatttcgacagccctgatgactgtcggcatcgcgctgatcagttggttggcactcccagctaaattcacaatcttcaattttggtgaacagaaagaagttagcaactggggcttgttcttatgtgttgcaattggtctctgggctggcttgatcattggctatgtgacagaatactatactagcaatgcatacagt

SEQ ID NO: 27632 - protein, 426 aa, Panicum virgatum
  misc_feature: Ceres CLONE 1878213
  misc_feature (6)..(426): Pfam Name: H_PPase Pfam Description: Inorganic H+ pyrophosphatase
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
MAILSDAATQVLVPLAAVVGIAFAVAQWVLVSRVKLSPSARGGARDKDVLGESLIEEEEGLNDHNVVVRCAEIQNAIAQGATSFLFTEYQYVGIFMSIFADVIFVFLGSVEGFSTRGHPCTYSKDRECKPALFNALFSTVSFLLGAVTSVVSGFLGMKIATYANARTTLEARKGVGKAFITAFRSGAVMGFLLASNGLLVLYIAINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGVNHDFTGMCYPLLVSSVGIIVCLITTLFATDIFEIKAVKEIEPALKKQLIISTALMTVGIALISWLALPAKFTIFNFGEQKEVSNWGLFLCVAIGLWAGLIIGYVTEYYTSNAY

SEQ ID NO: 27633 - DNA, 668 bp, Panicum virgatum
  misc_feature: Ceres CLONE 1878213-R
  misc_feature: Encodes the peptide sequence at SEQ ID NO. 27634
ggcaccttgttcggcgtgcagacgctctccggcgtcctcgccggcgccctggtctccggcgtgcaggtggccatctccgcctccaacaccggcggcgcctgggacaacgcgaagaagtacatcgaggcgggggcgagcgagcacgcgcgggcgctggggcccaagggctccgactgccacaaggcggcggtgatcggggacaccatcggggacccgctcaaggacacgtccggcccctcgctcaacatcctcatcaagctcatggccgtcgagtccctcgtcttcgcgcccttcttcgccacccacggcggcatcctcttcaagctcttctagcagcagcagagctcagctacctataccgcggatgattttggttttggattactctgattctgatccggcgcgtgtcaataaagccaacccctgcagcagaggacgacggtgctagtagttggtctccttgtatagaaaatagtagctcaaagtttgccgtgtgtgtgtcgtgtcaacctttctacctgcgggtgttggaatgtagcatactaacatgtgtgtgtgcatattttgcttggtgaatgtaacattgatcagaatcttctgaagaaaaagaaagaacagggacccctcccaaagtaggatatcgacttgggttgggcctgatacaaggc

SEQ ID NO: 27634 - protein, 110 aa, Panicum virgatum
  misc_feature: Ceres CLONE 1878213-R
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
GTLFGVQTLSGVLAGALVSGVQVAISASNTGGAWDNAKKYIEAGASEHARALGPKGSDCHKAAVIGDTIGDPLKDTSGPSLNILIKLMAVESLVFAPFFATHGGILFKLF

SEQ ID NO: 27635 - DNA, 724 bp, Panicum virgatum
  misc_feature: Ceres CLONE 1878214
  misc_feature: Encodes the peptide sequence at SEQ ID NO. 27636
atctctccactcgcgcataaacaaccgatcctactcccaagcaatgtatccctcggtcccgccggacgcttatcataagttcagcgccgtgagctccgccaaaggagccgccgccggccgcgtaccagcagcacggggccgtgaacatcatgaacccctcacgccccggcgccgggctgcggacatggtccaccggcctcttcgactgcatggaagacccggggaactgtctcatcagatgcctgggcccctgcatcccgttcggtcacatagcagacatcgcgcacaaacgaacctgctcttgtattgcgagtggactgatctatggcctcatctgcgcctcgacggggatgggctgcctctactcgagcttctaccggaccaagctgatggccgagtacgacctgggggagggggagtgccccgacttcctggtccactgatgctgccagcacctgccgctatgccaggagtaccgcgagctcaagaaccacggcttccaactgcggatcggttgggatgcctgcatgtaccggcagaatcgaggagttgccggcggcacggtgatgggcgcgccggccacgccgctcgacatgatgagataggagataatggttgtgagatgtcgatatcgctttgctcccgtggtcattcgtgttgctacgctgttagcagttcttttctcgtcttgcgacatgagatcagaaagcatgtatttctctct

SEQ ID NO: 27636 - protein, 97 aa, Panicum virgatum
  misc_feature: Ceres CLONE 1878214
  misc_feature (13)..(97): Pfam Name: PLAC8 Pfam Description: PLAC8 family
MNPSRPGAGLRTWSTGLFDCMEDPGNCLIRCLGPCIPFGHIADIAHKRTCSCIASGLIYGLICASTGMGCLYSSFYRTKLMAEYDLGEGECPDFLVH

SEQ ID NO: 27637 - DNA, 729 bp, Panicum virgatum
  misc_feature: Ceres CLONE 1878220
  misc_feature: Encodes the peptide sequence at SEQ ID NO. 27638
aaaatcgtttatttccatccccacctcccttatctcccgcgctctcctctttcccaccatcagcctccaacaccaccaccaccatggctgccctcggcatcacctccccgccggcgccgtccgccttcgcgtccgcaacatcttcccgctcccactcttcaccctccaccccccgcctccgcctccgctccctccccacccgattcgcggctgcggcgtcgttccgcgcgcggtgcgctgccgccgccgccgcagccggcggcgctgcgggctccgagggcgccgccgcagtggcggaggtggatgaggcgggcaccgaggtcgccgggggcgccgcaacctccacgcggccgccctactcgctcatctccgcggagaatgtgcagaaggcgatgcgtggcctagctattacagatgctgatcactatgggaggcttggagtcacaagactagcttctactgatgaggtaaccgctgcctatgagaaaaagtgtgtagaactaaatagcaaaaaactggaagaagaggagctcaacaaggaacttgacctcctaaaggaatcatttaccatactatcaactgaggaagagcgaagattatatgattggagcatgtccagaagtgggcaacctgagcgatatgtctggccttttcaagtagatcccttggagccggcaccagatcctccccaggaacctgaagacgaggtcccgacaaagctcgttggct

SEQ ID NO: 27638 - protein, 215 aa, Panicum virgatum
  misc_feature: Ceres CLONE 1878220
  misc_feature (113)..(174): Pfam Name: DnaJ Pfam Description: DnaJ domain
MAALGITSPPAPSAFASATSSRSHSSPSTPRLRLRSLPTRFAAAASFRARCAAAAAAAGGAAGSEGAAAVAEVDEAGTEVAGGAATSTRPPYSLISAENVQKAMRGLAITDADHYGRLGVTRLASTDEVTAAYEKKCVELNSKKLEEEELNKELDLLKESFTILSTEEERRLYDWSMSRSGQPERYVWPFQVDPLEPAPDPPQEPEDEVPTKLVG

SEQ ID NO: 27639 - DNA, 2325 bp, Panicum virgatum
  misc_feature: Ceres CLONE 1878230
  misc_feature: Encodes the peptide sequence at SEQ ID NO. 27640
gttaacgagttgaatcctctcccaactgctgctaattactaccgctgcgcgcctgcgatcgaatcgacgcgaacctcaatttccttcccgtcccaaaattctccgatcccgaacccaatcgcagcggaaaccttcctccccccgcaatccacaccgggcgggcgccgacgccggctccaatggcggccgccgccatctcccacctccgccgcggcgcgcagcgccacgcgctgctgtgcctctcgctctcgcgccgccgcttatcctcctccgcggcgtccccgctcgccgcggccgcgcgccggctcctctccacgacggtggacgccggcacgtcctcgtctggggagcactacaagccgccgcccttcgaccccttccgcgccgccacactgtcgccctcggcgccgcagctggagtcgcccccgatcgaggatgagccgcccagcagcccgccaccgcctgaggaggcggtcgcgtccgaggcggcgcacgagcaggcgacgctggcgtgccaggaggtggagctcgagggactcaaggcgggggtggaggcggtgaagagcagggaggagtcgccggaggagaaggaggcgtggtggctgctcggccgcgcggtcgtcaactactgcggcagcgccgtggggacgctggccgcgaacgacccgtccaccagtcagatgctcaattacgaccaggtgttcatcagggacttcgtaccgtcggcaatcgccttcctcctcaaaggggagagcgaaattgtgaagaatttcctgctccacaccttgcagctccagagttgggagaagaccgtggattgctatagccctggtcaggggttgatgcctgctagtttcaaagttagatctgtgcctttagatggaaatagtgaagcatttgaggaggttcttgaccctgattttggagagtcagccattggacgtgtagcgccagttgactctggtctttggtggataatcctgttgagggcatatggcaaaattactggagactatgctctacaagaaagggttgatgtgcaaacaggcatcaggctaatactgaatttgtgcttgtctgatggatttgacatgtttccgacattgctagtaactgatggatcatgtatgattgatcggcggatgggaatccacgggcatcctcttgagatccaggctcttttctattctgttttgcgctgtgctcgagaaatgatcggtgtaaatgatggatcaaagaacttgatccgtgctattaacaataggctcagtgctctgtcatttcacatcagagagtattattgggttgatatgaagaagataaacgagatttatcgctacaagactgaggagtactcccatgatgctatcaacaagttcaacatctacccagagcagattccttcttggcttgcagactggattcctgtgaaaggtggttaccttattggcaatctgcagccagctcacatggattttaggtttttctctctagggaatctctaggcaattgtctcatctcttgctacccaaaggcaagcagagggtattctaaatctcattgaagccaaatgggatgacatagtggccaatatgcctctcaaaatatgctaccctgcactagagtacgaggaatggcgtatcatcactggtagtgatcctaaaaacacaccctggtcgtatcataatggtggatcttggcctacattgttatggcagttcaccctagcctgtatcaagatgggtaggcgtgacttagcacggagggcagttgaagtggcagaaaagaggctctcagatgacaagtggccagagtattatgacaccaggacaggaagatttattgggaaacaatcacggttatatcagacttggaccattgctggttatcttagctccaaaatgttattggactgtcccgagatggcatccatactaatatgtgatgaagacttcgagctgctggaagggtgtgcttgcagtctgaacaagagtgctcgcaccaaatgctcacgtcgtgcggccaagtcgcaggtccttgtgtagttccatgcctggttttcaccccaagaactgcactgctccttcaactttgttgaattgttcgtcacagaagttggcactagttagtagttacttcagcaggatgaccacgaaccacctatgccggttattttggcgagtttgtggttgatccactcatacaagagtatacattgttgtgtgtacattttacttaatcaatcttatgtattctgccagtcaactcgagttgattggttgtttttttgtaagcagacagcatgtaaatattaccagctgttac

SEQ ID NO: 27640 - protein, 441 aa, Panicum virgatum
  misc_feature: Ceres CLONE 1878230
  misc_feature (127)..(441): Pfam Name: Invertase_neut Pfam Description: Plant neutral invertase
  misc_feature: Functional homolog of the protein sequence given in SEQ ID NO 50740
  misc_feature: Useful for making plants with altered carbohydrate content
  misc_feature: Functional homolog of the protein sequence given in SEQ ID NO 51255
  misc_feature: Useful for making plants with modulated oxidative stress sensitivity
MAAAAISHLRRGAQRHALLCLSLSRRRLSSSAASPLAAAARRLLSTTVDAGTSSSGEHYKPPPFDPFRAATLSPSAPQLESPPIEDEPPSSPPPPEEAVASEAAHEQATLACQEVELEGLKAGVEAVKSREESPEEKEAWWLLGRAVVNYCGSAVGTLAANDPSTSQMLNYDQVFIRDFVPSAIAFLLKGESEIVKNFLLHTLQLQSWEKTVDCYSPGQGLMPASFKVRSVPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQALFYSVLRCAREMIGVNDGSKNLIRAINNRLSALSFHIREYYWVDMKKINEIYRYKTEEYSHDAINKFNIYPEQIPSWLADWIPVKGGYLIGNLQPAHMDFRFFSLGNL

SEQ ID NO: 27641 - DNA, 723 bp, Panicum virgatum
  misc_feature: Ceres CLONE 1878236
  misc_feature: Encodes the peptide sequence at SEQ ID NO. 27642
ggggattatggtcgcaaggcctactacccgtatcccaaatcccaatcccccgtgaccgctgctccattcttggaagccccggagggagagcggagacgcccggcgcccacgcgcttggcctcgaggtcccagacacccaaacaaagatggcaacttcgacatctccagttctctgcaacttcatggccatcgcacagaacaacacgcttgtgctgaacaagagcacaaagcggtccctgctgcagctgagcttcccgaggggcacgccgacactgccggacttgagagcgaggcaggacgtccgcgtcgccgccgtctacaaggtgaagctcatcgggccggaggggaaggagagcgtggtcaaggtgccggaggacagctacatcctggacgcggccgaggaggccgggctcgacctgccctactcctgccgcgccggcgcctgctcctcgtgcgccggcaaggtcctgcagggctccgtcgaccagtcggaccagtcgtacctcgacgacgagcaggtcggcgccgggtacctgctcacctgcgtcgcgtacccgacctccgactgcgtcatccagacgcaccgggaggcggacctgtactagctagtagtagccctgtgccactcccgcagctccattcagactcgagcttgagttctcttgacattgcgatttcgcatcgatctgtacttgtcgctggatcttagctactagactcctt

SEQ ID NO: 27642 - protein, 152 aa, Panicum virgatum; identical to SEQ ID NO: 12196
  misc_feature: Ceres CLONE 1878236
  misc_feature (63)..(139): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase

SEQ ID NO: 27643 - DNA, 1353 bp, Panicum virgatum
  misc_feature: Ceres CLONE 1878239
  misc_feature: Encodes the peptide sequence at SEQ ID NO. 27644
cggtatcggccccactccacatccgcgagcccacgagttccttccgggttcccggaacctttccgagtccccaaaggcgtcgctcccacctcgccggcgatggcgagctccggcgggaactccgaccagctcttcgtctccgtcaagctggagagcccccaactcgccgagtgcgacctcgacccccacctcttcggctcccatcctgtcgccggctcctgggacccttgcaaggccctgccattggagcgggccggcgccgccgtgtgggacctcagctgcgtcgtcccttcgcagcatgaaccgctggatttcaagttcgttttaaagaaaacaaatgatagttcgcagtgcattgttgaggagggaccaaacagatcactaggttgccagagcagtgaagttgaattgaggcctgcagtgtttaaactcaatgaagggaatgatgtacttgagtgcaaggttcaggttcagacagaaatgttatccccatttgatctggctgctagttggagggctcatcaggagtatcttcagccttcaagggtgcgaggggccaatgatgtcactatcaacactggattagaaggcagagccaagaatggcttcgcttctggtttggagcttgatttagagaagtatgtagttccaacaccaaatatgggctccggtgttgtttatgcagctaacttgactgaaaatccacgttcattattgcaaactgggagttcctcaaacaatgataccacaaaggacattttgtacaactcgactaaaggcgattcatccccgaatcactatgctaaaactatgaagggcgcaactgaggggcatgcaccatcattggaagaacacaggacaatgtttgttgatagaggtgttggctcaccaaactttgcaagaccaacaaaggaaaccttttcagcgagcaactttaaatttgattctgaagcgaaggatatgccagcagcagaaggagctgttgcagcagctgcagtagctgatcagatgtatggcccgaaagaggaccgcaagttgaccattgtgttggttgggctgccagctcgtggtaataccttcacagcagctaaacttacaagatatcttcgatggttaggtcatgaaacaaaacacttcaatgttgggaagtaccgccggctcaagcatggaactaatcagactgctgatttctttcgtggagataacagggagggtgtggaggcacgaaacgaggtggcagcattagcaatggaagatatgctatcctggatgcaggaaggtggtcaggttggtattttcgatgccacaaaacagcacgagaatacggagaaacatgctgatgaaaatggccga

SEQ ID NO: 27644 - protein, 417 aa, Panicum virgatum
  misc_feature: Ceres CLONE 1878239
  misc_feature (301)..(417): Pfam Name: 6PF2K Pfam Description: 6-phosphofructo-2-kinase
  misc_feature: SWISSPROT Homolog: EC 3.1.3.46 Fructose-2,6-bisphosphate 2-phosphatase
MASSGGNSDQLFVSVKLESPQLAECDLDPHLFGSHPVAGSWDPCKALPLERAGAAVWDLSCVVPSQHEPLDFKFVLKKTNDSSQCIVEEGPNRSLGCQSSEVELRPAVFKLNEGNDVLECKVQVQTEMLSPFDLAASWRAHQEYLQPSRVRGANDVTINTGLEGRAKNGFASGLELDLEKYVVPTPNMGSGVVYAANLTENPRSLLQTGSSSNNDTTKDILYNSTKGDSSPNHYAKTMKGATEGHAPSLEEHRTMFVDRGVGSPNFARPTKETFSASNFKFDSEAKDMPAAEGAVAAAAVADQMYGPKEDRKLTIVLVGLPARGNTFTAAKLTRYLRWLGHETKHFNVGKYRRLKHGTNQTADFFRGDNREGVEARNEVAALAMEDMLSWMQEGGQVGIFDATKQHENTEKHADENG

SEQ ID NO: 27645 - DNA, 208 bp, Panicum virgatum
  misc_feature: Ceres CLONE 1878239-R
cggacaaaccaccggaggaagacccaaaaagggagaaaccacgacacacaaaaaccgagaaacaaaagggcggagcaggcgcccaagagaaacggaacaaacccagggaggcaggccaccccaccggggggcggcaagaaagaggccagggagcccacccacggaaagaaaacggcccaaacaaaaggagggagggcaaacaagcgca

SEQ ID NO: 27646 - DNA, 646 bp, Panicum virgatum
  misc_feature: Ceres CLONE 1878243
  misc_feature: Encodes the peptide sequence at SEQ ID NO. 27647
atccgtccagccatgagccatccatcaagccattcatcgcagtgtttagcgtgcgactcccttccctagaattgactgacttgccctgccctgccctgccggccttccccagcgaaagagagagaggaggagccatggcgccgcggaagctgtacgggatgccgctgtcgcccaacgtggtgcgcgtggccaccgtgctcaacgagaagggcctcgacttcgagatcgtccccgtcgacctccgcaccggcgcccacaagacaccggaattcctcgccctcaaccctttcggccagatccctgcgttgcaggacggagatgaagttctctacggtatgtaacgcaactgacggacatccctgctccttcaccgcttagttgtttactggcactccctctcgcaattgattaatgattattatcagctcaccactcgccattttaaatgaaccaaccactagatcctgatctctctctctctctctctctctctctctctctctctctctcttgagaccaccactaaatcctgatctaggaacagtatctatctccgttgtaccttactactaattctgtgttttattttttttaagaatgagcctaatacttgctagttgactactagtacttttatgattccacc

SEQ ID NO: 27647 - protein, 68 aa, Panicum virgatum
  misc_feature: Ceres CLONE 1878243
  misc_feature (2)..(67): Pfam Name: GST_N Pfam Description: Glutathione S-transferase, N-terminal domain
  misc_feature: SWISSPROT Homolog: EC 2.5.1.18 Glutathione transferase
MAPRKLYGMPLSPNVVRVATVLNEKGLDFEIVPVDLRTGAHKTPEFLALNPFGQIPALQDGDEVLYGM

SEQ ID NO: 27648 - DNA, 2257 bp, Panicum virgatum
  misc_feature: Ceres CLONE 1878260
  misc_feature: Encodes the peptide sequence at SEQ ID NO. 27649
gcgcagtcaactctctcccgctcggcctctgctgctgctgcagcagcgcgcaggcgaagggcccagaaaaatgctgcacggcccggcccaccccgcgtcgccgccggccgccgccatggccgccggcgggcagccgctggtggtgacgctcaactgcctcgaggacccgtccctggagcaggacgccctgtacggcgccgcggccgtggagcacgcgccgctctccgcgctcgccgcgggccgcgtcgaggccgccgccgccgtcctcctcccctcgctcgccttcctcccgcgcgccgcgcagcgcaggctccgcccctggcagctcctgctctgcctcggctccccggaccgcgccgcggacgccgccgccgccgccgagctcggcctccgcctcgtccacgtcgacgccaaccgcgccgaggaggtcgccgacaccgtcatggcgctcttcctggggctcctccgccgcacgcacctcctctccagccacgcctcctcctcgtccccgtccgccgggtggctcggtgccgtccagccgctctgccggggcatgcgccgatgccgggggctcgtgctgggcatcgtcggcgtcagcgccgccgcgcgctgcctcgccacgcgcagcctcgccttccgcatgagcgtcctctacttcgatccgctatacgaggctactgggaaaataaaacgtccttctattgtatttccttctgcggcaagaagaatggatactctcaatgatttattggcagcaagtgatcttgtttcgcttcattgtgcattgacaaatgatacaacacatatacttaatgctgagcgcctgcagcacataaagcctggagctttcattgtcaatactggtagctgtcagctcatagatgattgcgccctcaaacaactcttgattgatagcaccatagctggatgtgcattagatggtgctgaaggtccacagtggatggaagcatgggtgcgtgagatgccaaatgtgttaattcttcctcgaagtgcagactacagtgaggaagtgtggatggagatcagagagaaagcgattgcaatattgcagtcctttctctatgacggtgttgttccaaacaatgttatttcagatgaagatgaagagataagtgaagtgggatgtgaagatgatcaatttggcaaacaagaaaaagatcatgctttaaaggcttgtgatggtgagcagcaggcagcagaaagccaattaactacagaatacgacaagagaagagccatctcgcaacctgaagagcctcaagcttctgcacaatctcatagtattggctccagatctgaagggagacgcagccgatctggaaagaaagggaaaaagagacctgctcgccgcagatcacaacagaaaatggatgaattgtcaactctagagggaggaagcaactattcttcacgcagagatgatgataacctagtgttaagttctagttcacgatttgcatcacctgaggactcaaaaaataagcagaaatgttctgctgaatctccaatggagataatttctgaaaataagttgcctgcagggcttggtagaaagcttcctgaaaagctaaaagaaggttttgttattgctctaaaggcaagagataattcgggattttatgtttcaagagagagagtcgctggtgatggttggtatcttgatgtgataccaaatgctacaaagagggatcctgctgctcaattcctagtcactttcagaaacaaggacactatgggattgcgatcttttgttgctggaggaaaactattgcaggctaataataagatggagttcgtcttcgcaagtcattcttttgatgtttgcgagagctggatgctggaagggtccctgtcggaatgctgcaaactgatcaatcgcaaaaattcttctgctgtattggaggtctattttgagatcctcggagccccgagtgaagaagatggtgtgattaggtggcttgattaatatatctgacttatttagaaaaaaaaatagggctatgctgccaaagctattattgatccgatgttgtcggcgggttaggtctgctccgtatttttctattgccaaatattcagttttggctgttgttctagtagacttctagtgcttctgtgcctgcacggctgcacccagcatgtcactgaaactttttagcagtctgcttgttgtaggtcgcatctgtattttaattcttcagtatgcccgtgcaaaattaaataagactacttgcag

SEQ ID NO: 27649 - protein, 638 aa, Panicum virgatum
  misc_feature: Ceres CLONE 1878260
  misc_feature (125)..(315): Pfam Name: 2-Hacid_dh_C Pfam Description: D-isomer specific 2-hydroxyacid dehydrogenase, NAD binding domain
  misc_feature: SWISSPROT Homolog: EC 1.1.1.29 Glycerate dehydrogenase
MLHGPAHPASPPAAAMAAGGQPLVVTLNCLEDPSLEQDALYGAAAVEHAPLSALAAGRVEAAAAVLLPSLAFLPRAAQRRLRPWQLLLCLGSPDRAADAAAAAELGLRLVHVDANRAEEVADTVMALFLGLLRRTHLLSSHASSSSPSAGWLGAVQPLCRGMRRCRGLVLGIVGVSAAARCLATRSLAFRMSVLYFDPLYEATGKIKRPSIVFPSAARRMDTLNDLLAASDLVSLHCALTNDTTHILNAERLQHIKPGAFIVNTGSCQLIDDCALKQLLIDSTIAGCALDGAEGPQWMEAWVREMPNVLILPRSADYSEEVWMEIREKAIAILQSFLYDGVVPNNVISDEDEEISEVGCEDDQFGKQEKDHALKACDGEQQAAESQLTTEYDKRRAISQPEEPQASAQSHSIGSRSEGRRSRSGKKGKKRPARRRSQQKMDELSTLEGGSNYSSRRDDDNLVLSSSSRFASPEDSKNKQKCSAESPMEIISENKLPAGLGRKLPEKLKEGFVIALKARDNSGFYVSRERVAGDGWYLDVIPNATKRDPAAQFLVTFRNKDTMGLRSFVAGGKLLQANNKMEFVFASHSFDVCESWMLEGSLSECCKLINRKNSSAVLEVYFEILGAPSEEDGVIRWLD

SEQ ID NO: 27650 - DNA, 2655 bp, Panicum virgatum
  misc_feature: Ceres CLONE 1878266
  misc_feature: Encodes the peptide sequence at SEQ ID NO. 27651
agaacacgcgccttggaaaccaagacccggagagaccgaggcggccggcgcggaggaagcgtcgtccaggagaagaatcgccccaaccccgagctcgcacccggccgaggtctccattcccccccttgcccacctccgagtaccctctcctccgcggccgggagggagccgggacccgcccgcccgtccagcagccatcctgatccagttcgcgagcggggatggcccatggcggcggaagaagatcggcggcggcgggagaagccgtcgggtgctcaggcagcagatgacatgctgataccccctgcctgatccttcagagggtgtcatcagagccccctctgtgatacattgtttggtataaaatcagtttaatagaagatgccaaggtctgaatcagacagtgatgatattttctttgacgcatttgaaaatgttcggtcaccaagggagccttcatccccggaggattgcagcacgagcgatgatgtttcagtgccaaggaagtttgagtatgagatttgggcaaatgagccaatgagtgttcaagaaaggcggcaaaggttccttaagggaatgggattagatgaatttgtttctaccaggatggattcttttcaatgccatgaggaaatcacagcagttgagtctttcaccgacacggaggagagaactctcagtggccattcttccttggattcatctgtttgtgacaatgaattggaatttgacggtgcctgttgcataagggatatggatagtggaaagaaatatgtagttcacaatggtgcacatagcagtataactaacatgctgaaggaggttggatcagataaggtgatgtctcttatggagtttgagagcctgcttggcctctcccgatctgttcaaaaattgctacggagaggatgtggtaatagttctgcaagagaaacaaaaggtgctaagaaaaaggatgtcaaaagcttatggaagacattcatgacaaatagaagttttggcggcatgtgcaagtatgacgtccatgtaaaaaacagcacaacagctgtaccaaccagaacaagagttcaacatcggaagaaaaattttcttgaattctctgctgtctacatggatcaagaaatcaaagctcacaagggttcaattagggtcatgaaattcagcccatctggcttgtatttagcaagcggtggtgaggattgtgttgtacgaatatggcaaatcatagaagtagaagcatctcctaagttgtataagggagaggatccctatgaaaagttggagaaagtccaagtctttaagacaaatataggaaaggggcagaatcatggacttgcagtcatacccaagaaggcttttcgaatttcagagactccattacatgaatttcatggacatacaagcgatatcctcgacatgacatggtcaaaatcagaatatctcttgacttcgtctaaagataagacagtgcgcttgtggaaacctggctgtgatggttgtcttgcagttttcaaacacaaagactatgtgacatgtgtccaattcaaccctattgatgagagatacttcatcagcggttcattagatggtaaagtgcgcatttgggatgtgttggaaaggcgagtaactgactgggctgatacacggaatatcataactgctttgagttaccaaccagatggaaagggtttcattgttggcacgattgcaggagcatgccgcttctacaatcaatcaggtgaaaacatccaactagagagagaattatttgtgcaagggaagaaaaagtcagcttccagtcgaatcaacagtctgaagctatgtacaagtgattccaataggattataatcgcatcagccgattctaaaattcgagtcgccgatggagataccatcaaaaaatttgaagggccatgcaagtcgaaggctctatcatcaccgtctctaacttccgacggcagataccttatctctgccggcaaggactccaatgtctacatctggaactatgccaactccggagatgccaaatcaattcactcttgcgagctgttcttctccaaggacttgaccaccgctgtgccatggcctagtgtgcaccaggacaggcacaccaagcctccctgcctggccgagaaatcctccagcgcgcccgctctgcgccggcacggggagtcccggtcccccgggccgtggcccttcgccgacggcaccaaggggtcggcgacatggccggaggagaagctgccctccgccgcgaagcccgagagcggcccgcagctgggcgcctgcctctccgcgatctccgccgcgtggagcacggtcatcgtgaccgccagccgcgacggcgtgatccggtcttttcccaactacggcctgcccgtgagactctgataactccagtcagcggagcgcagccgtggttggtgactgataaccccgctactaacaccttgcattcttttcttttttcgtcagagtacctagaaattcttctttttttttgtaacatttgttcagatcgtgaacttcttacgaggaagagacgatctgttgtcggtccaagtgcaaacgcttgtgctgcttcccctaatctttttgctgaatggtctgttaagtgaacagtaagaaaagagtcattcagttattacctgg

SEQ ID NO: 27651 - protein, 670 aa, Panicum virgatum
  misc_feature: Ceres CLONE 1878266
  misc_feature (330)..(367): Pfam Name: WD40 Pfam Description: WD domain, G-beta repeat
  misc_feature (371)..(409): Pfam Name: WD40 Pfam Description: WD domain, G-beta repeat
  misc_feature (242)..(280): Pfam Name: WD40 Pfam Description: WD domain, G-beta repeat
  misc_feature: SWISSPROT Homolog: EC 2.3.1.48 Histone acetyltransferase
MPRSESDSDDIFFDAFENVRSPREPSSPEDCSTSDDVSVPRKFEYEIWANEPMSVQERRQRFLKGMGLDEFVSTRMDSFQCHEEITAVESFTDTEERTLSGHSSLDSSVCDNELEFDGACCIRDMDSGKKYVVHNGAHSSITNMLKEVGSDKVMSLMEFESLLGLSRSVQKLLRRGCGNSSARETKGAKKKDVKSLWKTFMTNRSFGGMCKYDVHVKNSTTAVPTRTRVQHRKKNFLEFSAVYMDQEIKAHKGSIRVMKFSPSGLYLASGGEDCVVRIWQIIEVEASPKLYKGEDPYEKLEKVQVFKTNIGKGQNHGLAVIPKKAFRISETPLHEFHGHTSDILDMTWSKSEYLLTSSKDKTVRLWKPGCDGCLAVFKHKDYVTCVQFNPIDERYFISGSLDGKVRIWDVLERRVTDWADTRNIITALSYQPDGKGFIVGTIAGACRFYNQSGENIQLERELFVQGKKKSASSRINSLKLCTSDSNRIIIASADSKIRVADGDTIKKFEGPCKSKALSSPSLTSDGRYLISAGKDSNVYIWNYANSGDAKSIHSCELFFSKDLTTAVPWPSVHQDRHTKPPCLAEKSSSAPALRRHGESRSPGPWPFADGTKGSATWPEEKLPSAAKPESGPQLGACLSAISAAWSTVIVTASRDGVIRSFPNYGLPVRL

SEQ ID NO: 27652 - DNA, 733 bp, Panicum virgatum
  misc_feature: Ceres CLONE 1878276
  misc_feature: Encodes the peptide sequence at SEQ ID NO. 27653
aaatcgatcggagcagcagaacagcagccacaccactcgagcaagcaagcaatccttgtgacatcgtaccacaggccacaagccgtgcactgttccagatggcgaccatggtgatggcttccgccgcgagctctctcgccttcgccgcaaccggcgcgcgcgccggccacttccccgcccgggttccggcggccgggctcgcgccgcgccggcgcgcaccgctcgtcagggcgcaggctaataagggtcctgagaccaagcgcgcggagagcccggggatctgggacgcgctggcgttcagcgggcccgcgccggagcggatcaacgggcgcctcgccatggtgggcttcgtgtccgcgctcgccgtcgaggcggcccgcggggacggcctcctcgcgcagctcggcaacggcgccgggctcgcgtggttcgcgtacaccgccgtcgtgctgtccgcggcgtcgctggcgccgctgctccagggggagagcgccgaggacaggagcggcggcttcatgaccgccgacgccgagctctggaacggccgcctcgccatgctcgggctcgtcgcgctcgccgccaccgagtacctcaccggcgcgcccttggtcaacgtgtagatacggcgtacattacgtacgcatacgtgtagctgtatgtgtagaggaggtagtgtatatacgtgtgtatatgtatgtacggccgggggacttagtgagctgagctgctcggc

SEQ ID NO: 27653 - protein, 173 aa, Panicum virgatum
  misc_feature: Ceres CLONE 1878276
  misc_feature: SWISSPROT Homolog: EC 4.99.1.1 Ferrochelatase
MATMVMASAASSLAFAATGARAGHFPARVPAAGLAPRRRAPLVRAQANKGPETKRAESPGIWDALAFSGPAPERINGRLAMVGFVSALAVEAARGDGLLAQLGNGAGLAWFAYTAVVLSAASLAPLLQGESAEDRSGGFMTADAELWNGRLAMLGLVALAATEYLTGAPLVNV

SEQ ID NO: 27654 - DNA, 2248 bp, Panicum virgatum
  misc_feature: Ceres CLONE 1878321
  misc_feature: Encodes the peptide sequence at SEQ ID NO. 27655
atcacatgcacgcggcctctcccctgcatctgcatgcctcttttagccgcaatcctcgtctcccaatttttcccctttctgcactctgcgcgctgaattcctcgtgcaacaacggcaatggcaacaagagcagcgactccctgagcagctagcggcgagggtgcaggcgtgaagaagcatggccgggggcagattgcggctgcacgtcgcatccttccgttcagattcgccgccattgctgcgttcttgagctgatcaggaggaggaggaggaggaaagcatgaggagaggccagcgcggcggagcccaatgctctccctgaagctgagggccatccttttccccttccagatggagccccggcgcgaggagctgctgcatgagctcggggagatgtgggacgagatcggggaaggggaggaggaccgccgggggatgctgcaaacgctggaggaggagtgcctcaacgtctaccgcgccaaggtcgagcaggtgcggcagcacagggcgcagctcaagcgggagatcgccgactccgtcgccgaggtcgccgccatctgcgccaccatcggcgagccgccggccaccgtgcagacggcctgttcctcgctgcagggcacggggagcctcaaggaggagctgggttcgatcgcgccggagctggcggagatgaggcgccggcgggaggagaggcggcggcagttctcggacgtgacggagcgggtgaacaggatccaccaggagatgaacccgggcggcggccagcctcgtgtcgtcgccgacagctccgacctgacgctgaccaagctcgaagagctcagggcgtacctgcagcacctgcaatcggagaaggaaagtcgcaccaggaaggtggcagagctcatggcctcgctgcattcttcgtccttggttctcggcacgaatcccagagagatcattcatggcggcgatcaagccggccacttcagcgacgccgcgatcgagaggctggcgtcggagatcgaggggctgagagagatcaaacggagccgaatggagaagctgcaagacctgctggccagcatgctggagctgtggaacctgatggacacgccggcggaggagcagcggcggttccagggcgtggtctgcaacatcgccgcctccgaggacgagatcacggagcccaacgcgctctccatggacttcatacgcaacgtggaggcggaggtggtgaggctcgaggccctcaaggagtgccggatgaaggacctcgtcgtcaagaagtacgatgagctcaaggagatccgccggcgcgcgcgcctgctggaggaggacgacggcgacgccgtggcgatgttcgacgccatcgacagcgatgctgagcgagccctgatcctggagcggctggaggtgcagatctcggaggccaaggatctggagttcagcaggaaggacgtcctcgagaggatggacaagtggcaggcggcgctggaggaggagtcctggctcgaggagtacaacagaaacgagaacaggtacaatgtgggaaaagggacgcatctggtgctgaagcgcgccgagaaagcgcgcgcgttggtcagcaagatgccggcaatggcggaagctctgacggcgaaggttgttgcttgggagaaggagagaggcgtcaagttcgagtacgatggtgaggcgctgctggacatgctggaggagtacagcaacgcgaggaaggagaaggagcaggagcggaagaggcagcgggaccagaggcggctgcagggcgcggcgccggagcgggacgcgtcgccggtggccgcccggccgccgcccaagaacatcaagaacgtgacgaggacgctgtccatgggcggcagcgcaaggaaggcggcgtcgtcgtcgaggccgggcacgccgagcttcctcaagtcgcccatgtccgcgcggcggggcggcagcgacgagggccagatgatggcgtccgactccttcgagtgagtggttggctctagcggtctctgatctgtctgcccgagggtcattaggagagaagagctcagctctggccatggccgtgagctgaattcagctgcatctcgatcgacatcttcctcctgaatccttagtagagtagattctaagtgttttctacacggcttcttagagattatgtagagcagcatgttcttttgttactaggatgtacagaatcactgcgatgttatttctgcaacaaaaaaccgaatgaacaacacagagtacgaatcac

SEQ ID NO: 27655 - protein, 555 aa, Panicum virgatum
  misc_feature: Ceres CLONE 1878321
  misc_feature (39)..(553): Pfam Name: MAP65_ASE1 Pfam Description: Microtubule associated protein (MAP65/ASE1 family)
MLSLKLRAILFPFQMEPRREELLHELGEMWDEIGEGEEDRRGMLQTLEEECLNVYRAKVEQVRQHRAQLKREIADSVAEVAAICATIGEPPATVQTACSSLQGTGSLKEELGSIAPELAEMRRRREERRRQFSDVTERVNRIHQEMNPGGGQPRVVADSSDLTLTKLEELRAYLQHLQSEKESRTRKVAELMASLHSSSLVLGTNPREIIHGGDQAGHFSDAAIERLASEIEGLREIKRSRMEKLQDLLASMLELWNLMDTPAEEQRRFQGVVCNIAASEDEITEPNALSMDFIRNVEAEVVRLEALKECRMKDLVVKKYDELKEIRRRARLLEEDDGDAVAMFDAIDSDAERALILERLEVQISEAKDLEFSRKDVLERMDKWQAALEEESWLEEYNRNENRYNVGKGTHLVLKRAEKARALVSKMPAMAEALTAKVVAWEKERGVKFEYDGEALLDMLEEYSNARKEKEQERKRQRDQRRLQGAAPERDASPVAARPPPKNIKNVTRTLSMGGSARKAASSSRPGTPSFLKSPMSARRGGSDEGQMMASDSFE

SEQ ID NO: 27656 - DNA, 587 bp, Panicum virgatum
  misc_feature: Ceres CLONE 1878334
  misc_feature: Encodes the peptide sequence at SEQ ID NO. 27657
ctcctccgccgtctcctctctcctttccccatcctgcgccgacgtcgcggtcgcctcgcagtccgaacagccccctactccgatggccagccgctgggtcggacccgaggtgtacccgctggtcgcggcgatgggcgtggccctcggcgtctgtggatttctgctcttccggaacatccccggcaaccgggatgtcagggtgtgcgaggcacggacggcccctggtgtgcttgagaatcatgacgaggggaggccttcccccatgctgctgctccgaacgctttgtagctgacaagacccctgaaataatgccgtccatcggcacgttcttcactgatgcgaaatgaaccgatttgctcgggtgctgctgctggactctctattgtctagttcctcttcaggcattcgctgttctgtcttccctaaattggaggacagcacatacatcttattaaaggtaccttatgaatgattggtgatggcttggcatgtgtatggtttatgagcgttgcatcacctcctgtgagatagtaattgctcttctgtcatgtggatgtgctgtgcctccaagaactaaatcaaaacgc

SEQ ID NO: 27657 - protein, 69 aa, Panicum virgatum
  misc_feature: Ceres CLONE 1878334
  misc_feature (2)..(62): Pfam Name: B12D Pfam Description: B12D protein
MASRWVGPEVYPLVAAMGVALGVCGFLLFRNIPGNRDVRVCEARTAPGVLENHDEGRPSPMLLLRTLCS

SEQ ID NO: 27658 - DNA, 2158 bp, Panicum virgatum
  misc_feature: Ceres CLONE 1878339
  misc_feature: Encodes the peptide sequence at SEQ ID NO. 27659
gttgcctctgtaagtactgactgctacctccactcccgggcctcgcttttgttgccgcaaatctttgttggccgccgccgccgccgctatctatacactgcaccttccatttctgatttctcctcggctcagctctcactctgaatagttaatagtcttctccatccagcctcgcagctcaatcccttgttgcgtttgctggattgcagcgtgtgtttggtttggacactggagctcgtgcttcgatctggccgagctcctctgggactgggacaccaattagccagtagatctggtgctgccactgccatctccccgaccgagacctcggccgtggcaagaaaatgcccgcggaatgagagggacaggccccgggagtggagcagcccgaaatagccattcgagcgcgtgcggaagaggagggaaggtgacagcttgggcaggcagtagataggtagaggagagctcgagctgagctgagctgagctgaggagaggccggcgtcggcatggactgggatctcaaggcgccgggcgcgtgggacctcgcggagctggagcaagaccacgcgggcggcgcggcggcggcggcagcgggagcggcggggacgtccggcgggcacggcaatgcggccgcctcggcgtaccgcccgcccggggcgcccgagtgctcggtcgacctgaagcttggcgggctgggcgagtgcgagctcggagcggggccggcacgcaggcagcccgccgccgcggcggggaaggcccccgcccccgcagcctccggggcggtggcggcggcaggcccgtcgtcgcccgggcccggcgcgccggcgaagcgggcgcgcccggctggcggcggcggcgggcagcagcagcagcagcagtacccgtcgtgcgcggtggaggggtgtacggcggacctgagcaagtgccgcgactaccaccggcggcacaaggtgtgcgaggcgcactccaagacgcccgtcgtcgtcgtcgccggccgcgagatgcgcttctgccagcagtgcagcaggtttcacttacttgcggagttcgatgacaccaagcgcagctgcaggaagcggctagatgggcacaatcgccgccgcaggaagccacaaccagataccatggcttctgcaagcttcatcgcgagtcaacaagggacacgattttcaccatttgccgctccaagacttgatgcgaactggccgggtgtaatcaaaaccgaggagagcccatattacgctcaccaaatccctctgggcaccagcaacaggcataatttcgtcggctcgtcgtctgcttacgccaaagaaggccgccgcttccctttcctgcaggagggcgagataaacttcgccaccggcgtggtgctggaggctccggcttcagcgcgccagccggtcctcaagacggcagcacctcccgagagcagcagcggcagcaccggcggcaagatgttctccgacgggctgacccgcgtgctcgactcggattgtgctctctctcttctgtcagctccggctaactcctccagcatcgacgtcagcaggatggtcccgactgaacacgtccccatggcgcagcccgtggtgtcggggctgcagttcggcagcccgtcgtggttctcgcgcccccaggccgccgccgccgccgcggccacggccgggttcccctcatgccccgtggtggagggcgggcagcagctgaacaccgtgctgagctccaacgacaacgagatgaactacagcgggatgttccacgtcggcggcagcgacggcgggggcgagggctcctcggacggcacctcttcgtcgctgcccttctcgtggcagtagttatcacttccttcccagcggctgttcttgcgtgcttccgatctggtagagcaattcgcttcagcgaatgatcactgatcagcactggttttctgtcttttctgcatccattttatttttctcgaatcgattctactccccagcattcgtgtggacatcctgagcataattcggtgctcgttttcctgaaattgtcttagctgttgtagtgcctgccgactgctgaccgcagtgttgcttctgttcctgagacgaaggccgcacctgtcatcgtcgtgcctgatgctttcagtttcagagtttcagtttcaggctttcgtt

SEQ ID NO: 27659 - protein, 442 aa, Panicum virgatum
  misc_feature: Ceres CLONE 1878339
  misc_feature (127)..(205): Pfam Name: SBP Pfam Description: SBP domain
  misc_feature: Functional homolog of the protein sequence given in SEQ ID NO 50782
  misc_feature: Useful for making plants with altered terpenoid content
  misc_feature: Useful for making plants with modulated flowering time
  misc_feature: Functional homolog of the protein sequence given in SEQ ID NO 50802
  misc_feature: Useful for making plants with altered lignin content
MDWDLKAPGAWDLAELEQDHAGGAAAAAAGAAGTSGGHGNAAASAYRPPGAPECSVDLKLGGLGECELGAGPARRQPAAAAGKAPAPAASGAVAAAGPSSPGPGAPAKRARPAGGGGGQQQQQQYPSCAVEGCTADLSKCRDYHRRHKVCEAHSKTPVVVVAGREMRFCQQCSRFHLLAEFDDTKRSCRKRLDGHNRRRRKPQPDTMASASFIASQQGTRFSPFAAPRLDANWPGVIKTEESPYYAHQIPLGTSNRHNFVGSSSAYAKEGRRFPFLQEGEINFATGVVLEAPASARQPVLKTAAPPESSSGSTGGKMFSDGLTRVLDSDCALSLLSAPANSSSIDVSRMVPTEHVPMAQPVVSGLQFGSPSWFSRPQAAAAAAATAGFPSCPVVEGGQQLNTVLSSNDNEMNYSGMFHVGGSDGGGEGSSDGTSSSLPFSWQ

SEQ ID NO: 27660 - DNA, 1949 bp, Panicum virgatum
  misc_feature: Ceres CLONE 1878357
  misc_feature: Encodes the peptide sequence at SEQ ID NO. 27661
acgaaaactcgatcgagcgggccagaggccggcgcgcgcgtggcccacacgtcggcgccccggcggtgcgcgtggcctccgcccgccacgcctcccccaaccacggtccacctcactgcgcagctgacaccccacgcccacgcccccgaaattaagaagggaactccggaatcgctcgaggtggtggggcgagctcgcgcgaggaggaggtggggcgagaagcttctggtggtggtcgcggtggcggtggtgctgaccctcgccgtcgaagcgggcggggagagagagaggagcggggatcgcgcggcggaaggcgggggaggcggtggatggcggtggagtaccactgctgctcggcgcccttcttcgagcacatcgtcatcatcgtcgtgctcgtgctcttcgcgggcctcatgtcgggcctcaccctcggcctcatgtccctcagcctcgtcgacctcgaggtcctcgccaagtccggcaccgaccaggaccgcaagcacgcagctaagattttgcctgttgtgaagaaccagcaccttctgctatgcactcttctgatctgcaatgctgcagccatggaggctttgcccatatttcttgatagcttggtgactgcttggggtgcgattttgatctcagtgacactgattctactgtttggtgagatcttaccgcagtccatctgctcacattatgggctggctattggtgcttcagttgctccattagttcgtgtgcttgtttggatctgctttcctgttgcctatcctataagcaagctactagactgtgtgctgggtcatggtcaaacagctctcttccgtagagctgagctaaaaacacttgtcactctgcatggaaatgaggctggtaaaggtggagagttaacccatgatgaaactaccataattgctggagctcttgaactcacagaaaagaaggctaaagatgctatgacaccattatgtcaaacctttgcaattgatataaatgcaaagcttgacagagaactgttgcaagaggtcctcgagaaagggcatagcagagtgccagtttattatgaaaagaagacgaatatcattggattgatattggtgaagaacttactatcagtcaacgctgatcatgaggttcctataaaaagtgtaactatccgcaaaattcctcgtgtttttgaagatatgcccctctatgacatcctaaatgagtttcagaaaggccacagccccatggcagtggtcataaggaaaaacgttcccattgaatcagctgaacaacctgccaatgatggaggaacttttgaggtgtccattgctattgatgaaaagaacaacgaaaaagtcgtgaagaacctcccgccaccgctgcgaagatggaagagctaccctaacactcagaacacatcaaatagaggaagcaggcctaaaaaatggtccaaagatcaatcagatgtcctgcagatacatgaagagcccctgcccacattgagcgaagatgaagaggctgtcggtatcataaccatggaggatgtcattgaggagcttctgcaggaggagatatatgacgagacagacgtacatgaggagcaatgacactggcttcacggcccgtgtttatagttccctactggatacatgagaaggagctgttagaaaagtgcatcatacgtaatatatgtactgtatgtcgataggtagatagttcattgtagtaccaggtggctgtcataggatatctttttggcaagaatactgtttggactttggaggtgcttcggtctcaggaccgcaggattgcccaggtccggaaattgtgccggatataccccggtaagaaacggaccgcaaactgtaacgagcatcctggtggtaagaaacggaagcgtttgacggatccgttcggttcagaaaccccaataagatttcagtttctttacggtgtctcac

SEQ ID NO: 27661 - protein, 421 aa, Panicum virgatum
  misc_feature: Ceres CLONE 1878357
  misc_feature (210)..(318): Pfam Name: CBS Pfam Description: CBS domain pair
MAVEYHCCSAPFFEHIVIIVVLVLFAGLMSGLTLGLMSLSLVDLEVLAKSGTDQDRKHAAKILPVVKNQHLLLCTLLICNAAAMEALPIFLDSLVTAWGAILISVTLILLFGEILPQSICSHYGLAIGASVAPLVRVLVWICFPVAYPISKLLDCVLGHGQTALFRRAELKTLVTLHGNEAGKGGELTHDETTIIAGALELTEKKAKDAMTPLCQTFAIDINAKLDRELLQEVLEKGHSRVPVYYEKKTNIIGLILVKNLLSVNADHEVPIKSVTIRKIPRVFEDMPLYDILNEFQKGHSPMAVVIRKNVPIESAEQPANDGGTFEVSIAIDEKNNEKVVKNLPPPLRRWKSYPNTQNTSNRGSRPKKWSKDQSDVLQIHEEPLPTLSEDEEAVGIITMEDVIEELLQEEIYDETDVHEEQ

SEQ ID NO: 27662 - DNA, 695 bp, Panicum virgatum
  misc_feature: Ceres CLONE 1878370
  misc_feature: Encodes the peptide sequence at SEQ ID NO. 27663
aggagcgccatggtggaagctcatgccacgccggcgacgccgttctccccactgacagggctccacaagtacatcgcgatcttcctcgtcatcctctcatggatcctggtccacaagtggagcctgaggaagcagaaaggcccaagatcatggccggtgattggcgcgacggtggagcagctgaggaactaccacaggatgcacgactggcttgtcgagtacctgtcgaagaacaggacggtgaccgtcgacatgcccttcacttcctacacctacatcgcggacccggtgaatgttgagcatgtcctcaagaccaacttcaccaattaccccaagggagacgtgtacagatcctacatggatgtgctgctcggcgacggcatattcaacgccgacggcgagttgtggaggaagcagaggaagacggcgagcttcgagtttgcctccaagaacctgagagatttcagcgccatcgtgttcagagaatactcactgaagctgtcaggcatactgagccaagcatccaagacaggcaaagttgtggacatgcaggaactgtacatgaggatgacgctggactcgatctgcaaggttgggttcggggttgagatcggcacgctgtcgccagatctccccgagaacagcttcgcccaggcgtttgacgccgccaacatcatcgtcacgctgcgcttcat

SEQ ID NO: 27663 - protein, 228 aa, Panicum virgatum
  misc_feature: Ceres CLONE 1878370
  misc_feature: SWISSPROT Homolog: EC 5.3.99.5 Thromboxane-A synthase
MVEAHATPATPFSPLTGLHKYIAIFLVILSWILVHKWSLRKQKGPRSWPVIGATVEQLRNYHRMHDWLVEYLSKNRTVTVDMPFTSYTYIADPVNVEHVLKTNFTNYPKGDVYRSYMDVLLGDGIFNADGELWRKQRKTASFEFASKNLRDFSAIVFREYSLKLSGILSQASKTGKVVDMQELYMRMTLDSICKVGFGVEIGTLSPDLPENSFAQAFDAANIIVTLRF

SEQ ID NO: 27664 - DNA, 3409 bp, Panicum virgatum
  misc_feature: Ceres CLONE 1878389
  misc_feature: Encodes the peptide sequence at SEQ ID NO. 27665
gaggtggaagcgtgcggcgcgggcactgcggcggggtactcgccaaaactactcgggcagggcttgcggcgtcgcggccgcgcggacgtagcggcggtggctggtgcagtggttcccgtgcttctcgtgagcaggcctgccctttggggtccggcgcgatcacgaaaatcaaggttgcacgaaaaacctgtttggcccggttgatcctgcgcatgcaacttggcatccatcagattttacggcatagagctgctgtcatggccgtcgccttggacgtccactcctgcatccagctcctccgctcgtgcagcgccgccgccggccggcagctccaccagctcctcctcaagtccggccacgtcccctcctccctcccgcccaccaactccgtcctcctcatgtacgcgcgcagctccccattccactcccgcgacgcgcacctcctcttcgacgaaatgcccacgaggaactgcttctcctaccactccctcatcaccgccctctttaaatcgggagacctccacggggctctccgtgtgttccgctccatgcccgacaggaacaccttctcctggaacgcggtgattaccggcttcaccgcggctggggatcttgacacggcccgtaacctgctggacgagatgcccgtgaaggacgccgtggcatgccacgctgtcttgcacaaatatgtccggtgtggccgggtggacgaggcatttgctttaatcaagaggattggtccccggtgcaatgctgaaatgatctcctcaccctggaatgaccccttcgttcttactacagttgttggcgcttgtgctgaccgggtgaagtatgattttgggaggcaagctcatgctcgaatggtggttgccaagatcaaaattgattcggtattgggttgcacattgattgacatgtactgcaagtgtggggatttggactctgctcgctgcgtccatgatggattagaacatgttgatgaattctcactgtctgctctggtccatggctacactgcttgtggacagttgcatgaggcgttatgcctttttgacaaggtggagaaccccagcgttgcactatggaattctcttatcagtggttgtgtgcctgcttaccatggagattgggcttttgttcttttcgtaaggatgttgcggtcaggcatgttgcctaattcttcaacctatgtcagtgttctgaatatgtgtgggtttttaggcatgctgaagcctgggcagcagacacatgggtgtgctttaaagggtggggctgtcaatgacttgctagcagcaagctctctcattgacttctactcaaaatgcagcctctgggcagatgcctgccaagcttttagtgagcttaggcattatgacaccattgtgctcaattcaatgatcactgtatactcgaactgtggacagacagatgaggctagaagagtttttaataagatccctagcaagagtgtcatctcatggaattctatgattgttgggttcagccaaaatgggcatgctcttgatgcaatggagctgttctgtgagatgcatcggcttggcttgcagcttgacaaggttgctgtagccagtgttctgagtgcatcaagcagcatctgctctataagttttggggagcagatttttggtcttgctattgcacttggcctgcagtctgaccatattgtagcctcctcgctcattgacctgtactgcaaatgtggcaacttggtcaatggatgcaggatcttcgatggaattgatagtccagatgaagtcttgtggaactcaatgctgataggttatgcttctaatgggtatggacaggaggcactggaacttctaaagttaatgcaaagcaggggtgtgaaaccaagtgaacggacctttattggtgtcctttctgcatgctgccattctggacttgtggaagagggtctgagatggttttaccagatgaaggaagattttggcgtgagtccatcagctgagcattatgcatgtgtgactgacctgttagtccgtgcaggtcgactggaggaagcagttgatttcatagagaacatgcctttcaaagctgatgcacttagttggacttctattattggagggtgtaaagcccagggcaatgaggctctgttgcacaaggtggcaaagaaactgatggaaacggaagtgtcaccacattccagtttgtatgtgcagctgtcaagcacacttgcagctcaaggggattgggccaagtctgcagagattaggagtatgatgcgtgacagaagaatttcaaaaaatgctggctgcagttggattgacagggcatagaggaaactgtcaatgtcatcccccacaggcatctcggtccctttttcttctaggatcttcactattgtctttggtttcttcaacgggttcttctgctaatcaggaattgtgacctactagctactcaacttttagaggaaccacgggggtccaatgacccaatcactcgttttagctccatgttaactgtagtttggagctcaacttatggcatactgaagttattatgtcttcaactggtttgtcgatccttgaaacttctccagcaaggaatccatttttactgatagtggggcatgtgacagtgacttccatgccccatggaagggctctatgcaggaatatctgtaggtccagacaacaaaataacttattggacaagcattggatgaacatgggggtggtgcatcagttcaaataatgtgcagtcatagtatcctgagaactgagagcaactcgtgaccgccaccgcagcagccacttgaccacttccacctccgcggtggcctctgccttcttggcatccaccatgggcccatgtctcctccacatcgtcttcttcctcggcatccacctcttgcattatcttggtgagaagaaccatcaactccaagatcctctctaaggccattgagtattgcaacaagcacatcacgccacctccaagttctttgagatcagccacacacttcgatctcatcatggattcatgttagaggaggaagatgtgggtgatgaattatttctgttattgtccatctgaaagaagaaaaaccacattgctcaatcatcccttccggacaaacttcagagtgatatttttcactcgaggtattctgttccagggcaatttcagtttcctttttgagatctcaaggaccaaacttactgaaaaggattagcttggtcagatattagattattcttcaatttaacttttgcaagaattagattcttgggagatttgaatatttttgtagattttagctatttatctcacaatgtttatacaggtcatgtaactgaggttttcttcttgcatgacgtgcattttctggttatttattgatcttttctatggtttgatc

SEQ ID NO: 27665 - protein, 687 aa, Panicum virgatum
  misc_feature: Ceres CLONE 1878389
  misc_feature (507)..(541): Pfam Name: PPR Pfam Description: PPR repeat
  misc_feature (406)..(440): Pfam Name: PPR Pfam Description: PPR repeat
  misc_feature (104)..(138): Pfam Name: PPR Pfam Description: PPR repeat
MAVALDVHSCIQLLRSCSAAAGRQLHQLLLKSGHVPSSLPPTNSVLLMYARSSPFHSRDAHLLFDEMPTRNCFSYHSLITALFKSGDLHGALRVFRSMPDRNTFSWNAVITGFTAAGDLDTARNLLDEMPVKDAVACHAVLHKYVRCGRVDEAFALIKRIGPRCNAEMISSPWNDPFVLTTVVGACADRVKYDFGRQAHARMVVAKIKIDSVLGCTLIDMYCKCGDLDSARCVHDGLEHVDEFSLSALVHGYTACGQLHEALCLFDKVENPSVALWNSLISGCVPAYHGDWAFVLFVRMLRSGMLPNSSTYVSVLNMCGFLGMLKPGQQTHGCALKGGAVNDLLAASSLIDFYSKCSLWADACQAFSELRHYDTIVLNSMITVYSNCGQTDEARRVFNKIPSKSVISWNSMIVGFSQNGHALDAMELFCEMHRLGLQLDKVAVASVLSASSSICSISFGEQIFGLAIALGLQSDHIVASSLIDLYCKCGNLVNGCRIFDGIDSPDEVLWNSMLIGYASNGYGQEALELLKLMQSRGVKPSERTFIGVLSACCHSGLVEEGLRWFYQMKEDFGVSPSAEHYACVTDLLVRAGRLEEAVDFIENMPFKADALSWTSIIGGCKAQGNEALLHKVAKKLMETEVSPHSSLYVQLSSTLAAQGDWAKSAEIRSMMRDRRISKNAGCSWIDRA

SEQ ID NO: 27666 - DNA, 678 bp, Panicum virgatum
  misc_feature: Ceres CLONE 1878393
  misc_feature: Encodes the peptide sequence at SEQ ID NO. 27667
tgcgatgtcacgatcaattggtgacagatatctgaagccatggataattccagtcccagaggtaacaatagtacctcgggcgaaggatgatgaatgtcttgttcttgccagcgatggcctctgggacgtaatgtcaaatgaagaggtatgtgatgttgcccgcaagcggatacttctgtggcacaagaagaatggcacaagctcatcatcagccccacgggtcggtgattccgcagacccagcggctcaagcggccgctgaatgcttgtcgaagcttgctcttcagaaggggagcaaagacaacatcaccgttgttgtggttgacctgaaagcacatcgtaagttcaagagcaaaacctaacccaggatggctcgatgaacaactgcagcgacaagttgttaggaacctatagatttggagaatccaaattcgtcagttttagtccgcagtacattacttagcccagttctttttttctcagttctttttaaagccatctgggctgccaagggctgtatcccacgtatatggtaccgattgcgaccatcagggtttatgcttcctggtcgcggtgatggtcctattttccattcttcttacttcgttgccctgtattctttttgtcaagctgggcgtccatgtatctggcaatgtatatttgagcttgtagggtgcaa

SEQ ID NO: 27667 - protein, 119 aa, Panicum virgatum
  misc_feature: Ceres CLONE 1878393
  misc_feature: SWISSPROT Homolog: EC 3.1.3.16 Phosphoprotein phosphatase
  misc_feature: Functional homolog of the protein sequence given in SEQ ID NO 51250
  misc_feature: Useful for making plants with modulated drought sensitivity
AMSRSIGDRYLKPWIIPVPEVTIVPRAKDDECLVLASDGLWDVMSNEEVCDVARKRILLWHKKNGTSSSSAPRVGDSADPAAQAAAECLSKLALQKGSKDNITVVVVDLKAHRKFKSKT

SEQ ID NO: 27668 - DNA, 710 bp, Panicum virgatum
  misc_feature: Ceres CLONE 1878404
  misc_feature: Encodes the peptide sequence at SEQ ID NO. 27669
aaaatcacaataaggtgctaccggggcagggtggtgggggtcttcctcgacggcgcgtcgctggccggcgccgtggcgccgctcctgcggctcggccagatcagggcgctcgccgtcaggaacaactccctgtccggctcccttcccccgctggacaacgccacggcgagcccgtggctgcggcacctgctcgtctcccgcaaccagctcaccgggagcctcaacatctcgttgggtgctctggtcacgctcagagcggagcacaacggcttccggggaggcctcgaggcgctgcgcgctccgatgctcaggagcttcaacgtgtctggggaacaggctcgccggggggatctccggcgacctgtccgggttcccgagctcgtctttcggtgacaatctcgcgctctgcggcacgcctctgccaagatgtgctcgtgcttacaatgcgttaggatcagatagttcctcttcgaatgctaccactagtattgatgctcagtctcctatcggtggagtctcttccagcaatggaggtttcagtaagaatagcttgactgctctcatgaccaccggcattggcaacgcggtgctcatcacggtctcgctaggcatctctgtggccatgttcgtctacatgaggaggaagctccgggccgcgaaggatgcttccgacgcggcattgtgtctcgcggaggaagaccagaggaaca

SEQ ID NO: 27669 - protein, 130 aa, Panicum virgatum
  misc_feature: Ceres CLONE 1878404
  misc_feature: SWISSPROT Homolog: EC 2.7.11.1 Non-specific serine/threonine protein kinase
KITIRCYRGRVVGVFLDGASLAGAVAPLLRLGQIRALAVRNNSLSGSLPPLDNATASPWLRHLLVSRNQLTGSLNISLGALVTLRAEHNGFRGGLEALRAPMLRSFNVSGEQARRGDLRRPVRVPELVFR

SEQ ID NO: 27670 - DNA, 745 bp, Panicum virgatum
  misc_feature: Ceres CLONE 1878409
  misc_feature: Encodes the peptide sequence at SEQ ID NO. 27671
aagcctttcttccccgcaaagaaagaaacgagcagcagcagcggaacgaggcagaagcagcagcggaacgagagagaagcagcagcagcgacgatggcgagcggcggcatgaagagggagatcagcgagacccacgacgccctccgcttcggcatcaacgccggcgtcaaggccgacctcgcgccgccgcatcctctccagtccaccatccaatcggaggccaagttctgggcggacaagaagaggttcgggacggaggctatctacggatccgccttcaacatccgcaaggatctcgatgcccaaatcctctccaggttccaaaggccccctggtgctttgccatcatctatgcttggatatgaggcactgacaggttccttggatgattttggatttgaagattatcttaacatgcctcaagattctgacaatttccgtcaacctgacatgcaccatggaatggaagttcgccttggcttgtccaagggacctatctgccctagcttcaattgatccatccatgtagttctgcagtacgttgtgcaccacacagtccagtacatcggtcaatagaccatattatcatggtgaaaagtgaaaaccgatgagccttgccacctgttcagtgttcagtgtaatgtttcagtcaacgccgaatttagttcttatcctatttgatcttacatttgatggttggtctgcctctgtgaatctacgtgtttcggcttggtgacaaaatttc

SEQ ID NO: 27671 - protein, 140 aa, Panicum virgatum
  misc_feature: Ceres CLONE 1878409
  misc_feature (2)..(131): Pfam Name: UMP1 Pfam Description: Proteasome maturation factor UMP1
MASGGMKREISETHDALRFGINAGVKADLAPPHPLQSTIQSEAKFWADKKRFGTEAIYGSAFNIRKDLDAQILSRFQRPPGALPSSMLGYEALTGSLDDFGFEDYLNMPQDSDNFRQPDMHHGMEVRLGLSKGPICPSFN

SEQ ID NO: 27672 - DNA, 689 bp, Panicum virgatum
  misc_feature: Ceres CLONE 1878411
  misc_feature: Encodes the peptide sequence at SEQ ID NO. 27673
gaccgttctccgcaacacaatcgcctaaacccagtaacccacccaccccccgcacggccgcaccctacgaccccgccgcctcgccgccgcgtcaaacaacggcgcaacgcagcagcccatggctttcacctcccaatccctaatcttccgggcacccgcctccctccccagcggccgcctcgccgccccaggtcgtgtcgccgtccggggccgcggtgccgcgttcccttccgccgcggccgcctccacgccgatggcgaagtcggacggcgacgagaaggagatgaagctctggggcgggcgcttcgaggagggcgtcacggacgccgtggagcgcttcacggagtccatctcctacgactggcagctctacaagtacgacatcatgggcagcaaggctcatgccaccatgctcgcctcccagggtttgataactgctggcgatagggatatcatcttagagggtctcgatcagattgagacgttgattcaagaaggcaagtttgagtggagaaaggatcgggaggatgtgcatatgaacattgaagcagctctgattgagagggttggtgagcctgcgaagaagctgcacactgctaggagccgcaatgaccaaattgtgacggatctaaggctatggtgccgtgatgctattgacaagatcttgattcgtatcaagcagtttcagg

SEQ ID NO: 27673 - protein, 190 aa, Panicum virgatum
  misc_feature: Ceres CLONE 1878411
  misc_feature: SWISSPROT Homolog: EC 4.3.2.1 Argininosuccinate lyase
  misc_feature: Functional homolog of the protein sequence given in SEQ ID NO 50976
  misc_feature: Useful for making plants with modulated salt sensitivity
MAFTSQSLIFRAPASLPSGRLAAPGRVAVRGRGAAFPSAAAASTPMAKSDGDEKEMKLWGGRFEEGVTDAVERFTESISYDWQLYKYDIMGSKAHATMLASQGLITAGDRDIILEGLDQIETLIQEGKFEWRKDREDVHMNIEAALIERVGEPAKKLHTARSRNDQIVTDLRLWCRDAIDKILIRIKQFQ

SEQ ID NO: 27674 - DNA, 2008 bp, Panicum virgatum
  misc_feature: Ceres CLONE 1878417
  misc_feature: Encodes the peptide sequence at SEQ ID NO. 27675
acaagctgacgctacgctgctgcctataggctactactactactaccatcacgtcctccactactacgaccacctcgcctgccagttcctgcgccccactaccacgccgcccactccgatccgttcgttccctcctcccggcaggggaagcaccacggcgatggcggccgccgcccagtgacggcaccggcggcatgccggacgacgctgcctacctcctctgcgccgaggacgccgccgccgccttcttcggcgccgcggccgccggcagcagcgcctgcaccgccgggaccggcgccgacgacgggagctgctgctccgccggcgaggaggagtcggcggcctccatcgccgagctcatcggcggcgaggccgactactcgccgcggccggactaccccgaccggctccggtcgcggtccatcgacccggccgcccgggccgagtcggttgcatggattctcaaggtgcaggagtactatggattccttcccttgacagcctacctcgccgtcaactacatggaccggttcctctccctccaccgtctgccgcaggaggacgggtgggcgatggagctgctggccgtgacctgcctctccctggccgccaagatggaggagaccctcgtgccctccctcctggacctacaggtcgagggcatcagcaggtacgtcttcgagcccgggacggtcggccggatggagctgctcgtcctgaccgcgctgaattggcggctccggtccgtgacgcccttcaccttcatcgatttcttcgcctgcaaggtcgatccgggagagaggcacacgaggtgcctcattgcccgggccacacaggtcattctagctgcaatgcatgacatcgagttcctggaccactgcccatcgtcaatggccgcagcggccgtgctccgcgccaccggcgagacgccgtcgctggagtccgtcggccccgaggccgccgtccgctggtgcattggccttgcagaggatgcgatcagcagctgctacagactgatgcagcagctcgtgatcggcaacgttcggacaagagcagccagcaccaccgcagcatcggcagcgaacctgtgctgctcagacgaggtcctgtcctcgcactcctcgtcctcctcatcgcctcccccggctaagaggaggaagaggtcgccgccggggatttgaaacggaagaacgcaagtagatactagcattattttcatggggcttttttttggcagattaatagggtttgatcgatttccttgcagtttgctgttgtgttcctgcgattcttttttttttttttccttttgttctcttcttttggggttggatctttacacctctgtggggggctccgcctgctcgaccggctcagccatgattgcggcctctggcctctgcactgccagccaatctgtgtaaggtgtcgagatgaagagatggaggcatctggagagagaaaggcagcagctgcagcagacacatgtcacatttgtgtttctctgtgcaacacccagtgggtcttcttcaacccccggcgcagagctgcagaggaaccattgattggtcagcgaggaaaccatggcgattggcggcagatggagaggagtaaaacaggaggcaatgccagtgatgagatgcagggagtggtggacggtagggttaaatagggtggtcaaagagcggtcagggctcctgccaagatgcagccggtcctgcccctgcaaagttcctgttcatattcatgagggcaaaaattgtttgtttccgagtggtttgttggtattttgttgatgctactgaagtgagcttcagagggaggggggcatgctttgctgtgatgggaggcacatgcaggcgtgccctggtgtgtggtggtgctccggagggaaatatttgtccgtctccggggctaacagtgtccaagcatgaggcttttgggggcccttgctatttgttcccatttgtatctcttttttgagcatcaataaggatcttgccattcg

SEQ ID NO: 27675 - protein, 328 aa, Panicum virgatum
  misc_feature: Ceres CLONE 1878417
  misc_feature (50)..(183): Pfam Name: Cyclin_N Pfam Description: Cyclin, N-terminal domain
MPDDAAYLLCAEDAAAAFFGAAAAGSSACTAGTGADDGSCCSAGEEESAASIAELIGGEADYSPRPDYPDRLRSRSIDPAARAESVAWILKVQEYYGFLPLTAYLAVNYMDRFLSLHRLPQEDGWAMELLAVTCLSLAAKMEETLVPSLLDLQVEGISRYVFEPGTVGRMELLVLTALNWRLRSVTPFTFIDFFACKVDPGERHTRCLIARATQVILAAMHDIEFLDHCPSSMAAAAVLRATGETPSLESVGPEAAVRWCIGLAEDAISSCYRLMQQLVIGNVRTRAASTTAASAANLCCSDEVLSSHSSSSSSPPPAKRRKRSPPGI

SEQ ID NO: 27676 - DNA, 659 bp, Panicum virgatum
  misc_feature: Ceres CLONE 1878419
  misc_feature: Encodes the peptide sequence at SEQ ID NO. 27677
acacctccgatcctcacaaagcaagcaagcaaccactgctccattgccagctagccacacagtcacacacacgcagcctcgaccaagcagtcgctactggtagtgctgagccagcaggcagcaggagctgcagcagcgatggcgagagcgctggtgccggcggccatggcggccgcgacgatggtgctgctgctgctggccgcggcgccggcgccggcggccgcgatcgacttcggcgcggaggacctggcgtcggaggaggcgctgtgggcgctgtacgagcggtggcgcggcgtgcacgcggtggcgcgcgacctgggcgacaaggcccgccgcttcaacgtcttcaaggagaacgtgcgccagaagggcgccgtcaccgacgtcaaggaccagggccagtgcgggagctgctgggcgttctcgacgatcgccgccgtggaaggcatcaacgcgatcgtgaccaagaacctgacgtcgctgtcggagcagcagctggtggactgcgacaccaaggccaacgccggctgcaacggcgggctcatggactacgcgttccagtacatcgccaagcacggcggggtcgccgccgaggacgcgtacccgtaccgggcccggcaggccgcgtgcaagaaggccgccggcgccccggccgtgag

SEQ ID NO: 27677 - protein, 173 aa, Panicum virgatum
  misc_feature: Ceres CLONE 1878419
  misc_feature (75)..(172): Pfam Name: Peptidase_C1 Pfam Description: Papain family cysteine protease
  misc_feature: SWISSPROT Homolog: EC 3.4.22.6 Chymopapain
MARALVPAAMAAATMVLLLLAAAPAPAAAIDFGAEDLASEEALWALYERWRGVHAVARDLGDKARRFNVFKENVRQKGAVTDVKDQGQCGSCWAFSTIAAVEGINAIVTKNLTSLSEQQLVDCDTKANAGCNGGLMDYAFQYIAKHGGVAAEDAYPYRARQAACKKAAGAPAV

SEQ ID NO: 27678 - DNA, 725 bp, Panicum virgatum
  misc_feature: Ceres CLONE 1878427
  misc_feature: Encodes the peptide sequence at SEQ ID NO. 27679
aaaccgaagcggcagcagcagcagcagcaatggcggcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcatcgggctccttgccggcggcgccctccttgtttacaacaccagcgccctcgccagctagcaacattattcatgcatagtccatgaaagcgcttgcggccggtccatatataagatttatcatcagcccgggtgtctgtgtgtaatctagcctgcagcttcgatgcccaatataatgcttggttcatgcaacaatgctactacggctctccatacttttggaacaattaattattatattacttcatgctatatatttagattaataactggtaactttatttctctgtgccttgcattgtgagcctttgtgaagaagatgatgctgatgctacttgaatatatatgtatgtacttagtc

SEQ ID NO: 27679 - protein, 131 aa, Panicum virgatum
  misc_feature: Ceres CLONE 1878427
  misc_feature (35)..(131): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYSPIYKEEDWSPTGDVYVGGTTGLLIWSVTLIGLLAGGALLVYNTSALAS

SEQ ID NO: 27680 - DNA, 574 bp, Panicum virgatum
  misc_feature: Ceres CLONE 1878453-R
  misc_feature: Encodes the peptide sequence at SEQ ID NO. 27681
caacaggctgaggatgcactttcacaaggaatggaagcccttcaacagttccttggttgagaccctggatgggtctctttcgtcttctgggtcaacaggaaatgtggcaaactacatgggtcaaatggccatggccatgggaaagcttggaacgcttgagaatttccttcgccaggttgacaacctgcggctgcagaccctacaacagatgcaaaggatcctgaccaccagacaggcagctcgagcacttcttgtgataagcgattactcttcacgactccgtgccctgagctctctctggcttgctcggccgaaagaatagcaagcacatgcgatttgactgcggcacttttcacagtttggtgttcaatggggatcttatcaggagggtttgacagtaatgcaacagacttgattcggagatatctgcacatactataatcgggatggtcttgtagtttagccatatagttaagtgcattggttcttggttcatgctgtattattaccaactgctgtaaaaattgctctcttttgccatcattttccatatatgtatgcccctaatttgcag

SEQ ID NO: 27681 - protein, 106 aa, Panicum virgatum
  misc_feature: Ceres CLONE 1878453-R
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: Functional homolog of the protein sequence given in SEQ ID NO 50877
  misc_feature: Useful for making plants with modulated biomass
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: Functional homolog of the protein sequence given in SEQ ID NO 50990
  misc_feature: Useful for making plants with modulated flowering time
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
NRLRMHFHKEWKPFNSSLVETLDGSLSSSGSTGNVANYMGQMAMAMGKLGTLENFLRQVDNLRLQTLQQMQRILTTRQAARALLVISDYSSRLRALSSLWLARPKE

SEQ ID NO: 27682 - DNA, 656 bp, Panicum virgatum
  misc_feature: Ceres CLONE 1878453
aatctcagcgagccccccgcccttccccagttccccggcgagatcccccgcgcggatccgcttcctacagcgtggatccagcagcggctcctgctcctcgacggcgccctcttcacccggtgcggctcatctccggtggcggacggcggcaaggtcagggccgacggggaggcggcggcgctcgaggccggccgggaggcaggcgggacgacgacgcttggggccggccgggaggcaggtcaggaggcggcgacgaggggcaggcggggagacggcgcttcggaccggccgggaagcaagcgcggcggcagggtgttggggccgaccgggagggaggcggggaggcgacaacgaggggcaggtgggaaggcgaggggcaggtgggaaggaggctcttggggccggctgggaagcaggcggggcggcggcgcttgcgccggcccggaggcaagcggatcggcggtgcttgggaccagctaggaggaagggagggaggcggcggcaacgggcaagcagggaggcgagcgtgcgcgtggtgcaagcgaggagcaccaccttagttcctacgctggagctgccttgagaggaactgtgaagagctcggaagtggagcgggtaaagattcttgttcgccccgatcttctgcggcgtccact

SEQ ID NO: 27683 - DNA, 708 bp, Panicum virgatum
  misc_feature: Ceres CLONE 1878454
  misc_feature: Encodes the peptide sequence at SEQ ID NO. 27684
atctcaagcgcagcattcattcagtccttagccaattaactagccgaggagagagctcgttgatcagccgtcgagtgtctccgggcgagagctcgagagaaggcaacaatggctgcctcctacctcctcccttgctctgccctcgtcgctgtgctcgtgctgctcttctccgtcggcatggcggagggcgccattagggagtaccagttcgatgtgcaaatgacgaacgtgacgcgtctgtgtagcagcaagagcatcgtgacggtgaacgggcagttcccggggccgacggtgtttgcgagggagggcgacctcgtcgtcgtccgcgtcgtcaatcacgtcccctacaacatgagcatccactggcacggcatccggcagctgcggagcgggtgggcggacgggccggcgtacatcacgcagtgcccgatccagagcgggcagagctacgtgtacaagttcaccatcacggggcagcgcggcacgctgtggtggcacgcgcacatctcctggctccgcgccaccgtctacgggcccatcgtcatcctccccaagcccggcgtcccctacccgttcccggcgcccgacaaggaggtccccatcatgttcggcgagtggtggacggcggacacggaggcggtgatcagccaggcgctccagaccggcggaggccccaacgtctccgacgcgttcaccatcaacggcctg

SEQ ID NO: 27684 - protein, 199 aa, Panicum virgatum
  misc_feature: Ceres CLONE 1878454
  misc_feature (35)..(151): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 50392
  misc_feature: Useful for making plants with altered carbohydrate content
  misc_feature: Functional homolog of the protein sequence given in SEQ ID NO 50393
  misc_feature: Useful for making plants with altered cell wall content and/or composition
  misc_feature: Functional homolog of the protein sequence given in SEQ ID NO 50394
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MAASYLLPCSALVAVLVLLFSVGMAEGAIREYQFDVQMTNVTRLCSSKSIVTVNGQFPGPTVFAREGDLVVVRVVNHVPYNMSIHWHGIRQLRSGWADGPAYITQCPIQSGQSYVYKFTITGQRGTLWWHAHISWLRATVYGPIVILPKPGVPYPFPAPDKEVPIMFGEWWTADTEAVISQALQTGGGPNVSDAFTING

SEQ ID NO: 27685 - DNA, 2064 bp, Panicum virgatum
  misc_feature: Ceres CLONE 1878467
  misc_feature: Encodes the peptide sequence at SEQ ID NO. 27686
gtctccgtctctctcctccgcctccccttccgctccccttctctctcctcccttcctcgcttggaccttggatccgagcccaaaccctaagccccaacggtcccctccccgaccaaaccctaaaacccactacccctcttcgatttcccgcctaatcataccataccaccgcgcgctcgcgtcgaattcgaaccggccattcggagctcgaatttgaattcgagctcgaatcacccgcgccgggagcgagggcgagctgggggagctcgattcgatgcggtgctgagcgtgggtcaaccaatttgggccgggcggtggcgcggtcggcgggatctgaaccctagcggccggccggatctgagagaccgcgccggcgaggtgctcggcggtatgagtggttgggaagggcacagaggagaagcggagatatgagcggaggcggcgggagcggcaccggggacgagttcgggcgggcggtggcgcgggccgcggtggtgcaggcgctggaggccgcggggttcgactgcgcgcaccgctccgcggtggacgcggtcgttgacgtcctcctgcgctacatctcccacctgggccggtccgcggccttcaacgccaacctcgccggccgcgcgctcgccaacgagctcgacgtcatccaggcgctcgaggaggtcggctccgacacggacgggtttgcgggcgcgtccgccacggggcactgcctcgttggctccggcgtcatcagggacctcatggcgttcgtcgacaccaaggacgaggtgccgttcgtgcggccgctgcccaggttccctgtgccgcgcgtgcagccgcagccctctgccagcttcgcggtggccgggagggagaccgggatgaagcacgtgcctgagtggctcccggttttcccggatccgcacacctatgtgaggacagaggcgtgggttgagccgccggcaaccaaggaccgggtggacaaggtggaacaggtgcggcaacggaggaaggctgagaagtccctactcagcttgcagcaaaggctagcacaggctggtgctgaaggatttcatccagcagttgggctcacacaggatagcacggagaagggcaaggagatactggcagctgggaccaagagaaatccatttcttgagccagcattgccgcctggagagaaggatatatccgaggttgatatgcctcctgaaaagaagaaactctctgtccttgaggcatttgcaccagctattcaagctacagccatcagggagattgatgctgggacagggttagatcaaaaccaaaggagcatcgttccaaaagagagggcgccagtacacctcaagattggatttggtaagaagcctgtagcagctgtcccgaattcaggagccctggatctgagggatgatccttccttcttgaaggaggaagcgaaggatgacaagaagcggagagcagggatgatattaagagcatcaatggagaacccacaggaacttcctcatctctgaagtggtttatggatgaactgtggtgacagaatggaatcgcatcacagtgcgattgagtttattggagctatggatattccagattgatggtggaacttcaatttccagaatcttgaggccatgcgtccgtgatacgactttccttgtatcttaatgacatcagaagcattcttagaacattgctaacagcacccaggctctcccttccccacctaccattttcctggaatcacaaggcgctggttattctgcagcgctgcaactgaagttccaccgtttcacccccattcaacttaggttctgctggtatttcactgctaaggcgttaactgtaagtgagccacttcatacggagctgattttggaggccgtgtttcctctccccagacatggcgtccaaaataatgatgctcccgagttactttttgtagctgtattcccggggagaattgaaaagagatgtttgtacaaaagctaacctgattctcctgacctagactccaagacttgtctcagacaggattgatgtacctagtgggttactcccaagagccag

SEQ ID NO: 27686 - protein, 359 aa, Panicum virgatum
  misc_feature: Ceres CLONE 1878467
  misc_feature (11)..(87): Pfam Name: Bromo_TP Pfam Description: Bromodomain associated
MSGGGGSGTGDEFGRAVARAAVVQALEAAGFDCAHRSAVDAVVDVLLRYISHLGRSAAFNANLAGRALANELDVIQALEEVGSDTDGFAGASATGHCLVGSGVIRDLMAFVDTKDEVPFVRPLPRFPVPRVQPQPSASFAVAGRETGMKHVPEWLPVFPDPHTYVRTEAWVEPPATKDRVDKVEQVRQRRKAEKSLLSLQQRLAQAGAEGFHPAVGLTQDSTEKGKEILAAGTKRNPFLEPALPPGEKDISEVDMPPEKKKLSVLEAFAPAIQATAIREIDAGTGLDQNQRSIVPKERAPVHLKIGFGKKPVAAVPNSGALDLRDDPSFLKEEAKDDKKRRAGMILRASMENPQELPHL

SEQ ID NO: 27687 - DNA, 561 bp, Panicum virgatum
  misc_feature: Ceres CLONE 1878483
  misc_feature: Encodes the peptide sequence at SEQ ID NO. 27688
agggacgcgatcgccccaacaccaaaccgccggccccgcccccgcatcagcggcaccagcagcagcgcgagcgagcgagagaaacaagaaaagcatggcgcgccgccggagcagcaggctgctcctcgccgccgccgcgctgctcgccgtcgtcgccgcggcggaggccgcggtgccgccgacgtgcgagcgcatcgagtgccccgcgtacgaggtgatggacagcgccaacgggctcgagatcaggcggcacacggacgccgtgtgggtgtccgccgcccccatcgaggacatctccttcgtcgccgccacgcgcaccggcttcctccagctgttccagtacatccagggcaagaacgcgtacaacgagacgatcgagatgaccgcgccggtgctgacggacgtgccccccagcgacgggcctttctgcgcctcctccttcgcggccagcttctacgtgccggccaagaaccagccggacccgccgccggcggagggcctgcgcgtgcggcgctgggccggggccacgtacgccgccgtgtgccggttcgggggcttcgt

SEQ ID NO: 27688 - protein, 155 aa, Panicum virgatum
  misc_feature: Ceres CLONE 1878483
  misc_feature (33)..(155): Pfam Name: SOUL Pfam Description: SOUL heme-binding protein
MARRRSSRLLLAAAALLAVVAAAEAAVPPTCERIECPAYEVMDSANGLEIRRHTDAVWVSAAPIEDISFVAATRTGFLQLFQYIQGKNAYNETIEMTAPVLTDVPPSDGPFCASSFAASFYVPAKNQPDPPPAEGLRVRRWAGATYAAVCRFGGF

SEQ ID NO: 27689 - DNA, 1867 bp, Panicum virgatum
  misc_feature: Ceres CLONE 1878504
  misc_feature: Encodes the peptide sequence at SEQ ID NO. 27690
aatccctcgcaccgaattccctttggttcagccggaggatcctttcaggatgatgcccggatcagccgcgccggcggggggcgccgggatgttcgtcccggcggcgacggcgggcacggtcctctgctgcatgtgcggcgtggcgatgcagcccaacccggccaacatgtgcgcgcgctgcctccgcgcgcgcgtcgacatcaccgagggcgtcccgcgccacgccgccgtggtctactgccccgactgctcctcctacctccagccgccgcgctcctggctgcgcgcgaccccggagtcccccgagctcatgcagatcctgctccgccgcatcaaccgcccgctggcgcggctccgcgtctcgctctccggcgccgagttcgtcttctccgagccccactccaagcgcctccgcctcaagctccgcctccgccgagaggtgctccacggcgtcgtcctcgagcagactcaccccgtcgagttcgtcgtccacgaccgactctgcgactcctgctcccgcgcgcaggccaaccccgaccagtgggtcgccgtcgtccagctccgccagcacgtgccccaccgccgcactttcctctacctcgagcagctcctcctcaagcacggccaggcttcgcttgcgatccgcgtcgccgcggcccccggcggcctcgacttcttcttcggctcgcgctcccatgccgcccgcctggtcgacttcctcgccaccgtcgctcctatccaaactcagacagccaagcagctcgtctctcacgacaccaagagcagcgtctacaactacaagtacacattttcggtcgagatctgccccatctgccgcgaggacctcattgcgctcagcccacaggcctcccgagatatgggtggcctcggtccgctcgtcctctgtgtcaaggtcacaaatgccattgctcttcttgatcccctcacgctgcgcgttcaccacctggaggagaaaaagtacagggtgtacaacttcaaagcagctctcactagcaagcagctcgtggagtacattgtgctggacattgagcaagaatcgccagaaatttccattgatgggtctaggtatcaattggcttatgcacaggttgcccgggtgtcagattttgggaagaatgacaccatctttacagtgaggacgcatcttggccacctgctgaaccccggcgatcttgcccttgggtatgatctctatggtgcaaacctgaatgatgatgacatggacacagctatgacaaggtacagcttaccagaggtggttcttgtgaagaagagctatgagaagaggccacgcacacggcgatggaagctgaagaggttgccagtggaggaagatgctgggaacaaggccaagggtgaggaagagaggaagctagatgagtatgaggctttcctcaaggatttggagcaggacccagatttgaggtttaatataaatctgtacaagaatgaggactataggtcagagatggcatcaactgttggtgatgatgtccctacagtgccaattgaggagctgattgaggacttgacacttggtgatgatgaggaggatgaaggggatgaagctgttgcaggcaacactcaatctgcgatggcggaatgagcaaaattgtcgactactttgcttcttcattgctcagtgagaagggttggtgcttactgcaggttaaatgtctgagttgcatctgtcagttatcatatatgttattttgcttgttagtgatacaagttaaaaagtggtggtgttgcttaagttacattttgaatttcgccgtttgttcatcttgaaattatttcaacctttatcctatattgggggtatatcaatctgttttcccttgtc

SEQ ID NO: 27690 - protein, 525 aa, Panicum virgatum
  misc_feature: Ceres CLONE 1878504
  misc_feature (26)..(258): Pfam Name: NMD3 Pfam Description: NMD3 family
MMPGSAAPAGGAGMFVPAATAGTVLCCMCGVAMQPNPANMCARCLRARVDITEGVPRHAAVVYCPDCSSYLQPPRSWLRATPESPELMQILLRRINRPLARLRVSLSGAEFVFSEPHSKRLRLKLRLRREVLHGVVLEQTHPVEFVVHDRLCDSCSRAQANPDQWVAVVQLRQHVPHRRTFLYLEQLLLKHGQASLAIRVAAAPGGLDFFFGSRSHAARLVDFLATVAPIQTQTAKQLVSHDTKSSVYNYKYTFSVEICPICREDLIALSPQASRDMGGLGPLVLCVKVTNAIALLDPLTLRVHHLEEKKYRVYNFKAALTSKQLVEYIVLDIEQESPEISIDGSRYQLAYAQVARVSDFGKNDTIFTVRTHLGHLLNPGDLALGYDLYGANLNDDDMDTAMTRYSLPEVVLVKKSYEKRPRTRRWKLKRLPVEEDAGNKAKGEEERKLDEYEAFLKDLEQDPDLRFNINLYKNEDYRSEMASTVGDDVPTVPIEELIEDLTLGDDEEDEGDEAVAGNTQSAMAE

SEQ ID NO: 27691 - DNA, 459 bp, Panicum virgatum
  misc_feature: Ceres CLONE 1878517
  misc_feature: Encodes the peptide sequence at SEQ ID NO. 27692
ataggagacgctttgccccctgcacgcctcctccccaaaccctacctactacccctcgacagcttcacaatcgcaatggcgctcgacaccaactccacggccgccgccgccgcaccggtcgtatccggcggcgcggagtcccatccgcgcctcgctaccgcgttcctcccgctgaacaggcccaccatctcggccgtccacgccccctacccgtccaagaacaacgagcccgccgtccccgcggcctccgcctccaaggactcgacctcggaggtggctacgccggagaagccggcgccgtaagggaagtgggcgatctacagctggaagtcaaagaaggcgctgcagctccccgagtacccaaaccacgatgagctggacaccgtgctcaagacaatcgagacgttcccgcctgtggtgttcgccggggaggctcgccacctctaggagcgcctcgcg

SEQ ID NO: 27692 - protein, 75 aa, Panicum virgatum
  misc_feature: Ceres CLONE 1878517
  misc_feature: SWISSPROT Homolog: EC 2.5.1.54 3-deoxy-7-phosphoheptulonate synthase
MALDTNSTAAAAAPVVSGGAESHPRLATAFLPLNRPTISAVHAPYPSKNNEPAVPAASASKDSTSEVATPEKPAP

SEQ ID NO: 27693 - DNA, 2423 bp, Panicum virgatum
  misc_feature: Ceres CLONE 1878554
  misc_feature: Encodes the peptide sequence at SEQ ID NO. 27694
accatctccctcctcttctctcacagaatcacacgaagagggggctccccattcctcgcctctctgcccccgtccccgctcacctacgagtgatagcccacacctgctgcgctcgtcccctccctcctccctcctagcccctcgccattactccctccctcataaaggaagagcagagcagggtcgaggaagaagcagcgccggggaaggacccggccgtagcctctgctccgcgactccggctcggcgcctgccaatcgcgcggcgcggccaccacgctagcccccgtcttgcaggcgaacagagccgccgcgtcgatagtacagtaaattccgccgcattccattcccttccccctttcgaaacccaccctgcatttactgcacgccactcgccctccggcctcccgcgatcttcgaaatcatctccctgccaaaagcggccggagacgggaaggccgggcgcttcaggatggcgcgcgagcagctggaggaggccatcgtggccgacggcaacggcaaggaggaggaggtcggggtcatgggcatcgccggcgcgggcgacggcgacgagcagcacggcggcggcaagttcagcatgaagagcttcctctggcacggcggctccgtctgggacgcgtggttcagctgcgcctccaaccaggtggcgcaggtgctcctgaccctgccgtactccttctcgcagctggggatgctgtccggcgtgctgctgcagatcttctacggcttcctgggcagctggacggcctacctcatcagcgtcctctacgtcgagtaccgctcccgcaaggagaaggagggcgtcagcttcaagaaccacgtcatccagtggttcgaagtgctggacgggctgctgggcccgtactggaaggcggccggcctggccttcaactgcacgttcctgctcttcggctccgtcatccagctgatcgcctgcgccagcaacatctactacatcaacgaccggctggacaagcggacatggacgtacatcttcggcgcctgctgcgccaccacggtgttcatcccctccttccacaactaccggatctggtccttcctggggctcggcatgaccacctacaccgcgtggtacctcgccatcgccgcgctcatcaacggccaggtagagggcgtcgcgcacaccggcccgaccaagctcgtgctctacttcaccggcgccaccaacatcctctacaccttcggaggccacgccgtcacagtcgagatcatgcacgcgatgtggaagcctgccaagttcaagtacatctacctgctggcgacgctgtacgtgttcacgctgacgctgccgtcggcggcggccatgtactgggcgttcggcgacgagctgctgacccactcgaacgccttctcgctgctgcccaagaccgcgtggcgcgacgcggcggtgatcctgatgctgatccaccagttcatcacgttcgggttcgcgtgcacgccgctctacttcgtgtgggagaaggtgatcgggatgcacgacaccaagagcctcttcaagcgcgcgctggcgcggctccccatcgtggtgcccatctggttcctcgccatcatcttccccttcttcgggcccatcaactccgccgtcggcgccctcctcgtcagcttcaccgtctacatcatccccgcgctcgcgcacatcctcacctaccgcacggcctccgcgcgcatgaatgccgcggagaagccaccgttcttcctgccgagctggacggggatgttcgtggtgaacgtgttcatcgtggtgtgggtgctggtggtcggcttcgggctcggcggctgggccagcatggtgaacttcatcaggcagatcgacacgttcgggctcttcgctaagtgctaccaatgctccaagccgcccgtccccgccgcgccggcgccgttgccgcaccactagggcgcgcgtacgccgcggcgccggcggcgccggccggaggcatcgcaaggaagccggccggcgcgtcgctttgcagcagccagtgttaattgctaggtttcggtcgccttgtaatatacaagcctcctctcctcctctcccctagggtgccacttgacaccgtagcaggactcgatcagcagcagaggtttctctcacggcggcggctcgggacccgtccctggcgtaacaagaacacaagatctcctcgcccccgaggccgtgccgctgccgcgtcgctttcccctcaccccgcgcccgatcggtccgtcgccattggtgttccttgtgttttgtttggcttgccaccagtataagtgtgagtgatggtcatggcttataaggctctctctttctcgctctcggctcatgtgagagtgagagagacgattccacaatccatatgatatgacatacttatcctatagggttccttaatttttttccct

SEQ ID NO: 27694 - protein, 487 aa, Panicum virgatum
  misc_feature: Ceres CLONE 1878554
  misc_feature (49)..(443): Pfam Name: Aa_trans Pfam Description: Transmembrane amino acid transporter protein
MAREQLEEAIVADGNGKEEEVGVMGIAGAGDGDEQHGGGKFSMKSFLWHGGSVWDAWFSCASNQVAQVLLTLPYSFSQLGMLSGVLLQIFYGFLGSWTAYLISVLYVEYRSRKEKEGVSFKNHVIQWFEVLDGLLGPYWKAAGLAFNCTFLLFGSVIQLIACASNIYYINDRLDKRTWTYIFGACCATTVFIPSFHNYRIWSFLGLGMTTYTAWYLAIAALINGQVEGVAHTGPTKLVLYFTGATNILYTFGGHAVTVEIMHAMWKPAKFKYIYLLATLYVFTLTLPSAAAMYWAFGDELLTHSNAFSLLPKTAWRDAAVILMLIHQFITFGFACTPLYFVWEKVIGMHDTKSLFKRALARLPIVVPIWFLAIIFPFFGPINSAVGALLVSFTVYIIPALAHILTYRTASARMNAAEKPPFFLPSWTGMFVVNVFIVVWVLVVGFGLGGWASMVNFIRQIDTFGLFAKCYQCSKPPVPAAPAPLPHH

SEQ ID NO: 27695 - DNA, 1327 bp, Panicum virgatum
  misc_feature: Ceres CLONE 1878573
  misc_feature: Encodes the peptide sequence at SEQ ID NO. 27696
acacccaccaccactactccataccaacaccaccgacccaggagaagaaggaaggaaacaaaccactgccggcaagccaaaagccagtgacgccgccccggccggctactgctccccgatcgatcggtctccccatctcgtcaggccgcaggtagctagtccaccacgctgaccgtcggcatggcggctctggcaacgtcccagctcgccaccacccacgccggcttcggcctcggcggcgacacctccatgttccgccgcggcgtccagggcctgagggggccccggccctcggcgggcgcgctcagcgtgcggaccagcgcgcgcgcggcgccccggcagcagtcccgccggccgcagcgcggcgggggcaggctcccctccctcgtcgtctgcgccgccgccggcatgaacatcgtcttcgtcggcgccgagatggcgccctggagcaagaccggaggcctcggcgacgtcctcggcggcctcccgccggccatggccgcgaatggccaccgcgtcatggtcatctccccccgctacgaccagtacaaggacgcctgggacaccagcgtcgtgtccgagatcaaggtgggggacaggttcgagacggtgaggtttttccactgctacaagcgcggagttgaccgtgtgttcatcgaccacccatcgttcctggagcgggtttggggaaagaccggtgagaagatctacgggccagacgctggagtggactacaaggacaaccagcggcgtttcagcctgctttgccaggcagcacttgaagctcctaggatcctgagcctcaacaacaacccctacttctcaggaccgtacggggaggatgtcgtgttcgtctgcaacgactggcacaccggccctctgtcgagctacctcaagagcaactaccagtccaacggcatctacaggaacgcaaagaccgctttctgcatccacaacatctcttaccagggccggttcgcattctcggactacccggagctgaacctccctgagagattcaggtcatccttcgatttcatcgacggctacgagaagcctgtggagggcaggaagatcaactggatgaaggccggtatcctggaagccgacaaggtcctcaccgtgagcccctactacgccgaggagctcatctctggcatcgccaggggctgcgagctcgacaacatcatgcgcctcactggcatcaccgggatcgtcaacggcatggacgtcagcgagtgggaccccagcaaggacaagtacatcgccaccaagtacgacgtgtcgacggccatcgccgccaaggcgctgaacaaggaggcgctgc

SEQ ID NO: 27696 - protein, 382 aa, Panicum virgatum
  misc_feature: Ceres CLONE 1878573
  misc_feature (78)..(339): Pfam Name: Glyco_transf_5 Pfam Description: Starch synthase catalytic domain
  misc_feature: SWISSPROT Homolog: EC 2.4.1.242 NDP-glucose--starch glucosyltransferase
  misc_feature: The sequence is a functional homolog of SEQ ID NO 4 in US patent 7169982
MAALATSQLATTHAGFGLGGDTSMFRRGVQGLRGPRPSAGALSVRTSARAAPRQQSRRPQRGGGRLPSLVVCAAAGMNIVFVGAEMAPWSKTGGLGDVLGGLPPAMAANGHRVMVISPRYDQYKDAWDTSVVSEIKVGDRFETVRFFHCYKRGVDRVFIDHPSFLERVWGKTGEKIYGPDAGVDYKDNQRRFSLLCQAALEAPRILSLNNNPYFSGPYGEDVVFVCNDWHTGPLSSYLKSNYQSNGIYRNAKTAFCIHNISYQGRFAFSDYPELNLPERFRSSFDFIDGYEKPVEGRKINWMKAGILEADKVLTVSPYYAEELISGIARGCELDNIMRLTGITGIVNGMDVSEWDPSKDKYIATKYDVSTAIAAKALNKEAL

SEQ ID NO: 27697 - DNA, 658 bp, Panicum virgatum
  misc_feature: Ceres CLONE 1878573-R
  misc_feature: Encodes the peptide sequence at SEQ ID NO. 27698
cgagcgcatgctgatgagcgcggaggagaagtaccccgacaaggtgcgcgccgtggtgaagttcaacgcggcgctggcgcaccacatcatggccggcgccgacctgctcgccgtcaccagccggttcgagccctgcggcctcatccagctgcaggggatgcgatacggcacgccctgcgtgtgcgcgtccaccggtgggctcgtcgacaccgtcatcgaaggcaagaccggattccacatgggccgcctcagcgtcgactgtaaggttgtggagccggccgacgtgcagaaggtggcgagcaccctgaagcgcgccatcagggtcgtgggcacgccggcgtacgaggagatggtcaggaactgcatgatccaggacctctcatggaagggccctgccaagaactgggagaaggtgctgctgagcctgggggtcgccggcagccagccggggatccaaggcgaggagatcgcgccgctcgccaaggagaacgtggccgcgccctgaagactatatatatatatatatagttgcttgtggtaatgtattatagtagtggccagcggcggcacacctaataagtatatatgaaccatatatattatatatactatattgcgaataaataaaaaggatttgctatagtagtagtagtagtat

SEQ ID NO: 27698 - protein, 167 aa, Panicum virgatum
  misc_feature: Ceres CLONE 1878573-R
  misc_feature: SWISSPROT Homolog: EC 2.4.1.242 NDP-glucose--starch glucosyltransferase
  misc_feature: The sequence is a functional homolog of SEQ ID NO 4 in US patent 7169982
ERMLMSAEEKYPDKVRAVVKFNAALAHHIMAGADLLAVTSRFEPCGLIQLQGMRYGTPCVCASTGGLVDTVIEGKTGFHMGRLSVDCKVVEPADVQKVASTLKRAIRVVGTPAYEEMVRNCMIQDLSWKGPAKNWEKVLLSLGVAGSQPGIQGEEIAPLAKENVAAP

SEQ ID NO: 27699 - DNA, 1388 bp, Panicum virgatum
  misc_feature: Ceres CLONE 1878581
  misc_feature: Encodes the peptide sequence at SEQ ID NO. 27700
ctgcatctccctctgttcatccccgcttcgccggccatctccctcggcgagctcggcgtgtggattcgagagcggccggcgctgcggcggaggtgcaagcttgaattcgctctcatccctccccgctcctagcttcgtaaacctgtcaatggcgcgctcggtgcggcggcgagcacccgtccgtggacggcgccggcgcgcggcctgctaagcaaccatttttctccgcccgtccttctctctcttcaatctagtacacgcctcgcaatgggttcgccggcctacaccgcttccctttctcccggctctgctctcttctccaactctcgagtgccgccgccgcgtcttctccggccggggctcggggtgccggggagaggggaggtgggggtgtcttcggcagctggaaggtacggcggcggccgcctcaccccgccgcaggagaagcgccggccctcggagtcagcccaactcacggaacggaagcggcattggaaagcgggggagttcccggcggggtccgccaccggcagggacggcggccgcgccgccccgccgcaagagaagcggcactggaaggcgggggagttcccggcgggggccgccgccggcagggacggcggccgccccggcccaccgcaggagaagcggcactggaaggcgggggagttcccgggcaccgccgcgcccccggactcgaaggcgtcgaggacgcccctgaagaacgtcaagaagcggctggacgcccgcgcggacgccaaggcgtgggcgtgcaccgtcaccgaggccctcgccgacagcatcaactccaagaactggcgagaagcgctgcaggtcttcgagatgctcaaggagcagcctttctaccatccgaaagagggcacctacatgaagctcatcgtgctgcttggcagatcgggccaggccgcccaagcgcgccagctattcgacgagatgctgcaacaaggatgccaacccacccctgagctctacaccgccttgattggggcctactgccgctgtggcttactggatgagtcactccagctcctcacagacatgaaggcctctccactgtgccagcctgacgtctacacctacagcaccatcatcaaggcctgtgtcgatgccaccagatttgaccttgttgaagccatgtacaaagacatggctgagcgcttgatatcacccaacacggtcacgcagaacattgtcctcagtgggtatggaaaggctggacggttagatgacatggaaagagtgctctctgacatgctcgacagcacgacctgcaagccggatgtctggacaatgaacattatcctaagcctgtttggaaacagggggcaggtggaagcgatggagaaatggtatgagaaattccgaag

SEQ ID NO: 27700 - protein, 373 aa, Panicum virgatum
  misc_feature: Ceres CLONE 1878581
  misc_feature (240)..(274): Pfam Name: PPR Pfam Description: PPR repeat
  misc_feature (205)..(239): Pfam Name: PPR Pfam Description: PPR repeat
  misc_feature (276)..(310): Pfam Name: PPR Pfam Description: PPR repeat
MGSPAYTASLSPGSALFSNSRVPPPRLLRPGLGVPGRGEVGVSSAAGRYGGGRLTPPQEKRRPSESAQLTERKRHWKAGEFPAGSATGRDGGRAAPPQEKRHWKAGEFPAGAAAGRDGGRPGPPQEKRHWKAGEFPGTAAPPDSKASRTPLKNVKKRLDARADAKAWACTVTEALADSINSKNWREALQVFEMLKEQPFYHPKEGTYMKLIVLLGRSGQAAQARQLFDEMLQQGCQPTPELYTALIGAYCRCGLLDESLQLLTDMKASPLCQPDVYTYSTIIKACVDATRFDLVEAMYKDMAERLISPNTVTQNIVLSGYGKAGRLDDMERVLSDMLDSTTCKPDVWTMNIILSLFGNRGQVEAMEKWYEKFR

SEQ ID NO: 27701 - DNA, 669 bp, Panicum virgatum
  misc_feature: Ceres CLONE 1878581-R
gaccttctgttgtctaataaatggattcagcaaagcagttttttttcataaggttgtgggcatggttaagcttgctgagagacttggtgtgcccacagatacgtctttccacaatgctattcttggtgcatgtgcaaaagcagatgatcttatggagatggagagggtcttcatgcacatgaagcataagcagtgtgatccggatgccatgacatactctatcttggtggaagcttatcggaaggaaggaatgaccgacaagatttatgctttgcatcaggagaacccaactttggttccaactgatcttgtcatggtgtaactgactcgctgactgaataatggttcaggtatatttaagcctggctgcattggtggaaaacttccctgctgtccaagtttggagttgataatgtaaccaagtagagtggcagccattctccaactccattttgtctgttggcctgcaaaagttagtatctatatctcctggcaactgtatttctgtgaactctgggggcttcgctgtatcaattgaaatgtgacagtaatgtgtgtaggtctgaggccatacggcttgaaacctccccagcaagatgtggcaacttgagatgctttgagtttaggctgtttagcacagaattgataaatgataacaaaattgtgtcg

SEQ ID NO: 27702 - DNA, 705 bp, Panicum virgatum
  misc_feature: Ceres CLONE 1878594
  misc_feature: Encodes the peptide sequence at SEQ ID NO. 27703
gacaaagagcgagcgcagagggagcggaaacgagaagggagaggggaaaagggaaagatggcggctcggcgagggcgggagtgggatggggacgagctggtcggtccgccgcagacacctctcgccgcacccgtcgtctgcctcctgcgctccgccggggacctcgctgccggtgccttcgtcggctcgctcgtcggatatggcaaaggtttgatcacgaatcaaggtatgaaggcttcacttagcaacgctggatcgtctgccaagacttttgcagctcttgctggtgttcaaagtttcataatgtgcttattgagaagactgcgtgggaaagatgacgtgatcaatgctggtatgtctggttgttgcacaggccttgctttgagttttccaggtacaactatgtttgaccatagttagcaattgtttagaactttatcctcgggaacactgcattgtttgttcatactttttcgatctacaaacagtgcaactgatgctagatgatatatctataaattttttagttgagctagatgatatttctttaagctttttgttttttctcgtatctactgttcaagttaccattgagttattttttgagatattattgccttcctcacttttcttggtatcttggtttgctatttttgaaatattattacttttccccattcatggggacatcttaaattgtctatt

SEQ ID NO: 27703 - protein, 120 aa, Panicum virgatum
  misc_feature: Ceres CLONE 1878594
  misc_feature (21)..(117): Pfam Name: Tim17 Pfam Description: Tim17/Tim22/Tim23 family
  misc_feature: Functional homolog of the protein sequence given in SEQ ID NO 51063
  misc_feature: Useful for making plants with modulated salt sensitivity
MAARRGREWDGDELVGPPQTPLAAPVVCLLRSAGDLAAGAFVGSLVGYGKGLITNQGMKASLSNAGSSAKTFAALAGVQSFIMCLLRRLRGKDDVINAGMSGCCTGLALSFPGTTMFDHS

SEQ ID NO: 27704 - DNA, 538 bp, Panicum virgatum
  misc_feature: Ceres CLONE 1878596
  misc_feature: Encodes the peptide sequence at SEQ ID NO. 27705
aatcctcgccttctctccgcgccgcgacgctaccccgccccatccgccaggccgtcgccgccagcagtctccccaccctcgacccgctccgccgtcgcgcttccggaggaggcagataggagaaggtgatcggctgcgatggcccgcttgtacgtcgggaacctggatcctcgggtgacggcacgggagctcgaggacgagttccgcacctttggagttcttcggagtgtttgggttgctcggaaaccacctggctttgcatttattgattttgatgacaagagggatgctgaggatgcaatccgtgatcttgatggcaagaatggatggagagttgagctatcacgtagtgccagcagtggtcgtggtggtcgtgatcggtatggtgggtctgagtctaagtgctacgagtgtggtgagactgggcactttgctcgtgagtgtcgtttgaggattggttctggaggtctaggcagtggaaggcgccgaagcaggagccgcagccgcagccgcagccccagataccgacggagtccaa

SEQ ID NO: 27705 - protein, 133 aa, Panicum virgatum
  misc_feature: Ceres CLONE 1878596
  misc_feature (4)..(70): Pfam Name: RRM_1 Pfam Description: RNA recognition motif. (a.k.a. RRM, RBD, or RNP domain)
  misc_feature (87)..(104): Pfam Name: zf-CCHC Pfam Description: Zinc knuckle
  misc_feature: Functional homolog of the protein sequence given in SEQ ID NO 50750
  misc_feature: Useful for making plants with modulated flowering time
MARLYVGNLDPRVTARELEDEFRTFGVLRSVWVARKPPGFAFIDFDDKRDAEDAIRDLDGKNGWRVELSRSASSGRGGRDRYGGSESKCYECGETGHFARECRLRIGSGGLGSGRRRSRSRSRSRSPRYRRSP

SEQ ID NO: 27706 - DNA, 676 bp, Panicum virgatum
  misc_feature: Ceres CLONE 1878602
  misc_feature: Encodes the peptide sequence at SEQ ID NO. 27707
gctctcccgcacggcaccaccaccgctactccacaccacaccagctgcgcccccgcgcgtacgcgccgcgccccgtgccggggctttcccatcctttccacgctgtcgccgcgcgctctctcctgcgctgctccgtccgaccgtccccccattccggcgttcacaccgcctgctcagcctcgcgtcttacaaagaggcgtgggtgcgcaccctccgattgcccctgagaggcggcacggcggagggagcggcggcggtgcgagaagctgctcgtgtgtcgtgtcggcgactcgaggggggggggggacatgagctgcctgggctggttcaagcggaggtcgaggagcgacggggcgtcgtcggggaagcgcggggcgtcggcgtcggcgtcgtccggcccggcgaccgccaccacgacgaccaccacggtgtcgggggtgagcacgagccggtcggacgactccggcgcggtgcggccggtgagcaagtcggcggggtcggccgcctcgtcgcagtcgcagcggagcatctcgtcgctgtacgaggagcggggccacggccagctgcgggtgttcgactaccaggagctccaggccgccaccgccgacttcggccgcgcgcagaagctcggcgagggcggcttcggcagcgtctacaagggcttcgtccgcgcggc

SEQ ID NO: 27707 - protein, 122 aa, Panicum virgatum
  misc_feature: Ceres CLONE 1878602
  misc_feature: SWISSPROT Homolog: EC 2.7.11.1 Non-specific serine/threonine protein kinase
MSCLGWFKRRSRSDGASSGKRGASASASSGPATATTTTTTVSGVSTSRSDDSGAVRPVSKSAGSAASSQSQRSISSLYEERGHGQLRVFDYQELQAATADFGRAQKLGEGGFGSVYKGFVRA

SEQ ID NO: 27708 - DNA, 544 bp, Panicum virgatum
  misc_feature: Ceres CLONE 1878606
  misc_feature: Encodes the peptide sequence at SEQ ID NO. 27709
acgcgctggacgcgcaccggccattcctaccggaacagccaacgaaccggaccgtgatgcctcgacggcggcgcccacgcggcgacctcgccgtcgcggcggcgctggcggcgctggccctggcggccgtggtggcggaaggaggcgacggcggcgcggtgtttgattaccggaagctgtcggggataatcatcccggggttcgcgtcgacgcagctgcgcgcgtggtcggttctggactgtccctactcgcctttcgacttcaacccgctcgactccgtctggctcgacaccgccaagcttttctctgctgtaaattgctggcttaagtgcatgctgcttgaaccctataatcagacagaccatccggagtgcaagtcaaggcctgatagtggtctttctgcaattacagagttagaccctggttatataacaggtcctctctcttcagtatggaaagaatgggtcaaatggtgtgtagagcttggcattgaagctcatgcaattctcgctgttccttatgattggagactgccaccatcaat

SEQ ID NO: 27709 - protein, 162 aa, Panicum virgatum
  misc_feature: Ceres CLONE 1878606
  misc_feature: SWISSPROT Homolog: EC 2.3.1.158 Phospholipid:diacylglycerol acyltransferase
  misc_feature: The sequence is a functional homolog of SEQ ID NO 5 in US patent 7157619
MPRRRRPRGDLAVAAALAALALAAVVAEGGDGGAVFDYRKLSGIIIPGFASTQLRAWSVLDCPYSPFDFNPLDSVWLDTAKLFSAVNCWLKCMLLEPYNQTDHPECKSRPDSGLSAITELDPGYITGPLSSVWKEWVKWCVELGIEAHAILAVPYDWRLPPS

SEQ ID NO: 27710 - DNA, 691 bp, Panicum virgatum
  misc_feature: Ceres CLONE 1878609
  misc_feature: Encodes the peptide sequence at SEQ ID NO. 27711
acggcgatttgccatctgaatcataccctacactggtgcgggcgtgcggcggctcctcttgcgcagccgggtattcccggcgatgtctgagcgtcggcggcgtggccactgcatctcggcggcagatggagagggtgtcaaacggtgcacggaggtggcgagcggcaacctgtttgatgtataccagaggaaggggaatttgaaggtatacaagaggaaggggaagaagaagaagaagagggtgctgccgcagcagcagactttcgagctgccggacgagattgtctgggagatcatgatccggctgccagtggaatccctggcgagattcaaaaccgtcagcaaggcctggcttgccatcatttcggatccttcttttgttcgcgcgcatctccagtgctccaagcagaaacagcaccgcaacccatcacatttcctcatcaaccccaagtttcttttggaaacaagtaatgccgatgctttttccaccaacatccagttctaccagtggtgtttacaagaaaacatgatgaggagtactgcaacactactgtacgggagacacttccctaccagcgagtttgggagagtgtccgacatggcacattgtgatggcttgatgctgctccccaccgacaccaaggtctacgtcttcaacccagccacaaaggacaccattgcactgccagag

SEQ ID NO: 27711 - protein, 202 aa, Panicum virgatum
  misc_feature: Ceres CLONE 1878609
  misc_feature (58)..(105): Pfam Name: F-box Pfam Description: F-box domain
MSERRRRGHCISAADGEGVKRCTEVASGNLFDVYQRKGNLKVYKRKGKKKKKRVLPQQQTFELPDEIVWEIMIRLPVESLARFKTVSKAWLAIISDPSFVRAHLQCSKQKQHRNPSHFLINPKFLLETSNADAFSTNIQFYQWCLQENMMRSTATLLYGRHFPTSEFGRVSDMAHCDGLMLLPTDTKVYVFNPATKDTIALP

SEQ ID NO: 27712 - DNA, 726 bp, Panicum virgatum
  misc_feature: Ceres CLONE 1878615
  misc_feature: Encodes the peptide sequence at SEQ ID NO. 27713
ggcgcaacccccctgtccgtgttcgcggagatggggaacatcttcgtgaagaagcccaagatcacggacgtcgacagggccatcctcaccctcaagacgcagcgccgcaagctcgcccagttccagcagcagcttgagaaggtaatcgaagcagaaaaggaagctgcacggcagttggttcaacagaagaagagggacagagctttgattgctctgaagaagaagaaagctcaggaggagctgttgaaacaagttgacacatggcaaatgaatgttgaacaacagctgacagacattgaactagcaagtaaacaaaaggctgtatttgaaagcctgaaggctggaaatgctgcccttaagtctatgcagaatgagataaacattgatgatgtccagaagctgatggatgatacagccgaggctaaggcttatcaagatgaaataaatgctgttctaggcgagcagctatcggctgaggatgaagaagctgttatggctgagtttgagaatttggaagctcagcttgccgtcgagtctttgccagacgcacctgttactgaagtacggcctgaagagaaaatgaaagcaccggctgacacagaagctgcatctgaggacattgatgaggttattgagcttcctgatgtgcctacgaaagtgccggagagaccagaagctcctgaaaaaacgaaagttttggacgagccgctacctgcatagtggatg

SEQ ID NO: 27713 - protein, 229 aa, Panicum virgatum
  misc_feature: Ceres CLONE 1878615
  misc_feature (16)..(178): Pfam Name: Snf7 Pfam Description: Snf7
MGNIFVKKPKITDVDRAILTLKTQRRKLAQFQQQLEKVIEAEKEAARQLVQQKKRDRALIALKKKKAQEELLKQVDTWQMNVEQQLTDIELASKQKAVFESLKAGNAALKSMQNEINIDDVQKLMDDTAEAKAYQDEINAVLGEQLSAEDEEAVMAEFENLEAQLAVESLPDAPVTEVRPEEKMKAPADTEAASEDIDEVIELPDVPTKVPERPEAPEKTKVLDEPLPA

SEQ ID NO: 27714 - DNA, 873 bp, Panicum virgatum
  misc_feature: Ceres CLONE 1878643
  misc_feature: Encodes the peptide sequence at SEQ ID NO. 27715
ttcaaaaccaaacacttcagctgcagcgtaagcttgcagggcaccagagatcaggcagcaatggccagctcggttgcaaacactgctagtagcctgcgccgccgcctcctgcccctcgccgccgtcgtggctctgacgatcctggcgccgccggtggtgtcggaagagcgggtccctgtgcggctgacggtgtacgtccaggaagtcctggacgggccggggcagacggagaagctgctgattaggggccccggcccggagaacccgagagtgtggcccccgcacaacctcttcggcgacacggttgtgatggacgacctcgtcaccgagggcctcggcaacgacaccgcgcccatcggccgcgtgtacggcatctacatgacggcctccatgacccgcccggtgtacacggtgagcttcacgctgctgctcaccgcggggccctacagcgggagcacgctcgtgatggccggcatcgacgacgacgacatggaggtcagggagcacgccgtggtgggcgggacgggcgcgctccggggggccgagggctacgtgctgggcgtggtcacgccattctcgcccacgtacgttgtgatggagctggacgtgtacgcgaccgtgccggtgccgacgaccgaagccaaagcggctgcctctcatctcataaccgaccagtgatccactagcttgcttgctatcccctataataattcaaatggtacatcattttagcaaatctaaatgcataatttttactatgtatctagatataatatttatctagatacgtagcaaaacttttgtatctaaatttgtcaaaacgacctacaatttgtaattaaaggagtactcaataatccatcattgtgccct

SEQ ID NO: 27715 - protein, 205 aa, Panicum virgatum
  misc_feature: Ceres CLONE 1878643
  misc_feature (23)..(187): Pfam Name: Dirigent Pfam Description: Dirigent-like protein
MASSVANTASSLRRRLLPLAAVVALTILAPPVVSEERVPVRLTVYVQEVLDGPGQTEKLLIRGPGPENPRVWPPHNLFGDTVVMDDLVTEGLGNDTAPIGRVYGIYMTASMTRPVYTVSFTLLLTAGPYSGSTLVMAGIDDDDMEVREHAVVGGTGALRGAEGYVLGVVTPFSPTYVVMELDVYATVPVPTTEAKAAASHLITDQ

SEQ ID NO: 27716 - DNA, 651 bp, Panicum virgatum
  misc_feature: Ceres CLONE 1878711
  misc_feature: Encodes the peptide sequence at SEQ ID NO. 27717
attacagaagaagattttgagtgcaaaatttaacttcaatgactttctgaagcaaacacaaatgatcgcaaaaatgggttcgttcagtcgtttaattggcatgattccaggcatgaacaaggttaccccagcacaaattcgtgaagctgagaagaatctcaagtttatggaatcaatgatcaatgtgatgactcctgaggaaagggaaagaccagaattactggctgaatcacgtgagagaaggagaagagtggccaaggactctggaaagactgaacagcaggtgagccaattggttgcgcagctcttccaaatgcgtgcccgaatgcaaaaaatgatgggtgccatgcaaggaaaagactctcccaacatggacgaactcatggagtcaattaaggctgaggagcagggtgctgccgatgctggaaggcgcaggaggaagtatggcaacctgaagcagcggcaactggatgcgatgcgtggtttccgccgacgttgagatgttaattggcgactctgactggcagtgtctgccgtatacctacctgattgcagcccagggatttgggtcggagtcagaactcagaaatggggatgaagtgctttcgggtgctctgcagttagaattgcatctggatacgtatacactgc

SEQ ID NO: 27717 - protein, 165 aa, Panicum virgatum
  misc_feature: Ceres CLONE 1878711
  misc_feature (9)..(109): Pfam Name: SRP_SPB Pfam Description: Signal peptide binding domain
LQKKILSAKFNFNDFLKQTQMIAKMGSFSRLIGMIPGMNKVTPAQIREAEKNLKFMESMINVMTPEERERPELLAESRERRRRVAKDSGKTEQQVSQLVAQLFQMRARMQKMMGAMQGKDSPNMDELMESIKAEEQGAADAGRRRRKYGNLKQRQLDAMRGFRRR

SEQ ID NO: 27718 - DNA, 2945 bp, Panicum virgatum
  misc_feature: Ceres CLONE 1878748
  misc_feature: Encodes the peptide sequence at SEQ ID NO. 27719
gagaatcgtgctccggaaaagcaagcctcagagtatccacctcctgctccccttctctctctagatctacgcaagcggcctcggtttcggcgatcgcgctgcggctgctcgcccgtccgcgccggcggggcggctgatgctcccgcgctgctccgcggagctggtgcggcgctgttagctgctctccacgagggcccgacccctcaccgagcgcgagcgatgagggcggggggcggcgggccccggcgcttccggcccggggctccggtgctcgtcctgctgctgatcgccgctgcggcattgccgcgccgcgcggtcgcggccaccgacgccgccgacgtttctgctataaatggactttatgttgcacttgtatcaccaaagctgcctggatggtctgcgagtggtggagatccctgtggtgagggttggcagggtgtcacatgtaccggctcaagtataacctcaatagtttttaatgctgcgaatttgggaggacagctaggcagcctggggaacttcacttcaataactgaaataaatcttagcaacaataatattggtggaaccataccggaagatctacctgtcacactgcaaaatttctttctctcagataatcaactcaccggaagcatcccaatgtcattatcaaaactccagagtctatcggccatgtcgctgaatgctaaccatctagatggaaaattgccagatgcatttgattcgctaacaggacttgtaaatcttgatatttcatccaacaacttcagcggtccattaccaccttcattgggaagcttgacatcactgactacattgcacgtgcaagataatcaactaactgggacccttaatgtgttgcaggatctccccctcaaagatttaaatgtagaaaataatatgttttctggtccagttcctccaaaactgctgaacataccaaatttcaaaaatgatgggaacccatttaacaccagcatagctccctctacttcaccctcttctacacctacaggctctacaccaacacaaacaccatcatccccttcatccccttcaggtcctcctccaccatctaatacagcctcaaactccagtggatctactgcacgagatagcagctctccatcatccaagaagcacaagtcttcaactctcagaactgttggatatgttcttcttgccattgtgctattcatagttatagtgctgctggtaatattttgcttgtccaagtaccaagagagacaagagagacgtgattattccacaagtcatttagggaggctgcgacagagggttgaggagccaaaaatcaagcaagcttcagtgcaatcaagagatgctacccaaaaaggttcagctgaaaatccagatagaaagaagcctcgtgaaataaatttaacagtaccagctgcccttgagaagcctcctgaaaagagaaaagagcatgtaattaatttggagcgaacagaatcagagatatttgctgcagcacctccaccacctccacctccgccacctccgcctccacctccgcctccgcctcttactccgccgccgctgccaccaatgccatcaccaccatcaccccctcgtgttgaaaaagtaaccgtaaatcccattgtcaggccagaaaaaagagttagcactccgccaaggactgatccctcaacatctgcgacatccttttctgttgcatcacttcagcaatatacaaatagcttcgaagagcaaaatttgatgagggagagtaggttgggaaaagtgtatctggcaatacttcctgaaggcaaattgctggaagttatgaagattgacaatgctaatggaagaataccagtagatggctttctagagctggttgctcgtatatcagatattagacatcctagcattctcgagcttgttggatactgtgctgagtatggacaacggttactcgtctataaccacttcagtagaaaaacactacatgatgtactgcatgaaggggaggagatagatgatgcattatcgtggaatgctcgcctccaggttgctcttcatgcagcaaaggcgttagagtatctccatgacacctgtgaacctccagtagtgcaccagaattttgaaccagcaaacgtgctccttgacaatagatgctcagtacgtgttgctgaatgtggactggcagaattgatgttgtcaggttctgttacacagctatcaggtcgcatgcgggctctactcaattatgaagcacctgaaatccaagaatctgggccttttactaacagaagcgatgtttacagttttggtgttgtgatgctagaacttctcacaggccgtagaccttatgacagttctcgcccacgtgctgaacaacatcttgtaagatgggccaactctcagcttcatgacattgagtccatatcaaagatggtcgatcctgctattcgaggagagtgttccgacatactgttgtcgcgtttcgcagacatcatcagtcgatgtattcagacggaaccagagttcaggccggcaatgtctgaaatcgtccaagacctaactaggattgtaggtgctaccggtgagggttcagagtgataaatcaaggaagaacagcaaggccagccaatgaagacgctgagtgaatacatcttgagcacattggtgcgacacaccctatcagaatttgtactggcgagattatcagctgtacatgccattttggagcctcacttctgaaaagggtggtagactggtagttctagtagtatggtacaaccagagaggaggtgtggtttcacattgttgctgagcagattcctgtgctccgcaagacatgataattccacctgtaggcagtatttcttgtaactaattctattttttattactttattacactatagctagttatattgaatatgatgcttttagcatgtcttgaacctcag

SEQ ID NO: 27719 - protein, 790 aa, Panicum virgatum
  misc_feature: Ceres CLONE 1878748
  misc_feature (509)..(778): Pfam Name: Pkinase_Tyr Pfam Description: Protein tyrosine kinase
  misc_feature (37)..(77): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
MRAGGGGPRRFRPGAPVLVLLLIAAAALPRRAVAATDAADVSAINGLYVALVSPKLPGWSASGGDPCGEGWQGVTCTGSSITSIVFNAANLGGQLGSLGNFTSITEINLSNNNIGGTIPEDLPVTLQNFFLSDNQLTGSIPMSLSKLQSLSAMSLNANHLDGKLPDAFDSLTGLVNLDISSNNFSGPLPPSLGSLTSLTTLHVQDNQLTGTLNVLQDLPLKDLNVENNMFSGPVPPKLLNIPNFKNDGNPFNTSIAPSTSPSSTPTGSTPTQTPSSPSSPSGPPPPSNTASNSSGSTARDSSSPSSKKHKSSTLRTVGYVLLAIVLFIVIVLLVIFCLSKYQERQERRDYSTSHLGRLRQRVEEPKIKQASVQSRDATQKGSAENPDRKKPREINLTVPAALEKPPEKRKEHVINLERTESEIFAAAPPPPPPPPPPPPPPPPPLTPPPLPPMPSPPSPPRVEKVTVNPIVRPEKRVSTPPRTDPSTSATSFSVASLQQYTNSFEEQNLMRESRLGKVYLAILPEGKLLEVMKIDNANGRIPVDGFLELVARISDIRHPSILELVGYCAEYGQRLLVYNHFSRKTLHDVLHEGEEIDDALSWNARLQVALHAAKALEYLHDTCEPPVVHQNFEPANVLLDNRCSVRVAECGLAELMLSGSVTQLSGRMRALLNYEAPEIQESGPFTNRSDVYSFGVVMLELLTGRRPYDSSRPRAEQHLVRWANSQLHDIESISKMVDPAIRGECSDILLSRFADIISRCIQTEPEFRPAMSEIVQDLTRIVGATGEGSE

SEQ ID NO: 27720 - DNA, 1797 bp, Panicum virgatum
  misc_feature: Ceres CLONE 1878762
  misc_feature: Encodes the peptide sequence at SEQ ID NO. 27721
aagcgtgtctactagcagccgatcgaggagctaggcgcaagctacccccaaccacgagctactaccagccggcagcggcagctgctgtgccgctgccgccatggagaacccctacacgagcttcttcaagaaccacccgcaccgccaccgttactactaccaccccgccacgccgccggcgccagcagtgacgcccgccgcctactcctccctgcccttcttcgccgcgcatctgcagccaccaccaacccacacgccgcccgccccgccctcgcccccgctccgggaagccctgccgctcctctcgctcgccccggcggccgcgtcatcgtcgcgcggtatcacgcgagagccggggcagcgcggccgggtagcggcggattctgacgaggacggggacgacgaggaagaggaggagggcggccccgccgcgagcagtaacagcggccacggacagcagcgcgtgggaggcaggctcttcgcctatctgaacgccaaggccgcgggtgacccgatggacgtggagtccggctccgcggcggacgacgtgaccgtggcgctgcgcatcggcttgccgacgatgaccagcgccggctcggccaaccccatcggcgcccgcaggcggcacgaggacggcggcgccgaggaggaggacgacgacgaagggaggaatgacagggagaacggcggcggcggggaggaggaagaggaagaaggcgaggccgtggcagccccgctagggttcccgtcgacgccgatcgggcggctgaacaaggggcagtactggatcccgacgccgtcgcagatcctgatcggcccgacgcagttctcctgccccgtctgcttcaagaccttcaaccgatacaacaacatgcagatgcacatgtggggccacgggtcgcagtaccgcaagggcccggagtcgctgcgcggcatccagccgacggcgatgctgcggctgccgtgctactgctgcgcgccggggtgccgcaacaacatcgaccacccgcgcgccaagccgctcaaggacttccgcacgctgcagacccactacaagcgcaagcacgggctcaagcccttcctctgccgccgctgcggcaaggccttcgccgtcaagggcgactggcgcacgcacgagaagaactgcggcaggctctggtactgcctctgcggctccgagttcaagcacaagcgctcgctcaaggaccacgcccgcgccttcggccacggccacggattcgtccgcggcgccggcgccggcgcctgcggtggcgacgacgacgacggcgcggtctccgacatcgaccacgacggcgccgccgcggccaagtcgatgtgatgattgttatcaccgatgatgatccgtcgatcggtcgagctccgagcctccgatccaagccggccggccggaagatcgatcgatcttatacatacaaagacactgtatgatcgatgctgtactgtaagagatgatcgagctgttcttttattttcgttgccgctgcagctgctgctgttatgtcttctttatcatcttataattaggtacgttgtgtttggttggagggtgaacttgcattgcattgctagggcataagtacggcacggctcatgtgtggtcattgtagtactcttgttctctatcatcctagtgattgtaggagggctcgactagggaactagctagtactacatctcgatcgatcacaggcatgcgtggagaactagccctgttcatccagttcaagacctgcaaatgttgtacaaattaaataaataattccttgttgagcgcgg

SEQ ID NO: 27721 - protein, 412 aa, Panicum virgatum
  misc_feature: Ceres CLONE 1878762
  misc_feature: The sequence is a functional homolog of SEQ ID NO 1075 in the 10/666,642 US patent application
  misc_feature: The sequence is a functional homolog of SEQ ID NO 1077 in the 10/666,642 US patent application
  misc_feature: The sequence is a functional homolog of SEQ ID NO 1078 in the 10/666,642 US patent application
  misc_feature: The sequence is a functional homolog of SEQ ID NO 1076 in the 10/666,642 US patent application
  misc_feature: The sequence is a functional homolog of SEQ ID NO 1490 in the 10/666,642 US patent application
  misc_feature: The sequence is a functional homolog of SEQ ID NO 2792 in the 10/374,780 US patent application
  misc_feature: The sequence is a functional homolog of SEQ ID NO 432 in the 10/225,066 US patent application
  misc_feature: The sequence is a functional homolog of SEQ ID NO 1556 in the 10/666,642 US patent application
  misc_feature: The sequence is a functional homolog of SEQ ID NO 306 in the 10/666,642 US patent application
  misc_feature: The sequence is a functional homolog of SEQ ID NO 1074 in the 10/666,642 US patent application
  misc_feature: The sequence is a functional homolog of SEQ ID NO 630 in the 10/666,642 US patent application
MENPYTSFFKNHPHRHRYYYHPATPPAPAVTPAAYSSLPFFAAHLQPPPTHTPPAPPSPPLREALPLLSLAPAAASSSRGITREPGQRGRVAADSDEDGDDEEEEEGGPAASSNSGHGQQRVGGRLFAYLNAKAAGDPMDVESGSAADDVTVALRIGLPTMTSAGSANPIGARRRHEDGGAEEEDDDEGRNDRENGGGGEEEEEEGEAVAAPLGFPSTPIGRLNKGQYWIPTPSQILIGPTQFSCPVCFKTFNRYNNMQMHMWGHGSQYRKGPESLRGIQPTAMLRLPCYCCAPGCRNNIDHPRAKPLKDFRTLQTHYKRKHGLKPFLCRRCGKAFAVKGDWRTHEKNCGRLWYCLCGSEFKHKRSLKDHARAFGHGHGFVRGAGAGACGGDDDDGAVSDIDHDGAAAAKSM

SEQ ID NO: 27722 - DNA, 1865 bp, Panicum virgatum
  misc_feature: Ceres CLONE 1878773
  misc_feature: Encodes the peptide sequence at SEQ ID NO. 27723
attccccaaaccaaaagcctcgcccggtcgtcccgtccagccgtcccccacggagcaagcggacgccatggagcggcagcccccgccgccgcggatcacaatggaggcgatgctgcacgcgatggcgagtgacggcgcgggcgcggagatgttgaaccccggcatggactacatttacggcctcctgcacagctttctcccctgcccgcccgtctccgccgccgcctccctttccgtccactcctcgccccccggcggcggctccgaggaccgcctcagcgccctccccgacgcgatcctccgcaacgtcgtctcgcgcctcccctccaaggacgccgcccgcacctccgtgctctcctcgcgctggcgcccgctctggcgctccgcgccgctcgtactcgtcgacgcccacctcctccaaccggccggcggcgaggacgcaccgctgcgcgcaggctcaggctccggctccggctccgtcaccgccgcggtgtcccgcgtcctggaggcccaccggggccccttccgctgcgtcaacctcacccgcagctccatgggcgcgcaccgagccgagctcgcgctctggctccacctcctcgccgtcaagggcgtcgaggagttcgtcttcgttaaccgcccctggccgctcgactttcccctccccgccacgatcttcagcctcgcctccgtcaagcgtctctacctcggggcttggaggttccctgacacctcggctctcccgcgcggcacggcgttcccccacctgcttgagctcggcctctgctgcatcgccatggagggcagggacctcaacttcctcctcgccaggagccccatcctccagacccttgtggtctacttgagccagaaggatgtgaacctccgcatcatcagccgcagcctgcggtgtgtgcagctgtgcgtgtccattgtccatgacgtctccgtggtggacgctccgcgtctggagcggctcctcctgtgggacacggtaagcgttgacaaagttcgcaccaggatcaagttcggccatgcacccaagctgcgatctgtgggatacttgatgcctggagtacatgttcttgaggttggcaacaccatcattaaggctgagacaagggcaagcccaggaaccatcgtcccaagtgtgaagacattagccttggaggtgcattttggagttcgcaatgaagccaagatgattccctgcttcctcagatgctttcccaacatagagacactgcatatcaagtctgaggaaactgatcaaccagctggtaagctcaatcacaaattctggaaagagaacagtagcatcgaatgcgtgcagtcacacatcagggagatggttttccatgagtaccgtggggagcgtagtgagcttgccttcctgaagttcatcctggagaatgcgcgggtgctgcaggagatggtcattttatttgtcgaaggtagtctctcttcaggggacaatgcggctgccaaactgattaaggatctattatctgtgaaaagggctggaaactgtagactggtgatctccgagagccctatccatcgtggtggtagtcgttggagcagccaagtagcatctgatttggatgttgctgaccctttttattgctgctgctgaacccagcacgactgtatgtctcatggtccaagctagaattgtctacaagtattgtgttctgttccgagtaactgtttcagactgttggcatgtatttttctgaagacagtgcaggttcctagtagcacatgtagcatgagaagcatagtgctgaagtttcgcagaactgagactatgttgatggttgatgtacttgataatttggtattactacccttgtgatcctatggtg

SEQ ID NO: 27723 - protein, 521 aa, Panicum virgatum
  misc_feature: Ceres CLONE 1878773
  misc_feature (410)..(459): Pfam Name: FBD Pfam Description: FBD
  misc_feature (68)..(115): Pfam Name: F-box Pfam Description: F-box domain
MERQPPPPRITMEAMLHAMASDGAGAEMLNPGMDYIYGLLHSFLPCPPVSAAASLSVHSSPPGGGSEDRLSALPDAILRNVVSRLPSKDAARTSVLSSRWRPLWRSAPLVLVDAHLLQPAGGEDAPLRAGSGSGSGSVTAAVSRVLEAHRGPFRCVNLTRSSMGAHRAELALWLHLLAVKGVEEFVFVNRPWPLDFPLPATIFSLASVKRLYLGAWRFPDTSALPRGTAFPHLLELGLCCIAMEGRDLNFLLARSPILQTLVVYLSQKDVNLRIISRSLRCVQLCVSIVHDVSVVDAPRLERLLLWDTVSVDKVRTRIKFGHAPKLRSVGYLMPGVHVLEVGNTIIKAETRASPGTIVPSVKTLALEVHFGVRNEAKMIPCFLRCFPNIETLHIKSEETDQPAGKLNHKFWKENSSIECVQSHIREMVFHEYRGERSELAFLKFILENARVLQEMVILFVEGSLSSGDNAAAKLIKDLLSVKRAGNCRLVISESPIHRGGSRWSSQVASDLDVADPFYCCC

SEQ ID NO: 27724 - DNA, 555 bp, Panicum virgatum
  misc_feature: Ceres CLONE 1878776
  misc_feature: Encodes the peptide sequence at SEQ ID NO. 27725
accccacgacacagctcacgagggataacgccaaaccataccaaaaccctcctctcctctcccccacaacccaaaccctagccggctgcccccttgatgaccgccgccgccgctgtacatgctcaggctctccctcaccgtcattgacgccgccgccgccatgcccgcggcgctccggatcggcggctccccggcgccccgcctaacgcgccgcgccccgcggggagctcttgcaccggagctgagccccggtagcgcgacggcggtgaggataggaacgtaccccttcccggtggtggatggcctcccggcgggggtggagaacctctcgaccgtcaaggccaaggacgcatggaagatctccgccgccactttcgacaaaaccgtgatgcggcccggccagcaagccctcatcagggagcactcgccggacgccatcatcagcgatgggcacttcttctggaacaccgacatcgccgccaatctcggcgtgccgtgcatctctttccaagtcatcgcaaccttgcgcggcgaccgccatcacacacctcaggg

SEQ ID NO: 27725 - protein, 131 aa, Panicum virgatum
  misc_feature: Ceres CLONE 1878776
  misc_feature: SWISSPROT Homolog: EC 2.4.1.238 Anthocyanin 3'-O-beta-glucosyltransferase
MPAALRIGGSPAPRLTRRAPRGALAPELSPGSATAVRIGTYPFPVVDGLPAGVENLSTVKAKDAWKISAATFDKTVMRPGQQALIREHSPDAIISDGHFFWNTDIAANLGVPCISFQVIATLRGDRHHTPQ

SEQ ID NO: 27726 - DNA, 678 bp, Panicum virgatum
  misc_feature: Ceres CLONE 1878792
  misc_feature: Encodes the peptide sequence at SEQ ID NO. 27727
tggctgagctcagaacctgcctcacactcgctgctcgtcctcgcccgtccctttccctcccgctctccgttccctctctttccgggctctgactgacagtgacgaaccccatgggcgcggcggcgaggaagcggaagcccgcctcatctctgctgccaatctggctcaagtccacggccatctccaaggtccggctctacggcgtcgacgcggggctcatccgcgcgctggccggctccaacatctccgtcgtcgtcggcgtggccaacggcgacatcccctcgctggccgcggacccggccgcggcgtcgcggtggctcgccgccaacgtgctcccgttcgtcccggccacggccatctccgccgtggccgtgggcaacgaggtgctcgagtccggggacgcctccctggccgcggcgctgctcccggccatgcagaacctccgcgccgcggccgccgccgcgggcggcgccgccgcgggggtcaggttctccaccgtcaacaccatgggcgtgatggcgcagtcggacccgccgtccacgggcgcgttccacccggacatcgcgccgcagctgcagggcatcctgggcttcctcagcaagaccggctcgccattcatgatcaacccctacccgtggttcgcgtaccagtccgacccgcgcccggacacgctcgcct

SEQ ID NO: 27727 - protein, 189 aa, Panicum virgatum
  misc_feature: Ceres CLONE 1878792
  misc_feature (8)..(189): Pfam Name: Glyco_hydro_17 Pfam Description: Glycosyl hydrolases family 17
  misc_feature: SWISSPROT Homolog: EC 3.2.1.73 Licheninase
  misc_feature: Functional homolog of the protein sequence given in SEQ ID NO 51256
  misc_feature: Useful for making plants with altered carbohydrate content
  misc_feature: Functional homolog of the protein sequence given in SEQ ID NO 51257
  misc_feature: Useful for making plants with altered cell wall content and/or composition
MGAAARKRKPASSLLPIWLKSTAISKVRLYGVDAGLIRALAGSNISVVVGVANGDIPSLAADPAAASRWLAANVLPFVPATAISAVAVGNEVLESGDASLAAALLPAMQNLRAAAAAAGGAAAGVRFSTVNTMGVMAQSDPPSTGAFHPDIAPQLQGILGFLSKTGSPFMINPYPWFAYQSDPRPDTLA

SEQ ID NO: 27728 - DNA, 753 bp, Panicum virgatum
  misc_feature: Ceres CLONE 1878797
  misc_feature: Encodes the peptide sequence at SEQ ID NO. 27729
aggagaaaccctaccccgcgcagccgcagcccgccgccgccgccgccgccgcctcgtcgaactccggcgcgtgcccgaaccccgccagccgctgccaccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgagctcacgccagatgagcttgagcgcctcatgactgtggttgccaacccccgccagttcaaggtgcctgactggttccttaacaggaagaaggactacaaggatggtaggttctcccaggttgtttctaacgccctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtccaagcgccctgtattggcccatagcttgtgtcttgagtatgcaaacctttgtgccatgttttgcttgatatgtttatttcagtgttctgtgaaaaaacgatgaagttttgcctgtttggaaaagcatcctatgtcctttcgtgtcatggggtctgttgggccacagtgtttgatgagcagctgtt

SEQ ID NO: 27729 - protein, 152 aa, Panicum virgatum; identical to SEQ ID NO: 15321
  misc_feature: Ceres CLONE 1878797
  misc_feature (14)..(142): Pfam Name: Ribosomal_S13 Pfam Description: Ribosomal protein S13/S18

SEQ ID NO: 27730 - DNA, 710 bp, Panicum virgatum
  misc_feature: Ceres CLONE 1878800
  misc_feature: Encodes the peptide sequence at SEQ ID NO. 27731
gaatccccccacgcccgctcgaatccactcctccggggaatccaccacccgtccggtcgtcggcaagcatgtctgggcgcggcaagggtggcaaggggctcggcaagggcggcgcgaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgtaccctctacggcttcggcggctaggctgatgcgctccccccttagctgtctcccttctgcagcttcgacgttatctgggcggtgctcacaggtcttgcggtcaagaaagtctcagactcgcttgtttagctcatctctggctgtagtaggtttatctgaatcatgagacagtaatgaattgatgttaccttctgaaattgggagccaatcttgtcgtgcttacttgtgatttttctatcaaatggccggtgttctgtgctgtgtatctatttgatggattcttttacaatcacaagctaagcagttctattaaccttgtgacgattacaaaagcaaactggttgtgctggttcc

SEQ ID NO: 27731 - protein, 103 aa, Panicum virgatum; identical to SEQ ID NO: 12044
  misc_feature: Ceres CLONE 1878800
  misc_feature (25)..(94): Pfam Name: Histone Pfam Description: Core histone H2A/H2B/H3/H4

SEQ ID NO: 27732 - DNA, 622 bp, Panicum virgatum
  misc_feature: Ceres CLONE 1878807
  misc_feature: Encodes the peptide sequence at SEQ ID NO. 27733
aataagactcgatcccagtccagatcgtcgcagcagaggaatcccggggtcccggaccgactccatttccggccacgaggccaagatccatttcattccgcctttctttttcttggtgatctgatccagtcgcccccgttcgcgtccaatcctagcagcggcgcgtatcttcagccgttactgcgtacaatggcgctcaacctcgcgcaccagaccggcgcggcggcggccgtaacggcggccccggcggcgccgcgctcggcggtggtcgcggcggcctccaccgtcgcgccgtccgcgacggcgccctcgccggcgcccgcgctccaggcgcagacggtgacggtggacccggccccggcgcaggcggcggactcggtgaagccggacctggccatggtgtgccaggcgctggtggacggcaagccggaggcggagcacgcggacgtggccgccgaggtcaggagcaaggagggcgtgccggtgttcgtgatgatgccgctcgacacggtgcgcaaggacggcaacagcctgaaccggcggaaggcggtggaggccagcctggcggcgctcaagagcgccggcgtcgagggcatcatggtggacgtgtggtggggtatcg

SEQ ID NO: 27733 - protein, 144 aa, Panicum virgatum
  misc_feature: Ceres CLONE 1878807
  misc_feature: SWISSPROT Homolog: EC 3.2.1.2 Beta-amylase
MALNLAHQTGAAAAVTAAPAAPRSAVVAAASTVAPSATAPSPAPALQAQTVTVDPAPAQAADSVKPDLAMVCQALVDGKPEAEHADVAAEVRSKEGVPVFVMMPLDTVRKDGNSLNRRKAVEASLAALKSAGVEGIMVDVWWGI

SEQ ID NO: 27734 - DNA, 569 bp, Panicum virgatum
  misc_feature: Ceres CLONE 1878817
  misc_feature: Encodes the peptide sequence at SEQ ID NO. 27735
gaaatcacgcgcaaagccacctccgcgtcatcgtcgtcgtctcctctcctctccaagcaagcgaggcggccttgagatctcctactcctccgcgccgccatggacgccgtggactcggtggtcgacccgctccgggagttcgccaaggacagcatccgcctcgtcaagcgctgccacaagcccgaccgcaaggagttcaccaaggtggcggcgcggacggcgatcggcttcgtcgtcatgggcttcgtcggcttcttcgtcaagctcatcttcatccccatcaacaacatcatcgtcgggtcaggctgatccggtcccggcaggtgaggggctgcaggacctggcaatggcaacaataccttggaagcagttttcagccctatatcgtaaacaatcatttaggctttctttttgttaaggactgctccccctgttttgtctcgaaagattgtattggtacccttgaaactccttttgtaacctgatactgattaggcattggtgagctaacaggtgacaaaatccaatggttacagtttccctcacctgtttaccttgtcttcttggtt

SEQ ID NO: 27735 - protein, 69 aa, Panicum virgatum; identical to SEQ ID NO: 11942
  misc_feature: Ceres CLONE 1878817
  misc_feature (10)..(66): Pfam Name: SecE Pfam Description: SecE/Sec61-gamma subunits of protein translocation complex

SEQ ID NO: 27736 - DNA, 681 bp, Panicum virgatum
  misc_feature: Ceres CLONE 1878822
  misc_feature: Encodes the peptide sequence at SEQ ID NO. 27737
gaagcggcgacagagcgcctccctcccttccctacgaccctaccacccgctccgcgagagtccgaccgctcggcgctcgctcccaccacagaaatcccgccgctggtcagtgatatctccctccggcctccgcacccgccgcctgctcctcctcctcgcctcctcttcctcgccgcgaaaacaagaacccgcgcctttgcctgcttcggaatttttcggtagaagaggctcgtcctgtttatcatgtcaggaggatcagctggatcttcaccatcatcaaggcgggccagctttaattctttatctagagacctagaccttccttcagaacaagggtgtctatctattgttgtacttggggcttctggtgaccttgccaagaagaaaactttcccagcactctaccaccttttcgatcagggatttatacagtctggagaagtgcatatatttggttatgctagatcaaatctttctgatgatgggttaagagaacgcattcgtggatatctcaaaggagccacggaggaagatctttcagaatttttgcagttgataaaatatgtcagtggttcttatgacaatggggagggatttgagaaattgaacaaggcaatatcagagtatgaggcgtcaagcaaatcagaaagctatcgcaggctcttttatttggcattgccc

SEQ ID NO: 27737 - protein, 145 aa, Panicum virgatum
  misc_feature: Ceres CLONE 1878822
  misc_feature (36)..(145): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSAGSSPSSRRASFNSLSRDLDLPSEQGCLSIVVLGASGDLAKKKTFPALYHLFDQGFIQSGEVHIFGYARSNLSDDGLRERIRGYLKGATEEDLSEFLQLIKYVSGSYDNGEGFEKLNKAISEYEASSKSESYRRLFYLAL

SEQ ID NO: 27738 - DNA, 626 bp, Panicum virgatum
  misc_feature: Ceres CLONE 1878856
  misc_feature: Encodes the peptide sequence at SEQ ID NO. 27739
cggaaaaccgaccgcgtcttctcggctctctctggttgcgggcgcggtcgggaggctagggtttcgcggcgagatgtcggcgtacgacgaggtggagatcgaggacatggagtggaacgcggagctgaaggcgtacacgtacccgtgcccctgcggcgacctcttccagatcacgctcgaggacctccgcctcggggaggagattgcgcggtgcctctcgtgctccctcttcctcaccgtggtctacaacgccgaggacttcgccgacgccaaggagccgccccacaagccgggcccaagcccggtcgccgtcgcctgaggcggtcccccccgtgcgcggcgagatggaggcgttgaattgatctcagggcaggaaaagaaacgagatttgatgtttgacatccacgagagcatttgtacaactaccactacttagatgagtgggctcagaggcatactattaaagcttaggttgttataaattatctttttgtatgggtgacctactattgtaaggtggcataacaacttatgcttcaaatttttgtttgtgaattttcttgcctcgatctctctttagcaagatacaatcccaattcatcgtcagtatattcatccacattgcg

SEQ ID NO: 27739 - protein, 81 aa, Panicum virgatum
  misc_feature: Ceres CLONE 1878856
  misc_feature (5)..(59): Pfam Name: zf-CSL Pfam Description: CSL zinc finger
MSAYDEVEIEDMEWNAELKAYTYPCPCGDLFQITLEDLRLGEEIARCLSCSLFLTVVYNAEDFADAKEPPHKPGPSPVAVA

SEQ ID NO: 27740 - DNA, 608 bp, Panicum virgatum
  misc_feature: Ceres CLONE 1878859
  misc_feature: Encodes the peptide sequence at SEQ ID NO. 27741
agattcacatccactccgaagcctctcctggtcaggactgaccggcgatggagtggccatactccggcggcggcggaggcgaggatggcgcgtacatgacggtgccgtcagcgccgcccagtcgccgcgcggggtggaccaagttccaggagacgctgctcccggtgtactcgggcgtgcgcttgctgatccccgggcgctgggtctgcgagctgcgagagccgcacggcaggcgccgcaccaggatcggcaccttccagaccaccgacatggccgcgcgcgccctcgacgtctccgcgctggcgctgcacggcacggccacctgcctcaacttcgccgactctcctcgcacgctccgcatcccgccgcacggcgcccggcaccactacagacgccgcgccgcctggcacgccgccgacctcttccgcccgcggcgcaatgcctgctctcactacgcggccggcgccgccgtcatcgagacggactactcccaggccaccctctgcctccgcagccacatcacttacttcgcgccccacgacggcctgcacttcgaaatgcacgtctagctgtacatggtgcaggcgatgctgatcgacccgccggcg

SEQ ID NO: 27741 - protein, 173 aa, Panicum virgatum
  misc_feature: Ceres CLONE 1878859
  misc_feature (39)..(90): Pfam Name: AP2 Pfam Description: AP2 domain
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: Functional homolog of the protein sequence given in SEQ ID NO 51026
  misc_feature: Useful for making plants with modulated water use efficiency
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
MEWPYSGGGGGEDGAYMTVPSAPPSRRAGWTKFQETLLPVYSGVRLLIPGRWVCELREPHGRRRTRIGTFQTTDMAARALDVSALALHGTATCLNFADSPRTLRIPPHGARHHYRRRAAWHAADLFRPRRNACSHYAAGAAVIETDYSQATLCLRSHITYFAPHDGLHFEMHV

SEQ ID NO: 27742 - DNA, 880 bp, Panicum virgatum
  misc_feature: Ceres CLONE 1878871
  misc_feature: Encodes the peptide sequence at SEQ ID NO. 27743
atggcggggaagcagttcccctccctggcgcacgcgcgccccgcctccgcctcctcccgccggctcctcgccgccgcgggcgccctcgtcctcctctccgccgcctacttcctcctcctctcgccctcttcgccccgccccgccaccaccgtcctcgcgagccctagctccaccacctcctccttcctcgcctcgctcgagagcttcctcgccgccccgcacccttcagactccgcggccgctcccggcgacctcgatgcttcgatccgttcccaggaggaggcccggctcctcggggaccccgcgtggcccgcgcccgccgcggggccgctcagggtctacgtgtacgagatgccgagcaagttcacctacgatctgctgaggcgcttcagggactcgtaccgcaagactgaaaacctaacgtccaatgggagccccgtgcaccggctcatcgagcaggtgggcgtgcggtgagatcgaactgcaattttgttctgttttctcttgtcgaggtgatacgaggcgcctggttctagttctagatttggtcacgtggagtattggatttcggagattggggactttcgcccggatttgtgaaatatttaaaatcgtagcacattgcttcatgcggattgcttgctggttggagtgggataatcatacttttctattcttctctgcgatgcatctgctctctgatgctttaaaaaagcttggagaagttgctgaaatgggctgcttgcttgtatgctagatcccagagagttggtagatttttcattataccaagtctctgttgtgaggtgaatgtgatttagaccagagtaccgcatcttattcttaaagcagtttgagaatgccttttttgagtactatg

SEQ ID NO: 27743 - protein, 157 aa, Panicum virgatum
  misc_feature: Ceres CLONE 1878871
  misc_feature: Functional homolog of the protein sequence given in SEQ ID NO 51258
  misc_feature: Useful for making plants with altered carbohydrate content
MAGKQFPSLAHARPASASSRRLLAAAGALVLLSAAYFLLLSPSSPRPATTVLASPSSTTSSFLASLESFLAAPHPSDSAAAPGDLDASIRSQEEARLLGDPAWPAPAAGPLRVYVYEMPSKFTYDLLRRFRDSYRKTENLTSNGSPVHRLIEQVGVR

SEQ ID NO: 27744 - DNA, 723 bp, Panicum virgatum
  misc_feature: Ceres CLONE 1878899
  misc_feature: Encodes the peptide sequence at SEQ ID NO. 27745
gcagatcgatcgagcaccccaaacttgcacacaatcaccatcagttctagtagacaggacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacagaagcgccttgggcttcaaccagcatgcactgctgcctgaagggcaaacaatctagttgtacagctaacagttgctaggtttgcgctcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgcctttgccggaaataaatactgtatgtttgctgtaaagcctaagccattggccctctgggtgtatctgttg

SEQ ID NO: 27745 - protein, 71 aa, Panicum virgatum; identical to SEQ ID NO: 19463
  misc_feature: Ceres CLONE 1878899
  misc_feature (12)..(71): Pfam Name: potato_inhibit Pfam Description: Potato inhibitor I family

SEQ ID NO: 27746 - DNA, 702 bp, Panicum virgatum
  misc_feature: Ceres CLONE 1878931
  misc_feature: Encodes the peptide sequence at SEQ ID NO. 27747
gaaatcacctccgcacggcactacctctccgtcgcgaagcaaccgcagccgcggcggcttctccgtccccgagctcagccgccctctcttcctcttcccctcctccgaatcgtgttcgtccagctgtggtagtaggcggccggcggcgaggtacgtcctgctccctcctccctttctcagattgaaaccggaagagaagagaaggcaagaagagactcacccgtcgctacgaacaccaattcttgcagagaggaggcatgagaacccaagtgttcttcctcacattcgccttgctcgccgtgctcgggcaatcgagcaacaggcaccaccaccaccaccactcccatgttcagagcaaagggcatggagggggaggaggaggaggggagctagcgagccgggggaaggcggcggcgcgggcgtggccgtgctgcgacaactgcggcgggtgcaccaagtcgaacccggcgcagtgccggtgccttgacgcggcgccccgcgggtgccacccggcctgccgggactgcgtcaagtccagcctcagcgccgacccgccggtgtaccagtgcatggaccgcgtccccaacttctgctcccgccgctgctccgccgccgccgccgccgcccactgaccggccggctgagcggacgacaacgagtcgacgactcgttctgattgctgctgttgacccaccaactgtc

SEQ ID NO: 27747 - protein, 124 aa, Panicum virgatum
  misc_feature: Ceres CLONE 1878931
  misc_feature (58)..(84): Pfam Name: Bowman-Birk_leg Pfam Description: Bowman-Birk serine protease inhibitor family
MRTQVFFLTFALLAVLGQSSNRHHHHHHSHVQSKGHGGGGGGGELASRGKAAARAWPCCDNCGGCTKSNPAQCRCLDAAPRGCHPACRDCVKSSLSADPPVYQCMDRVPNFCSRRCSAAAAAAH

SEQ ID NO: 27748 - DNA, 724 bp, Panicum virgatum
  misc_feature: Ceres CLONE 1878934
  misc_feature: Encodes the peptide sequence at SEQ ID NO. 27749
accagccctcgtccgcaggccgccgcgcgcctggccccatccaggtctccgcccggcgccccgcgaggaggccgtccagtaggccgccgccctgcgccccgagcccgacatcgacgcctccaggaggcaagggcgccgagatgactcgcggcagccagagggagcgcgaccgcgagcgcgcggcggcgcggaagcccaacgccaaggggtcccaggacgggctcaccccggagcagcgccgcgagagggacaagaaagcgctggaggagaaggcggccaagaaggcgcagcaggcggcggccggcgccgccggtacctccacggacaacaagaacaagggtggcggcaagaagtaggcgccaccaacaggcgcggcgcaacctctgtacgattatcgatgcttaccttcgcatcttcgtagatgcgatgtttgttgggtcataaactcgttgtctgcgagcttttagctacctgatacatcatgagttggtgatgacaataataagtggtgatctggttttgtaggtcatgttttgttgcttttgtgttccgtgatctgtgtgactttgctgttgatggatcttttgagtatcataactagcatacagggcgcatgagctactgaactcttgccatctgtaaacaacagtctactagcatgcctgtaaacaacagtctactagcatgttgaaactggaaagtagattatgttgttgttttgcgt

SEQ ID NO: 27749 - protein, 71 aa, Panicum virgatum
  misc_feature: Ceres CLONE 1878934
  misc_feature (1)..(56): Pfam Name: 4F5 Pfam Description: 4F5 protein family
MTRGSQRERDRERAAARKPNAKGSQDGLTPEQRRERDKKALEEKAAKKAQQAAAGAAGTSTDNKNKGGGKK

SEQ ID NO: 27750 - DNA, 835 bp, Panicum virgatum
  misc_feature: Ceres CLONE 1878937
  misc_feature: Encodes the peptide sequence at SEQ ID NO. 27751
gggcaggatgggtactgtatcctttacccatgacctatcagtcgagctcgagcaagagatggagatggaggcggaggcgacatgcacggagcccaccccctcctgctgccatccacaactttcgcaggaatccatcgcccctagctcgctcgctcgcctcggtcgatccccaagacaagatttgttccgatcctctctctttatatccttccgacgacctgctgcctccgtccgcctcctccattccatcgccgcagccgcagtcaagtgccgctgccagtgagtgagctcgctctcctgttcattgcaaggttggtattgtcttggcgctagctgttgggcgaaagggatggagcaggcagagggggctgcgaccgcgaggagggcggagctccagctgctgcagcagctggagaaggaggagagcaaggggaagaggaagcgcggccgggtggagctgcggcggatcgaggaccggaccagccggcaggtgcgcttctccaagcggcggagcgggctgttcaacaaggccaacgagctctccgtgctctgcgacgcccgggtcgggctcatcgtcttctcccccgccggccgcctctaccagttcgcctcctctggctccaggggcatggaagcaaatgcggaggagatgagcatgactgagataagaaacttggaggaaacagtaacctacgctctggccgctattaggaataagctgaggatgaaggtggttgggttgccccaaacctaagattaggtctggaactagtttttgctgcaggaaaaaggaggagaagccctctgaagacgaaatgagggaccatcccggttc

SEQ ID NO: 27751 - protein, 134 aa, Panicum virgatum
  misc_feature: Ceres CLONE 1878937
  misc_feature (38)..(88): Pfam Name: SRF-TF Pfam Description: SRF-type transcription factor (DNA-binding and dimerisation domain)
  misc_feature: The sequence is a functional homolog of SEQ ID NO 919 in the 10/666,642 US patent application
  misc_feature: The sequence is a functional homolog of SEQ ID NO 32 in the 10/666,642 US patent application
  misc_feature: Functional homolog of the protein sequence given in SEQ ID NO 51259
  misc_feature: Useful for making plants with altered terpenoid content
  misc_feature: Useful for making plants with modulated flowering time
  misc_feature: The sequence is a functional homolog of SEQ ID NO 28 in the 10/666,642 US patent application
  misc_feature: Functional homolog of the protein sequence given in SEQ ID NO 50969
  misc_feature: Useful for making plants with altered alkaloid content
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 1701 in the 10/412,699 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 730 in the 10/666,642 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
MEQAEGAATARRAELQLLQQLEKEESKGKRKRGRVELRRIEDRTSRQVRFSKRRSGLFNKANELSVLCDARVGLIVFSPAGRLYQFASSGSRGMEANAEEMSMTEIRNLEETVTYALAAIRNKLRMKVVGLPQT

SEQ ID NO: 27752 - DNA, 602 bp, Panicum virgatum
  misc_feature: Ceres CLONE 1878940
  misc_feature: Encodes the peptide sequence at SEQ ID NO. 27753
gtgcgtatatatcagcagcagccgaggaggcttgggacctcccgccccctcgaagcaatcgactggaattggaaagaagcgagggacggacgagagcagcggcgccgtcgccatgggtctgcaggaggaatttgaggagcacgccgagaaggccaagaccttgcccgactctactacaaatgagaacaagctgatcctctacgggctctacaagcaagcaaccgttggtgatgtcaacacagggcgtcctggcttcttcgacccaaaaggcaaagctaaatgggatgcttggaaggctgttgaagggaagtccaaggaggaagcgatgactgattacatcaccaaggtgaagcagctgctggaggaggctgctgcatccacttcctaggctacgaaaacaccaccatccgtagtgctgcgtacatcaataagtaataaacattgttatctgtcagatggctctcggtctcaattgttggtcgtggtggatgttcagtgtcgtttacggctgtaaaactcttgtgaaaacaaatggatgctgtctcatctaagcactgtatggatcttcatctctgttatatctgcatccgcattttcatgcc

SEQ ID NO: 27753 - protein, 91 aa, Panicum virgatum; identical to SEQ ID NO: 14322
  misc_feature: Ceres CLONE 1878940
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase

SEQ ID NO: 27754 - DNA, 689 bp, Panicum virgatum
  misc_feature: Ceres CLONE 1878949
  misc_feature: Encodes the peptide sequence at SEQ ID NO. 27755
ctccgagctcgtgctctacaacctggtccccgccccccaaaccctaaacccttcccaaacccacgccgccgccgccgtctccggcgacctctccatctccaccaccgtcgctccgccgccacaggagcctctccgcatccgggcgcgtcgcccggtggggtcccccgccgaccgccacgccaaggtcgccggccgcggccgccgggtccgcatcccggccatggtggcggcgcgtgtcttccagctcacccgcgagctcgggcaccgcaccgacggcgagaccatcgagtggctgctccgccaggccgagccctccatcatcgccgccaccggcacgggcgtcacgcccgaggaggcgccccccgctcccgtccccgtctcccccgtcgcggccaccgcgtccctgatgcccataccatactacactgcgctccttatgcagccaccgccaaccgccgattccgcatccggctctggtaccgccgcactggagaataataactaggctaggtagaagatggcggttactatgattaggactctaatgttagttattagcttaggtttcttatgacgctctgtagccatggcaatggcatcccccaccgctcaataactaacatattaccttgggagatgctgtagcccgttgcttagattgtcagttaggtagagaatggatgagatgg

SEQ ID NO: 27755 - protein, 167 aa, Panicum virgatum
  misc_feature: Ceres CLONE 1878949
  misc_feature (36)..(151): Pfam Name: TCP Pfam Description: TCP family transcription factor
SELVLYNLVPAPQTLNPSQTHAAAAVSGDLSISTTVAPPPQEPLRIRARRPVGSPADRHAKVAGRGRRVRIPAMVAARVFQLTRELGHRTDGETIEWLLRQAEPSIIAATGTGVTPEEAPPAPVPVSPVAATASLMPIPYYTALLMQPPPTADSASGSGTAALENNN

SEQ ID NO: 27756 - DNA, 706 bp, Panicum virgatum
  misc_feature: Ceres CLONE 1878959
  misc_feature: Encodes the peptide sequence at SEQ ID NO. 27757
aggatttatcccctccctccgcgcgctctccgtcgtgtccgccatggccatggccacggctgcagccgtcctgccgtcctgcgccgccggtcccctctcccgagcacccgccccgctgccgcgcctcctcctctccatacagccctcccccgcgcgcagggacggctcccgcggctgcagcctcgccggcgccagcggcagcagagcgccaaccgttcgacggaacgccgccgccgagacggtggttccatacgtgccgggatccggcaagtacatcgccccggactacctcgtgaagaaggtgtcggccaaggaggtggaggagctggtgaagagggagaggaacgtgccgcttatcgtcgacttctacgcgacatggtgcgggccctgcgttcagatggcgcaggacatcgagatgcttgcagttgagtatgaggacaacgccctatttgtgaaggtggacactgatgacgagtatgaatttgcaaaagacatgcaggtaagaggacttccaacactgtatttcttcagtccagaccaaagcaaagaagccatacgcacggaggggctaattccaatggatatgatcagaagcataattgacaacgagctatgagcagctgataggcaaatagacacgtaggcactgttttttgtttgtagcggatgagattttctcagggacttaagtgtttaggaactagtt

SEQ ID NO: 27757 - protein, 188 aa, Panicum virgatum
  misc_feature: Ceres CLONE 1878959
  misc_feature (81)..(187): Pfam Name: Thioredoxin Pfam Description: Thioredoxin
  misc_feature: SWISSPROT Homolog: EC 1.8.1.8 Protein-disulfide reductase
MATAAAVLPSCAAGPLSRAPAPLPRLLLSIQPSPARRDGSRGCSLAGASGSRAPTVRRNAAAETVVPYVPGSGKYIAPDYLVKKVSAKEVEELVKRERNVPLIVDFYATWCGPCVQMAQDIEMLAVEYEDNALFVKVDTDDEYEFAKDMQVRGLPTLYFFSPDQSKEAIRTEGLIPMDMIRSIIDNEL

SEQ ID NO: 27758 - DNA, 709 bp, Panicum virgatum
  misc_feature: Ceres CLONE 1878961
  misc_feature: Encodes the peptide sequence at SEQ ID NO. 27759
gaccaaacaacagccgccgctgcagcgccgcccgcacacgcgcgcgcagatacctttcctctcccccgtcttctcctcccctcttcgccccttccgcctcggccggaacccggcggccggccggaccgcgcccgcgccatgaccagctcctcctcgtccccttcccggaaggcgctgagcaagatcgcgtgcagccgcctgcagaaggagctctcggagtggcaggtcaacccgcccgccggcttcaagcacagggtcaccgacaacctgcagaggtgggtcatcgatgtggctggggcgccaggcaccctctacactggcgagacgtaccagctgcaggtggacttccccgagcattatcccatggaggcacctcaggttatatttctgcacccggcaccaatgcatccacacatctacagcaatgggcacatctgtttagatatattgtatgactcatggtccccagcaatgacggtcagttctgtctgtatcagcatcttgtctatgttgtcaagctcgcccgcaaagcaacgcccagccgataatgatcgctatgtcaggaactgccgcaacggtaggtccccgaaggagactaggtggtggttccatgacgacacggtgtgatgggtgttccattggtgtttccttttggcagcagccccttcagttgccagactaccttacatgggagatgatttaggcttat

SEQ ID NO: 27759 - protein, 162 aa, Panicum virgatum
  misc_feature: Ceres CLONE 1878961
  misc_feature (20)..(159): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 51260
  misc_feature: Useful for making plants with modulated oxidative stress sensitivity
MTSSSSSPSRKALSKIACSRLQKELSEWQVNPPAGFKHRVTDNLQRWVIDVAGAPGTLYTGETYQLQVDFPEHYPMEAPQVIFLHPAPMHPHIYSNGHICLDILYDSWSPAMTVSSVCISILSMLSSSPAKQRPADNDRYVRNCRNGRSPKETRWWFHDDTV

SEQ ID NO: 27760 - DNA, 980 bp, Panicum virgatum
  misc_feature: Ceres CLONE 1879001
  misc_feature: Encodes the peptide sequence at SEQ ID NO. 27761
cttgcccattgagccgccgaacgcaggggcctctcgcccagcggccctgcgcgctcaccccgccgcctcagcccagccgcgcgcgctcgagctcgccccgcccccgcgctccgccgcccgggtcatcatcgtctcccgcaaaccctaccggacagtcgccatggcctccgcccgcgccgccctcctcctgcggcgccagtgcctcggcgccgccgcggccaacccgtacctcttctccgggcatggcctccgctaccgcaagctcgaggtcatcctcaccacgacgattgataagctggggaaagcaggggaggtggtgaaggtggctcctggccacttccgcaaccaccttatgcccaagatgctcgctgtcccaaacatggacaaattcgccatactcatccgagagcagcgcaagctctatcaacgtgaagaggaggtggtgaaagaagtcacaaaggaagatgatgatgctcggctacaggaagagagactgaagcagtaccaaacagcagcaaagcggctagataatgcactcttggtgttgaggcggtttatctcgactggaaacgaactgcgcactcctgtaacaaaagatgaaattgtctctgaggtggcaaggcaactcaacatcaacatccacccggacaatctgcatctgccgtcacctttgtcgtcccttggtgaatttgagctgccccttcgcttaccgcaggatataccacgcccagaaggcaagctacaatggactctgaatgtcaagatcaggagaaagtagtgcagtaattggggaaatttaattcaccaccccagccattctagctttcagattaagggacctatggaataggttttcagatcgaatgttttgctaatcagatataaccgatccgcaagcttccttccaggctttgtttttgctgcttgaacttcttgcccgtctttggacaggatgccatcaatggcgatatgatagttgg

SEQ ID NO: 27761 - protein, 205 aa, Panicum virgatum
  misc_feature: Ceres CLONE 1879001
  misc_feature (35)..(83): Pfam Name: Ribosomal_L9_N Pfam Description: Ribosomal protein L9, N-terminal domain
MASARAALLLRRQCLGAAAANPYLFSGHGLRYRKLEVILTTTIDKLGKAGEVVKVAPGHFRNHLMPKMLAVPNMDKFAILIREQRKLYQREEEVVKEVTKEDDDARLQEERLKQYQTAAKRLDNALLVLRRFISTGNELRTPVTKDEIVSEVARQLNINIHPDNLHLPSPLSSLGEFELPLRLPQDIPRPEGKLQWTLNVKIRRK

SEQ ID NO: 27762 - DNA, 648 bp, Panicum virgatum
  misc_feature: Ceres CLONE 1879003
  misc_feature: Encodes the peptide sequence at SEQ ID NO. 27763
atcagacagacactactgcttggcgcttgctctccaccgcctcctctcctagagctagagctccggttatcacacaccagcgcccgcccaccttcccgccgccggccggccgccaccgagcaagcatggatttggtctcgcagtccgagcacctgtgctacgtgcgctgcacctactgcaacaccgtgctcgcggttggggttccatgcaagaggctgatggacacggtgactgtcaagtgcggccactgcaacaacctctcctacctcagcccacggccaccgatggtgcagccgctctccccgactgatcaccccttggggccgtttcagtgtcagggaccctgcaacgactgcaggaggaaccaaccaatgccgctggcctcgccgacatcaactgaggccagcccgagaatgcccttcgttgtcaagcccccagagaagaaacaccgccttccatctgcctacaatcgcttcatgagggaggagattcagcgcatcaaagctgcaaagccagatatccctcacagggaggccttcagcatggctgccaagaactgggcgaagtgtgatccacgctgctcgacgactgtctctactgccacttccaacagcgctcctgagtctagagttgtgcccgctcctcagg

SEQ ID NO: 27763 - protein, 174 aa, Panicum virgatum
  misc_feature: Ceres CLONE 1879003
  misc_feature (1)..(148): Pfam Name: YABBY Pfam Description: YABBY protein
  misc_feature: Functional homolog of the protein sequence given in SEQ ID NO 51261
  misc_feature: Useful for biocontainment applications
  misc_feature: The sequence is a functional homolog of SEQ ID NO 1152 in the 10/666,642 US patent application
  misc_feature: Functional homolog of the protein sequence given in SEQ ID NO 51262
  misc_feature: Useful for making plants with modulated flowering time
MDLVSQSEHLCYVRCTYCNTVLAVGVPCKRLMDTVTVKCGHCNNLSYLSPRPPMVQPLSPTDHPLGPFQCQGPCNDCRRNQPMPLASPTSTEASPRMPFVVKPPEKKHRLPSAYNRFMREEIQRIKAAKPDIPHREAFSMAAKNWAKCDPRCSTTVSTATSNSAPESRVVPAPQ

SEQ ID NO: 27764 - DNA, 531 bp, Panicum virgatum
  misc_feature: Ceres CLONE 1879029
  misc_feature: Encodes the peptide sequence at SEQ ID NO. 27765
gaacagtggcaagagagagaagaggagaagagagtgcggcggaggcgatggcgagcggagggaaggggctgaacgcgaccggggagttcttccggcggagggacgagtggaggaggcacccgatggtggggaaccagctgcgccacgccacaccggggctcggcatcgccatcgtggccttcgggatctacctcgtgggcgaggccgcctacaaccgcatctaccgcccctccggcgaccaccaccactaggtggctgccgggatccgtgactccaaggtaaagtagctggagcaaactttaccaagttcattggtgttgtttttcttttaccagtttgagctcataaggtcagccatgaccatcatctagtttgtaaccatggagtcaaccactcgtgaaatgctgtgctttatggcatttgggaatggcattgttcttgtaatactcaactcaagcaaatctattgcatccatgtttgatttctgaaattggcagaggttctatatgtgaaattggcagtttcaatccg

SEQ ID NO: 27765 - protein, 67 aa, Panicum virgatum
  misc_feature: Ceres CLONE 1879029
  misc_feature: Functional homolog of the protein sequence given in SEQ ID NO 50542
  misc_feature: Useful for making plants with modulated flowering time
  misc_feature: Functional homolog of the protein sequence given in SEQ ID NO 50543
  misc_feature: Useful for making plants with modulated time to senescence
MASGGKGLNATGEFFRRRDEWRRHPMVGNQLRHATPGLGIAIVAFGIYLVGEAAYNRIYRPSGDHHH

SEQ ID NO: 27766 - DNA, 702 bp, Panicum virgatum
  misc_feature: Ceres CLONE 1879040
  misc_feature: Encodes the peptide sequence at SEQ ID NO. 27767
acgccactacgtggcgagagggctccgcgggtcgcccccatctccagctagctagcctcctccgcgacgacgatggaggttgccgccgaggctgccgcgccggcgcccgacgagggcgcgctggacgagcgcggcgcggcgctgcacctccccaggctggtgaccggcgtcgtctccggcgccctcaccggcatcttcgctctcgctggagccttgaccggggccgtcaccggcgccgtcgcggggagagcttcggacagcggcgtcctccggggagctggactgggggcgttcgccggagctgtgctctccatcgaggttcttgaggcttcgcgagcttactggtgctccgaccggctgggctcgcacggtgcatcctccatggctgatttcattgagcagctcattcaggcccggtttgtgcaacagcaattaacatcttcaggatatacatcatctcgctggcaggtcagcatatcagattttggtcatgatgacatgtacgacatttttggagacatttcatctaaagggctctcactagagtcattgaagaaactaccacattatgtggtcactgaccaaatgcgggactcctttggggaaatcttgtcttgccctatctgcctacaggaccttgtagccggtgagacagcgaggaggttgcccattgctctccactttccaccagccttgcgtgga

SEQ ID NO: 27767 - protein, 209 aa, Panicum virgatum
  misc_feature: Ceres CLONE 1879040
  misc_feature: Functional homolog of the protein sequence given in SEQ ID NO 50913
  misc_feature: Useful for making plants with altered carbohydrate content
  misc_feature: Functional homolog of the protein sequence given in SEQ ID NO 50914
  misc_feature: Useful for making plants with altered alkaloid content
MEVAAEAAAPAPDEGALDERGAALHLPRLVTGVVSGALTGIFALAGALTGAVTGAVAGRASDSGVLRGAGLGAFAGAVLSIEVLEASRAYWCSDRLGSHGASSMADFIEQLIQARFVQQQLTSSGYTSSRWQVSISDFGHDDMYDIFGDISSKGLSLESLKKLPHYVVTDQMRDSFGEILSCPICLQDLVAGETARRLPIALHFPPALR

SEQ ID NO: 27768 - DNA, 738 bp, Panicum virgatum
  misc_feature: Ceres CLONE 1879053
  misc_feature: Encodes the peptide sequence at SEQ ID NO. 27769
aagcagggcatgcattccttccttcttccccttccttccttgatccttctccatctctacacagccaggcagccagcgctaagtaacctcactcactggacactacatatcggccttgcacattgcttccagcttcctgctgcatccattagctaggacatccaggcattggtcgagcgagttgccgagaagaggagcgagtgagcgaggagccgtacgatggagggcatgaacgccggcatgtcgccgcggccgagcacggactggggccccatcatcgtggcggcgatccttttcgtggtgctctcgccggggctgctcttccagctccccgcgcggacgcgggtggtggagttcggcaacatgggcaccagcgccatcgccatcctggtccacgccatcatcttcttctgcctcctcaccatcttcgtcgtcgccatcggcgtccacgtctacgccgcctaggcccagccagctcgatcccccgggctgctttgacacggcgatggtctacggttttctgcagtctcatgtaatctgctgctcgctcgttttaatgaattggccggtggttttacactgttctataactcatttgagcagagacagtacagttgtcagttgagaatttagctgttcttgtacacgaaaacttcaatttggcttcttttgttttttttttttggcaacacaatgtttctgttggaaattagaggatgctgcttattttcgcttctc

SEQ ID NO: 27769 - protein, 81 aa, Panicum virgatum
  misc_feature: Ceres CLONE 1879053
  misc_feature: Functional homolog of the protein sequence given in SEQ ID NO 50117
  misc_feature: Useful for making plants with altered cell wall content and/or composition
MEGMNAGMSPRPSTDWGPIIVAAILFVVLSPGLLFQLPARTRVVEFGNMGTSAIAILVHAIIFFCLLTIFVVAIGVHVYAA

SEQ ID NO: 27770 - DNA, 742 bp, Panicum virgatum
  misc_feature: Ceres CLONE 1879056
  misc_feature: Encodes the peptide sequence at SEQ ID NO. 27771
ctcgcgaaaaccctagccgcacggtgcttcccttcgctctccaacccctcgaggtaatccattcgcagtcggccaagtcctcggagcgcgggagatggcggatcaggagacccctgttgcggttgaggcacctacccctgttctcggggagccgatggacttgatgactgccctgcagcttgtcatgaagaagtccagtgctcatgatggtcttgtgaagggccttcgtgaggctgccaaagccattgagaagcatgctgctcagctctgcgtgcttgctgaggactgtgaccagcctgattatgtcaaactggtgaaggcactgtgctccgagcacaatgttcatctggttaccgtgcctagcgccaaaactcttggcgagtgggctgggctttgcaagattgactctgagggcaaggcaaggaaggttgtgggctgctcctgtgtcgttgtcaaggactacggtgaggaatctgagggccttaacatagtgcaggagtacgtcaagtcccactaaatgcgacacactccggcgcctggagctttatgttcgacattctggacctcggtttgaaatttgtgcttggtaacggggcctgctaggatattagagcaattttcaagtgtgagccaaggagagatgtgaacgatttggacatctgaactcttgtttgaagagccgtgtcgtctgcttttaatataaatcatgaagagctggcattattcttgtctgtttcgcttg

SEQ ID NO: 27771 - protein, 140 aa, Panicum virgatum
  misc_feature: Ceres CLONE 1879056
  misc_feature (25)..(120): Pfam Name: Ribosomal_L7Ae Pfam Description: Ribosomal protein L7Ae/L30e/S12e/Gadd45 family
MADQETPVAVEAPTPVLGEPMDLMTALQLVMKKSSAHDGLVKGLREAAKAIEKHAAQLCVLAEDCDQPDYVKLVKALCSEHNVHLVTVPSAKTLGEWAGLCKIDSEGKARKVVGCSCVVVKDYGEESEGLNIVQEYVKSH

SEQ ID NO: 27772 - DNA, 740 bp, Panicum virgatum
  misc_feature: Ceres CLONE 1879067
  misc_feature: Encodes the peptide sequence at SEQ ID NO. 27773
  misc_feature (642)..(642): n is a, c, t, g, unknown, or other
catccatgggaacaatacacttggagtttatataacccttagaatgcgtctaagatgtgagatctttcggaatggaaaagcaatgcccggaaaagtgtttgatgtgctaaatgaagtcgttgttgatcggggttctaatccatacctgtcaaaaattgaatgttacgagcataaccaccttatcactaaggtgcaaggagatggtgtgatagtagcaacaccaactggcagtacggcatactctacagcagcaggggggtcaatggtccatccaaacgtcccatgcatgctgtttactccaatctgccctcactcgctgtcatttagacctgtcatccttccggattccgcacgtctcgaattgaagataccagatgatgcaagaagcaatgcctgggtatcgtttgatggcaaaagaaggcagcaattgtcaagaggagactctgttcatatatccatgagccagcatcccctcccaactgttaataaatctgaccaaactggtgattggttccgcagcctgatcaggtgtctcaactggaacgagagattggaccagaaggcgctatagacactaggtttttcttaaaaaattgttttgttgtacatatatagctttacacacgtattttttttccttcntacatgtacaatgcgtgtaccatcgacctagcacacaagcagcagtggcagcacgcgttacgacttacgaccccttcgtctgtgtacgaatctgctct

SEQ ID NO: 27773 - protein, 189 aa, Panicum virgatum
  misc_feature: Ceres CLONE 1879067
  misc_feature (1)..(163): Pfam Name: NAD_kinase Pfam Description: ATP-NAD kinase
  misc_feature: SWISSPROT Homolog: EC 2.7.1.23 NAD(+) kinase
IHGNNTLGVYITLRMRLRCEIFRNGKAMPGKVFDVLNEVVVDRGSNPYLSKIECYEHNHLITKVQGDGVIVATPTGSTAYSTAAGGSMVHPNVPCMLFTPICPHSLSFRPVILPDSARLELKIPDDARSNAWVSFDGKRRQQLSRGDSVHISMSQHPLPTVNKSDQTGDWFRSLIRCLNWNERLDQKAL

SEQ ID NO: 27774 - DNA, 496 bp, Panicum virgatum
  misc_feature: Ceres CLONE 1879075
  misc_feature: Encodes the peptide sequence at SEQ ID NO. 27775
cttacaagctcgaattgccgccatctacgtcaattcaccctgtttttcatgtgtcgcagctcaaacaggtcatcggtgatcaactggtttctgctcttcccagcgaccactctatcttcgcctttcccgagcgcatactgcaacggcgtgtcgcagctggtgatcggccggtactccaagggctgatcaagtggtccggtatgcctgcatcgctcgctacctgggaagccctagaggctcttcgtcaacattttccactggctccgacttggggacaagtcgattcccaagaggagaggggggtgttggcagcacaagtaaccaggagacggaagcaaccggccaggagcacggcccaagagtgaagaagcccaacaggaaggtcctcggcctagaatgggtgaacttagtatatgtattagctgagagagagacgagagcagggatgtatgaacactcaaactattccccaagtaatctgacctcctccgatccc

SEQ ID NO: 27775 - protein, 120 aa, Panicum virgatum
  misc_feature: Ceres CLONE 1879075
  misc_feature (40)..(93): Pfam Name: Chromo Pfam Description: 'chromo' (CHRromatin Organisation MOdifier) domain
YKLELPPSTSIHPVFHVSQLKQVIGDQLVSALPSDHSIFAFPERILQRRVAAGDRPVLQGLIKWSGMPASLATWEALEALRQHFPLAPTWGQVDSQEERGVLAAQVTRRRKQPARSTAQE

SEQ ID NO: 27776 - DNA, 676 bp, Panicum virgatum
  misc_feature: Ceres CLONE 1879091
  misc_feature: Encodes the peptide sequence at SEQ ID NO. 27777
acttctccttcctgcggcggcggccgatttgggggcaattcgccatagcagattggcaacgaaggggaggaagcaaccggcgattcgctccgagccgatctgattcgccatgaagcctttcaagaaggaattcaccttcgatgagaggctccaggaatccgccgccatgatcgccaactaccccgccagggtccccgtcatcgttgaaaggtattcaaggagtaatttaccagaaatggagaagaggaagtacctggttccctgtgacatgccagttgggcagttcattttcatactacggtccaggttacacctatctccaggaacagcgctatttgtgtttgtaaacaacactttgccccaaacagctagcctgatgggaagtgtatacgactcgtacaaggacaaggacggcttcctttacatgtgctacagcagcgagaagacatttggctgccctgcccctggcctgacctgacgtacaaatttgctttgcggccaggtagcccgtgcatgtgatcacctctgtacatatatcgtgctactccgtatgttatgtgatcaactctgtagatatagtatcttgctactccttatgttatgtgaataaactctgtacatattgatataacatcgtgctacatttgagaaatgatgtactacttgtgtagctgtc

SEQ ID NO: 27777 - protein, 122 aa, Panicum virgatum
  misc_feature: Ceres CLONE 1879091
  misc_feature (12)..(115): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
MKPFKKEFTFDERLQESAAMIANYPARVPVIVERYSRSNLPEMEKRKYLVPCDMPVGQFIFILRSRLHLSPGTALFVFVNNTLPQTASLMGSVYDSYKDKDGFLYMCYSSEKTFGCPAPGLT

SEQ ID NO: 27778 - DNA, 507 bp, Panicum virgatum
  misc_feature: Ceres CLONE 1879094
  misc_feature: Encodes the peptide sequence at SEQ ID NO. 27779
gttcgctcgcccacctcgccccgtctcctcccgcagtctcgctcgctcgcctttccccacacagctagggtttcgtcgccccgcgcgccgatccgccgcccgcccgccatgtcgaagcaaggagggaaggccaagccgctcaaggcgcccaaggtcgacaagaaggagtacgacgagagtgatcttgcatatctgcagaagaagaaagaggaggaaaaggcactcaaggatctgaaggccaaggcacagaagggtgcgatcggaggctctggcttgaagaaaagcgggaagaaatgagtctgtcatgcgtatctgggaaatgataaaccccctgccttatgtgctgtgtttggccatatgtgattgtaacaaactagtggttctgtgttagtaatgctgcagttggttgcttgatccgaaaagatgatgttggctatgatccgaaaacatggcattctaagatgttatctcaaattttctgtgctgattttgttttcattgccattt

SEQ ID NO: 27779 - protein, 62 aa, Panicum virgatum; identical to SEQ ID NO: 12608
  misc_feature: Ceres CLONE 1879094
  misc_feature (1)..(62): Pfam Name: TMA7 Pfam Description: Translation machinery associated TMA7

SEQ ID NO: 27780 - DNA, 872 bp, Panicum virgatum
  misc_feature: Ceres CLONE 1879141
  misc_feature: Encodes the peptide sequence at SEQ ID NO. 27781
aaacagtcagctactcatccatgctggacggtggacgcctttccctcatcgaccacaaactcgccggcaaggaagcttcacagccttctcgccagctcacctgcctgcagctcgccggctcgcgccgcccacaccggccgccgttgttggaccgcgatgcctctgcccgcactggtctccgctcgccggcctccgtccgcggctcgccggcttcaccgcctccaagcccgcgtcaactgccgcttcccggccgcgctgcctcgcctctgttttccacagcactgcctccgcgagcggctcgccggcgacactgcctcgcctccgttcgccgccgtcgtccctgaccaccacatcgcaggtcgcagcaatggcgggaaacgggctgaacgagttgaagcagatggtagcgcaggccaacggcagccctccgccgccagggacgcgtcttgtgtcgccatcgagctcgacgaggaggcccgcccccgcgttaaggccagcagcgagtggatccttggctgcatcgcccacggcggcgacatctacggtggcacctcgcagcgccgcaccaaggacaggcctgctctgtagatcgagctgctcagggacggacaggacgctggacaattcaggaggggataatcaaaactttagccacctgcgtggctggaggtggcatggggacggcgtggggctggaggtgctccgcggcgagggcaggcgagactgcgagaggtggcggcggcggcggcggcggcggcgggagagatggcgcagggagacagaagacagggacgagggtttcctcgaatccaaccagatttggattatcctctaaatttttatccaatagaatccaatcctattttctagcc

SEQ ID NO: 27781 - protein, 143 aa, Panicum virgatum
  misc_feature: Ceres CLONE 1879141
  misc_feature: SWISSPROT Homolog: EC 4.3.1.5 Phenylalanine ammonia-lyase
MPLPALVSARRPPSAARRLHRLQARVNCRFPAALPRLCFPQHCLRERLAGDTASPPFAAVVPDHHIAGRSNGGKRAERVEADGSAGQRQPSAARDASCVAIELDEEARPRVKASSEWILGCIAHGGDIYGGTSQRRTKDRPAL

SEQ ID NO: 27782 - DNA, 670 bp, Panicum virgatum
  misc_feature: Ceres CLONE 1879158
  misc_feature: Encodes the peptide sequence at SEQ ID NO. 27783
acgctcgagggctacgcgctcgacctcctcgccatcctccaggagctcggcgtcgactcctgcatctacgtcggccactccgtctccgccgtcatcggcgcgctcgcctccatctccaggcccgacctcttcaccaagctcgtgctcctctccgcgtccccgaggtacctgaatgatgtggactattatggaggctttgagcaagatgagcttgaggaactctttgaggccatgcgatcaaactacaaggcctggtgctcaggttttgcaccactttgtgttggaggagacatggaatcggtggcagttcaggagtttagccggacactattcaacatacgtccagacattgcactaagtgttgcccagacgatattccagagcgacgtgcgcagcctcctcccgctcgttagtgtcccatgccacatcattcaaagcacaaaggatcttgctgtgccagtcgtcgtgtctgagtacctgcacaagcacatcggcagtgattctattgttgaggtgatgccgtctgaaggccatctcccccagcttagctctccagacattgtcatccccgtcttgctccgacacattcagcatgatattgcagtctaggttggacaacgattcctccaagacgatgagcatccgaagctgtctactgtcagtgtttgta

SEQ ID NO: 27783 - protein, 202 aa, Panicum virgatum
  misc_feature: Ceres CLONE 1879158
  misc_feature: SWISSPROT Homolog: EC 3.1.1.1 Carboxylesterase
TLEGYALDLLAILQELGVDSCIYVGHSVSAVIGALASISRPDLFTKLVLLSASPRYLNDVDYYGGFEQDELEELFEAMRSNYKAWCSGFAPLCVGGDMESVAVQEFSRTLFNIRPDIALSVAQTIFQSDVRSLLPLVSVPCHIIQSTKDLAVPVVVSEYLHKHIGSDSIVEVMPSEGHLPQLSSPDIVIPVLLRHIQHDIAV

SEQ ID NO: 27784 - DNA, 633 bp, Panicum virgatum
  misc_feature: Ceres CLONE 1879179
  misc_feature: Encodes the peptide sequence at SEQ ID NO. 27785
actgcccgcgccgttccgggttttctccccaccctccgccgccgccgcctcagccggtcccgccggagcgcagcgcgcgctgatctacagacgccgcgcgcccctcgcgggagcgctcctgttcttctgcatcggcgctgtgcatcgccgccgtcgcctgcgggacggggtgctccttgacccaccgccgcctcccattcctcggggcaagaggactcagctctgctcgaatggagtctgcccaccaccgtgccttccattgttgtatatgttacggttccaagatagagaagcaggcaagaagctgtcacagagcattatcatccagaatcttgctgcttgtgtcaatatactacctggcattgagtctgtttactggtgggagggaaaggtgccatctgatgctgaacaattgctcatcataaagacgagggaatcacttctacatgccttgaccgagcatgtcaaagccaaccatgaatatgatgttcctgaagtcatttctctgcccataacctgcggtaacagcaagtacctggaatggatcaagaacagcacccgggaaaactgatctgttttacagccctgagtgtgtaatgcacatcaaaacacccatgaatatgaagtgatggc

SEQ ID NO: 27785 - protein, 189 aa, Panicum virgatum
  misc_feature: Ceres CLONE 1879179
  misc_feature (93)..(187): Pfam Name: CutA1 Pfam Description: CutA1 divalent ion tolerance protein
LPAPFRVFSPPSAAAASAGPAGAQRALIYRRRAPLAGALLFFCIGAVHRRRRLRDGVLLDPPPPPIPRGKRTQLCSNGVCPPPCLPLLYMLRFQDREAGKKLSQSIIIQNLAACVNILPGIESVYWWEGKVPSDAEQLLIIKTRESLLHALTEHVKANHEYDVPEVISLPITCGNSKYLEWIKNSTREN

SEQ ID NO: 27786 - DNA, 668 bp, Panicum virgatum
  misc_feature: Ceres CLONE 1879248
  misc_feature: Encodes the peptide sequence at SEQ ID NO. 27787
gagcgccttccccgcccttagcaccacccacccaaacccctccgccgccgcgatgagctactacggccagcagcagccgcccgtcggcgtgcctcccccgcaagggtaccccgggaaggacgcgtacccaccggcgggctaccccccgccggcgcagggctacccaccgcaggggtacccgcccgcggggtaccctccgcagcaggggtacccgcagcagggctacccgccgccgtacgcgcagccgccgccgccgcagcgcccgcagagcagcggagggccctccttcatggagggatgcttgaccgccctttgctgctgctgcctgttggaagcctgcttctgagttctaggatacagcaacttgctcagcaattctgctgcgcgctcttcatataatcgggattgggttgtgaagcctgcttcttagatatgaagaatacagcaactcttatgcaaatcacatcgctccgtcctcttatcgatctgttcctccgttgagatgattgggtgtacttagtggtatcatgaagtttatgtcagtggaatccttggtctagctagcattgtgagatattttcctctctttagctagtgcattttggtccgcggcattgtcttcttccgtgtgggatgtctataatctttttaatttttttcatcactct

SEQ ID NO: 27787 - protein, 97 aa, Panicum virgatum
  misc_feature: Ceres CLONE 1879248
  misc_feature: Functional homolog of the protein sequence given in SEQ ID NO 50362
  misc_feature: Useful for making plants with altered cell wall content and/or composition
MSYYGQQQPPVGVPPPQGYPGKDAYPPAGYPPPAQGYPPQGYPPAGYPPQQGYPQQGYPPPYAQPPPPQRPQSSGGPSFMEGCLTALCCCCLLEACF

SEQ ID NO: 27788 - DNA, 763 bp, Panicum virgatum
  misc_feature: Ceres CLONE 1879261
  misc_feature: Encodes the peptide sequence at SEQ ID NO. 27789
acacccccacacggccccgcacccaccttgagtcgccgccccccgtcgcgaaccccgcacccgatccccaaatccccccggcggcgatggcggccagcttgtggcgggccgtgatggacagcgtcagcgggtcctcctcctccccgtcggcgcccgacgcggcgtccggcggggtcgagttctggcacggggccgagcgcgcggggtggctcaacaagcagggcgagtacatcaagacgtggcggcgccgttggttcgtgctcaagcaggggcgcctcttctggttcaaggaccccgccgtgacgcgggcctccgtgccccgcggcgtcatccccgtcgcctcctgcctcaccgtcaagggcgccgaggacgtgctcaaccgccagttcgccttcgagctctccacccccgccgagaccatgtacttcatcgccgactccgagaaggagaaggaggagtggatcaactccatcggccgctccatcgtccagcactcctgctccatcgcagacgccgaggtcgtcgactacgacagccgcccccaggcaacgacgcagcccaaggacagccaagagaccgagccggcagcgtagcatcgcggtgatccctgtgaatctctcgatatggctctcaattgtagtatatgtacttccaagtgattgtgggctttgttccttcactcttaattatatatatatatattaactatcaatgacttggtgtggtaataaatggtaatttcgtgctttgttttttatatact

SEQ ID NO: 27789 - protein, 168 aa, Panicum virgatum
  misc_feature: Ceres CLONE 1879261
  misc_feature (36)..(134): Pfam Name: PH Pfam Description: PH domain
  misc_feature: SWISSPROT Homolog: EC 2.7.11.1 Non-specific serine/threonine protein kinase
MAASLWRAVMDSVSGSSSSPSAPDAASGGVEFWHGAERAGWLNKQGEYIKTWRRRWFVLKQGRLFWFKDPAVTRASVPRGVIPVASCLTVKGAEDVLNRQFAFELSTPAETMYFIADSEKEKEEWINSIGRSIVQHSCSIADAEVVDYDSRPQATTQPKDSQETEPAA

SEQ ID NO: 27790 - DNA, 605 bp, Panicum virgatum
  misc_feature: Ceres CLONE 1879286
  misc_feature: Encodes the peptide sequence at SEQ ID NO. 27791
atccctgtctcctcttctccactcgccattcctgagctagcgcacgttatgttcaggtaacacaaccgcctccctagtttagcattgccctcccctctcccccctcccccttcaatgtcccccgcagtgccgaatttccttcgcctccgaggccggtaatcggcggcgctgatgccggccagggccggcaggaatcgcgcgcagggcatgcggtgcgactacatcagctcgccccaccaccagatggtggcggtggctacgacgcttatgctggtggctgggcggttcgggctggcgccatctgcgaaccagaaggcgacagaggagctgaacctcgagtcccgcgactcccgcctgcggagcggcgaacccgccggattcacgctcgccgacgccctggcctgcggcgccgtcggacacatcctcggcgtcggcgtcgtgctcgggctcgagaacaccgtcccactccaccagatcataggatacgtccaatgtctgcctttgccgctctctgcgccggaccggtgaccatgtaacctgcgtgtgtacatccgctccgcgctcatgcatctccttccaatggacatatcttgtttgttgctcac

SEQ ID NO: 27791 - protein, 118 aa, Panicum virgatum
  misc_feature: Ceres CLONE 1879286
  misc_feature (19)..(99): Pfam Name: PSI_PSAK Pfam Description: Photosystem I psaG / psaK
MPARAGRNRAQGMRCDYISSPHHQMVAVATTLMLVAGRFGLAPSANQKATEELNLESRDSRLRSGEPAGFTLADALACGAVGHILGVGVVLGLENTVPLHQIIGYVQCLPLPLSAPDR

SEQ ID NO: 27792 - DNA, 488 bp, Panicum virgatum
  misc_feature: Ceres CLONE 1879287
  misc_feature: Encodes the peptide sequence at SEQ ID NO. 27793
tgagaaacgcacactacctcaaagatcgcctcaaggaagcaggaatcggagcgatgcttaatgagctcagcagcacagttgtgtttgaaaggccaaaggatgaggagtttgtccgaaggtggcagcttgcctgcgaggggaatatagcccatgttgtggtaatgcccagtgtcaacattgacaagttagactatttcctgaatgaactagtggagaagcgggcgacctggtacaaggatggaataagtaaacccccctgcattgccagagacttgggcgaggagaactgcctctgtggccttcacaagtagtttgaggctgtgagccttttagcaacaggggggggggggggggcgttcattcgtgagttgagttagccctctctaatgggttatgttgtatacttgtactgtatccatgcgtttctgtatgtgataatgtggcctgctgtgtagcttatttgttgtcatgaataaattccttctatc

SEQ ID NO: 27793 - protein, 102 aa, Panicum virgatum
  misc_feature: Ceres CLONE 1879287
  misc_feature: SWISSPROT Homolog: EC 4.1.1.22 Histidine decarboxylase
RNAHYLKDRLKEAGIGAMLNELSSTVVFERPKDEEFVRRWQLACEGNIAHVVVMPSVNIDKLDYFLNELVEKRATWYKDGISKPPCIARDLGEENCLCGLHK

SEQ ID NO: 27794 - DNA, 1036 bp, Panicum virgatum
  misc_feature: Ceres CLONE 1879306
  misc_feature: Encodes the peptide sequence at SEQ ID NO. 27795
gcgcagcggtgtactgcatcctttagtcggcattgaagtgccctggtgcagcatgacgcttagactcttggctgaagtgagtcaacaggacctgctggtagctctttcagagctccaaaaccacctgctgggttacgcatccccgacgccatccatcgccgcggtggtgccgccaccctcgccgacattgtagccgacaccgagatacatccagcaaaggtccctgacctcaagcgcatgatggaactgctcagcacttcgggcatcttcacagccaccgccgcaaagggcagcggtggcagcggtgatgtcgtgtacggcctaacgacggcgtgctacttccttgtcggtcggtgcaacctgtcacctgtggtgccgtacttggtgagccctcacatcgtgtcctccttcttcggcatgtctgactggttcaggaaggagccggcggtcgctggcggatccctcttcgagctggcacacggctgctccctgcaggagatggcgagcaaggacgctgcgtttagcagcctcctgaacgactccatggcatctgacagccagctcttcctagaggggaactgctctgattaggaaggagaaggatcaaacactgttgctgtacgaggatgtgagctgggtcggcaagggaaggggaacgagtgcggcggagacgatgccttgtgaacgagtggatggggccccggacgcttttggacttggatagagcctccgttgatattttttgttttccttttttatgaattctttttttttgttgattggtcccacatgaactagtgctcagcctgccagtacagtaccctatagggcctatatttaccattaatttgggaaaaattttgaatcatagatgggcttttattttaaaacggagggagtatgtaacattagatcctatattgcatgccttgaatctaagcactatagaaaacattggcgcggctttgccgtgctcgtggagctagccagctttgattttttatgtcaataaattatggtattgataagttcgcgc

SEQ ID NO: 27795 - protein, 117 aa, Panicum virgatum
  misc_feature: Ceres CLONE 1879306
  misc_feature: SWISSPROT Homolog: EC 2.1.1.68 Caffeate O-methyltransferase
MMELLSTSGIFTATAAKGSGGSGDVVYGLTTACYFLVGRCNLSPVVPYLVSPHIVSSFFGMSDWFRKEPAVAGGSLFELAHGCSLQEMASKDAAFSSLLNDSMASDSQLFLEGNCSD

SEQ ID NO: 27796 - DNA, 827 bp, Panicum virgatum
  misc_feature: Ceres CLONE 1879326
  misc_feature: Encodes the peptide sequence at SEQ ID NO. 27797
cactccgggcccccaatacaaaacgctcgagagtccgtaaccctaaacccccaaaccctcctcgcctcctccgtccatccatccatccaaatcctcggggcgagcgagcgcggagagagagggattcgcaacgagatggcggcggtggctagggttttccgcgggtcccggttcctcatgtccccggcgccgggcgcggctgcggcggcgggggcgaagaaggcggcggcgccacaggtcaccaaggcggacgcgacggcggcgaaggagaagcgcgggatcttgaagccggtgccggtctccgaggagatgcgcaggttcgccggcggcaagcccgaggtcgcccgctccgaggccgtcaagctcatctgggcccacatcaaggccaacggcctccagaacccggccaaaaaaacagagatcaactgtgatgccacactcaaaagcttgtttggtgggagggacaagattgggatgctggagatctcgaaactactgaaccctcacttcctgaagaactaacagaagcagcagatggcgccaatgatggtgctttcgtctaagactttattggatggcctcttttgtgatccatgttaagtccagctccccactaggtagttgagccaaagttgtgtcatggtgtcaagacttcagactttgtgttcagcagttgggtttggggtgtgatgcatgtaaaaaggattcccagtgttattgctgctcttgtgatcctgtgagggcaccttcgtgcaaattgatgtgggaaatgttagtctgctgatggcacatcttagtcgcatgtttatgcccgccttattgcagtt

SEQ ID NO: 27797 - protein, 128 aa, Panicum virgatum; identical to SEQ ID NO: 13568
  misc_feature: Ceres CLONE 1879326
  misc_feature (49)..(126): Pfam Name: SWIB Pfam Description: SWIB/MDM2 domain

SEQ ID NO: 27798 - DNA, 721 bp, Panicum virgatum
  misc_feature: Ceres CLONE 1879331
  misc_feature: Encodes the peptide sequence at SEQ ID NO. 27799
ctcttgctcttgcttgcccggcggcgacgactgggcgagcagcgtcgacatttgtcacgtcttcgccccaccctttgccggcgacgagcatccaccaggtggtcagtaagatgattaatcttttcaaaataaagggtcaaaagaaagaagaggcggcaagtgctgctggaaaggcccctgttaagaagcagtctgctggggagctccgcctccataaagatattagtgagctcaacttaccgaagactacatcaatttcttttcctaatggcaaggatgatctaatgaattttgagatcatcatccgacctgatgaaggatattatatgggaggcactttcattttcacctttcaagtgtccccatcttatcctcatgaacctccaaaggtcaagtgcaagaccaaggtgtaccatccaaatattgatttggaaggcaatgtatgtctgaacattctgcgtgaagattggaagcctgttcttaacatcaacactgttatttatggcctgaatcttcttttcacgcaaccaaacgacgaggatccattgaaccacgaagctgcagttgtcctccgtgacaacccaaagatgtttgaggcaaatgttaaaagggcgatggctggaggctacgtaggccaaaactatttcccaagatgtgcttgacttggcgctgggtgcgaaacgatttctagtgccgccctgcgcgactgggcccctgtatc

SEQ ID NO: 27799 - protein, 183 aa, Panicum virgatum
  misc_feature: Ceres CLONE 1879331
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKEEAASAAGKAPVKKQSAGELRLHKDISELNLPKTTSISFPNGKDDLMNFEIIIRPDEGYYMGGTFIFTFQVSPSYPHEPPKVKCKTKVYHPNIDLEGNVCLNILREDWKPVLNINTVIYGLNLLFTQPNDEDPLNHEAAVVLRDNPKMFEANVKRAMAGGYVGQNYFPRCA

SEQ ID NO: 27800 - DNA, 609 bp, Panicum virgatum
  misc_feature: Ceres CLONE 1879356
  misc_feature: Encodes the peptide sequence at SEQ ID NO. 27801
taaacgaattagagcagtttttgataaggttgatatcaaggattcggagtctgtggttgtgaggataactggttgccctaatggatgtgctaggccatatatggctgagcttggctttgttggtgatggcccgaaaagttaccagatctggctgggaggaacaccaaaccagagtaccctagcagaatcatttatggataaagtgaagcttgatgacatcgagaaggttgtagaacctctgttctcctattggaatagtacacgccaagaaggtgaatcgtttggaagcttcacaaaccgaacaggattcgacaaattgaaagaggtagtggacaagtgggcagagtcaccatcagccgcataaaggatcgcttttgtcagataaaattcctggctcgtagcacaatttttggctccgggattaaagcgtgccgaaaggctctccagataaacgagaaaagaggttgtcaaccccgttggcaatagaaaacgaatgctcgtttaggatttgttatgcttgttgggttgtgtgatcaaaacaattttgcgtgtactttgaaggaaagcctatgttgacttgaataaattcctcgcaaagttgtggctgag

SEQ ID NO: 27801 - protein, 120 aa, Panicum virgatum
  misc_feature: Ceres CLONE 1879356
  misc_feature: SWISSPROT Homolog: EC 1.8.7.1 Sulfite reductase (ferredoxin)
KRIRAVFDKVDIKDSESVVVRITGCPNGCARPYMAELGFVGDGPKSYQIWLGGTPNQSTLAESFMDKVKLDDIEKVVEPLFSYWNSTRQEGESFGSFTNRTGFDKLKEVVDKWAESPSAA

SEQ ID NO: 27802 - DNA, 720 bp, Panicum virgatum
  misc_feature: Ceres CLONE 1879359
  misc_feature: Encodes the peptide sequence at SEQ ID NO. 27803
acgcggcctcagaagtcaacactcccggtaggttccggaggttcggtggctccggagagacaggcggatagcgagcgtatggccggccacttcgtcctcaacaccggcgccaagatcccggcggtcgggctcggcacctggcaggccgaccccgccgtcgtcggcgacgccgtctacgccgctgtcaaggtcggattgggtctcaagaaagcgctcgatgagggcatagtcaagcgtgaggatctcttcatcacctccaagctctggaacaccaaccatgcgccagaggacgttccagttgcgctggacggcacgctgaaagccctgcagacggactacgtggatctttacctcgtccattggccggtgaccatgaagaaaggcgctggttatggcccgcaaagcattatcccgtcagatatcccggcgacctgggcggcgatggagaagctgtacgacgccggcaaggcgcgcgccatcggcgtcagcaacttctcgagcaagaagctggcggacctgctcgccgtggcgcgcgtgcccccggccgtcaaccaggtggagtgccaccccgtgtggcagcagggcaagctccgcgccttctgccagtccaaagggatacacctctcggcctactcgccgttgggctcgccgggcacgacgatcgtgaaggtgagggcgggcgcggtgctggagcacccggtggtcgtgtcggcggcggag

SEQ ID NO: 27803 - protein, 213 aa, Panicum virgatum
  misc_feature: Ceres CLONE 1879359
  misc_feature (7)..(213): Pfam Name: Aldo_ket_red Pfam Description: Aldo/keto reductase family
  misc_feature: SWISSPROT Homolog: EC 1.1.1.21 Aldehyde reductase
MAGHFVLNTGAKIPAVGLGTWQADPAVVGDAVYAAVKVGLGLKKALDEGIVKREDLFITSKLWNTNHAPEDVPVALDGTLKALQTDYVDLYLVHWPVTMKKGAGYGPQSIIPSDIPATWAAMEKLYDAGKARAIGVSNFSSKKLADLLAVARVPPAVNQVECHPVWQQGKLRAFCQSKGIHLSAYSPLGSPGTTIVKVRAGAVLEHPVVVSAA

SEQ ID NO: 27804 - DNA, 682 bp, Panicum virgatum
  misc_feature: Ceres CLONE 1879372
  misc_feature: Encodes the peptide sequence at SEQ ID NO. 27805
aatcggctaatccccgcccccatcgagtctctcccccatccccctcccgaaaccggattcgcggtctagcagccgagtcggcacgccggcgcgggcggccatggaggacgaggagcacgaggtgtacggccaggagatccccgtcgacggcgaggacgtcgacatgtccggggccggcgacgacgccgccaagctgcaggagctcgacgagatgaagcgccgcctcaaggagatggaggaggaggcggccgcgctccgcgagatgcaggccaaggtcgccaaggagatgcaaggtgtagatcctaatgcaaccacatctgaaaacaaagaggagatggatgctcggtcagtattcattggaaatgttgattatgcctgcactccagaagaagtacagcagcacttcaattcttgcggaactgtcaacagagtgacaatactgactgacaagtttgggcagcctaaaggttttgcttatgtggaatttgttgaagttgaagctgttcaggaagctattaagctgaacgagtcagagttgcatggccgccaactcaaggtggcaccaaagaggactaatgttcctgggatgaagcaaccccgcggccgaggtttcaatccttaccatggccacccctacatgaggccatatggttatagtccctatggctatgggcgattcccc

SEQ ID NO: 27805 - protein, 193 aa, Panicum virgatum
  misc_feature: Ceres CLONE 1879372
  misc_feature (84)..(153): Pfam Name: RRM_1 Pfam Description: RNA recognition motif. (a.k.a. RRM, RBD, or RNP domain)
MEDEEHEVYGQEIPVDGEDVDMSGAGDDAAKLQELDEMKRRLKEMEEEAAALREMQAKVAKEMQGVDPNATTSENKEEMDARSVFIGNVDYACTPEEVQQHFNSCGTVNRVTILTDKFGQPKGFAYVEFVEVEAVQEAIKLNESELHGRQLKVAPKRTNVPGMKQPRGRGFNPYHGHPYMRPYGYSPYGYGRF

SEQ ID NO: 27806 - DNA, 740 bp, Panicum virgatum
  misc_feature: Ceres CLONE 1879373
  misc_feature: Encodes the peptide sequence at SEQ ID NO. 27807
gcagatcgatcgagcaccccaaacttgcacacaatcaccatcagttctagtagacaggacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgagaagcgccttgggcttcaaccagcatgcactgctgcctgaagggcaaacaatctagttgtacagctaacagttgctaggtttgcgctcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgcctttgccggaaataaatactgtatgtttgctgtacagcctaagccattggccctctggttgtatctgttgatatagtagtggcttcctgttgtttggccttttgt

SEQ ID NO: 27807 - protein, 87 aa, Panicum virgatum; identical to SEQ ID NO: 18987
  misc_feature: Ceres CLONE 1879373
  misc_feature (12)..(71): Pfam Name: potato_inhibit Pfam Description: Potato inhibitor I family

SEQ ID NO: 27808 - DNA, 567 bp, Panicum virgatum
  misc_feature: Ceres CLONE 1879385
  misc_feature: Encodes the peptide sequence at SEQ ID NO. 27809
tcggctatccgcttcccccccttccggttctcactccccccacccccctgcggaggcgcatgaagagggggaagcgaagcggaggccatccgatgtcggcgacgacggcggccgtgcccttctggcgcgcggcgggtatgacctacgtcggctactccatcatctgcgccgcgctggtgcggatctgcctcaaggagcccttcgagtccgaggccgcgtcccgcgagaaggtccccttctccgtcgccgagtggacggacggccagctggataagcccgctgtccgcgcggagtctgatgattaaaaatctggtgacctgatgactgtcctttctatacatgttgtgttttgagatgatgttgctagatttggagcttgctgtttatctggcttgattttctggtccccactgaagaataaatgcttttttcaacctgtgatctttttcagcattgccgtgtcgttactgtttatccttgctcttgctgtactctcaatccatcgtgtgaacttgcagaagtttgtgcagtttgtgatctgatatagtactggctatctcagatttg

SEQ ID NO: 27809 - protein, 70 aa, Panicum virgatum
  misc_feature: Ceres CLONE 1879385
  misc_feature (9)..(57): Pfam Name: ATP-synt_Eps Pfam Description: Mitochondrial ATP synthase epsilon chain
MSATTAAVPFWRAAGMTYVGYSIICAALVRICLKEPFESEAASREKVPFSVAEWTDGQLDKPAVRAESDD

SEQ ID NO: 27810 - DNA, 656 bp, Panicum virgatum
  misc_feature: Ceres CLONE 1879394
  misc_feature: Encodes the peptide sequence at SEQ ID NO. 27811
aaaaggcgaagcgtcgaatcgaaatcgaggccagcgaggcggcggcgaagggggagtgccggcggcgaggggcccacgcgtcagggacagagcgggggagttcctcaccaccggcgggcgatggatatggcgccctcctcctcctcctccggtggcggcggcggcggcggcggcgccgacccgatggcgctcgtgcaggggtacacgagcgaggagctggccatcgcgggggagttcctcgtctcctcccaaatcgccctagcatcagagctcctccgccgacgccgccatgggtaaggttcacgggtcgctggcccgcgctgggaaggtgcgtggtcagacgcccaaggtggcgaagcaggacaagaagaagaagccccgcggccgcgcctacaagcgcatgcagtacaaccgccgcttcgtcaccgccgtcgtcgggttcggcaagaagcgcggccccaactcctccgagaagtagatctagctaggcccagccgcctgattcatacgcttgtgttcttggcaccttcgtcttcttttttgttccaagtagtttcgttcgagtaatcaaggttttggtgatgtactgatgaccagttgaagacctaagctatgttgctgcaatccaattaagtatgatatgcatcgtttactgc

SEQ ID NO: 27811 - protein, 62 aa, Panicum virgatum; identical to SEQ ID NO: 10043
  misc_feature: Ceres CLONE 1879394
  misc_feature (3)..(61): Pfam Name: Ribosomal_S30 Pfam Description: Ribosomal protein S30

SEQ ID NO: 27812 - DNA, 387 bp, Panicum virgatum
  misc_feature: Ceres CLONE 1879438
  misc_feature: Encodes the peptide sequence at SEQ ID NO. 27813
ttcctcaagaacggcgacgctgggttcgtcaagatgatcccgaccaagcccatggtggtggagacgttctccgagtacccgccgctggggcggttcgctgtgcgcgacatgaggcagacggtggctgtcggcgtgatcaagagcgtggagaagaaggacccaacgggagccaaggtcaccaaggctgctgccaagaagaaataaacggtcgatccgtggatgttattatgacatcgcatagctagtggagttattttggctagaaaagtttgcattacagttattatattgtcggacaagtttggttgtttgggtctcgcagtgtttatttttacagtatgtgtcagtgtcagtttccagaatcaatatatctgttatgtttttttt

SEQ ID NO: 27813 - protein, 67 aa, Panicum virgatum
  misc_feature: Ceres CLONE 1879438
  misc_feature (1)..(50): Pfam Name: GTP_EFTU_D3 Pfam Description: Elongation factor Tu C-terminal domain
  misc_feature: The sequence is a functional homolog of SEQ ID NO 576 in the 10/666,642 US patent application
FLKNGDAGFVKMIPTKPMVVETFSEYPPLGRFAVRDMRQTVAVGVIKSVEKKDPTGAKVTKAAAKKK

SEQ ID NO: 27814 - DNA, 685 bp, Panicum virgatum
  misc_feature: Ceres CLONE 1879442
  misc_feature: Encodes the peptide sequence at SEQ ID NO. 27815
caagcgactgataaaggaccgtaacgatcacaagcaagttgaggagggtatcaaccgtcttatattatgttctgggaaagtttactatgaacttgacgaagagcgtaaaaagtcagagcgcagtgatgttgcaatttgcagagttgagcaactttgcccattcccgtacgaccttatccaaagagagcttaagagatatccaaatgcggagattgtgtggtgccaggaggagcccatgaacatgggtgcatacagctacatctctcctcggctgtatactgccacgaaggctcttgggcggggttcgtttgaagacatcaagtacataggcagagcaccttcagctgctacagccacaggcttcctgtcggttcatgtacaggagcagtcagagctggtaaagaaggcactgcagccggagccgatcaagttcccctgatggggatgcagatcttcacgctgctgttgcttagtacaaactatcgtgaaataacatgaccctgacatgcctgtttgcaggaggctcgacatacccgaacgtgcattttaaaagttttgcacattttcttttctttttcaattttgaggcttttgtgttttttttttgggaaataattatgaagacctgaagctctgtgaaaccgatgtcattcattcgactttgctttcatagtggctttctgtt

SEQ ID NO: 27815 - protein, 145 aa, Panicum virgatum
  misc_feature: Ceres CLONE 1879442
  misc_feature: SWISSPROT Homolog: EC 1.2.4.2 Oxoglutarate dehydrogenase (succinyl-transferring)
KRLIKDRNDHKQVEEGINRLILCSGKVYYELDEERKKSERSDVAICRVEQLCPFPYDLIQRELKRYPNAEIVWCQEEPMNMGAYSYISPRLYTATKALGRGSFEDIKYIGRAPSAATATGFLSVHVQEQSELVKKALQPEPIKFP

SEQ ID NO: 27816 - DNA, 598 bp, Panicum virgatum
  misc_feature: Ceres CLONE 1879444
  misc_feature: Encodes the peptide sequence at SEQ ID NO. 27817
gcgcttcgttcctcctcgtccctcggcatcgcctcctatccgtctccctgctctctgccagagagagcgccgcaaggcactgaaactcgcggcggcgtgttgtttgcttgcttgctggcaagagggagaaaaggaggaggaagagagcaggagatggcaggctgcgatggagccaagtcgccggcctccaaggaggaagaggcatgtgttgagaagaagtacggaggaattgcacccaagaagcctttgatatccaaggaccacgagcgcgcgtacttcgattcagcagactgggtgctcggcaagcaagctgcaaatagcagcacacgggctgctgttgagtctctgaagcccaagctgaagcgaacgcctcaccaccagcttccccctcgcaagccgacctgcgcttccagctgagacgcacgtgcagctgctggagggagtgctgggaggtaaggatagggctcggataaatgtttggccgctggtccgaaatcgtagggatggatcagaagcctgaggggcaatctggctacttgtcaattgcagcctctactatgtctatcatcaagaacggattagatggtacttatggttg

SEQ ID NO: 27817 - protein, 87 aa, Panicum virgatum
  misc_feature: Ceres CLONE 1879444
  misc_feature (20)..(87): Pfam Name: Lg106 Pfam Description: Lg106-like protein
  misc_feature: Functional homolog of the protein sequence given in SEQ ID NO 50181
  misc_feature: Useful for biocontainment applications
MAGCDGAKSPASKEEEACVEKKYGGIAPKKPLISKDHERAYFDSADWVLGKQAANSSTRAAVESLKPKLKRTPHHQLPPRKPTCASS

SEQ ID NO: 27818 - DNA, 645 bp, Panicum virgatum
  misc_feature: Ceres CLONE 1879478
  misc_feature: Encodes the peptide sequence at SEQ ID NO. 27819
tcctctgctgcccccttcaaatcgggcaccacaaccctgagcctgctggggagcagagtggggagccgaacggattggggtcgaatcttctcctcaatccctcgactagagctgccccgccctttggaaatcctctgatctggtgaactgagtatatttctgtcagtggaagaaaggaacttggtccattaattttgaaaaccctcaaacccaaccccgtcggctcctgctcctgctcctctcggccccgtcgatccatcggcgatgacgccacgaagctccgccgccggatcgggcgtcgttgttcctcggaacttcagactactagaagagctcgagcgtggggagaagggcattggagatggtacagtgagctatggaatggatgatgcagatgacatctacatgagatcatggactggcactatcattggcccacataatacagtccatgagggtcgcatctaccagctgaagttgttctgtgacaaggactaccctgagaagccaccatctgttagatttcattcaagaataaacatgacatgtgttaatcatgagactggagtggttgacccaaagaagttcagtatactggcaaactggcagcgggagtacacaatggagtacattctgacccagctc

SEQ ID NO: 27819 - protein, 126 aa, Panicum virgatum
  misc_feature: Ceres CLONE 1879478
  misc_feature: SWISSPROT Homolog: EC 6.3.2.19 Ubiquitin--protein ligase
MTPRSSAAGSGVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFSILANWQREYTMEYILTQ

SEQ ID NO: 27820 - DNA, 726 bp, Panicum virgatum
  misc_feature: Ceres CLONE 1879479
  misc_feature: Encodes the peptide sequence at SEQ ID NO. 27821
aaaaccactcgagacacaattcaagcagcagcacggcagaccaacacctccaagcgaagcaatcgagacctgacgagaggaagatgtgcctgatcaagaaggagatgagcgccgagtccggctcgccgtcggcctccacctcgccggagcaccacccgacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacaccgccgaggccgcggcgcgcgcgcacgacgccgccatgctcgccatcgccggcgcgggcgcctgcctcaacttcgccgactcggagtggctcctagcggtcccagcctcctacgccagcctcgccgaggtgcgccacgccgtcgccgaggccgtgtaggacttccagcggcgcgaggcccgggcggaggatgacgcgcgctcggccgcgtcctcgacgccgtcctctcccgccaacgacgacgacggcgaggagtcatctccggccaccgggggctcgccgttcgagctggacgtgctcggtgacatgagctgggacttgtactacgcgagcttggcgcaggcgatgctcatggagccaccgtccacggtcaccgcgttctgcgacgacgccgtcgcgg

SEQ ID NO: 27821 - protein, 133 aa, Panicum virgatum
  misc_feature: Ceres CLONE 1879479
  misc_feature (47)..(100): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1248 in the 10/374,780 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 752 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: Functional homolog of the protein sequence given in SEQ ID NO 51036
  misc_feature: Useful for making plants with modulated salt sensitivity
  misc_feature: Functional homolog of the protein sequence given in SEQ ID NO 51037
  misc_feature: Useful for making plants with modulated nitrogen use efficiency
  misc_feature: Functional homolog of the protein sequence given in SEQ ID NO 51038
  misc_feature: Useful for making plants with modulated low light sensitivity
  misc_feature: The sequence is a functional homolog of SEQ ID NO 1229 in the 10/374,780 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: The sequence is a functional homolog of SEQ ID NO 1231 in the 10/374,780 US patent application
  misc_feature: The sequence is a functional homolog of SEQ ID NO 708 in the 11/435,388 US patent application
  misc_feature: The sequence is a functional homolog of SEQ ID NO 1720 in the 10/412,699 US patent application
  misc_feature: The sequence is a functional homolog of SEQ ID NO 1956 in the 10/374,780 US patent application
  misc_feature: The sequence is a functional homolog of SEQ ID NO 196 in the 11/375,241 US patent application
  misc_feature: The sequence is a functional homolog of SEQ ID NO 2239 in the 10/666,642 US patent application
  misc_feature: The sequence is a functional homolog of SEQ ID NO 422 in the 10/714,887 US patent application
  misc_feature: The sequence is a functional homolog of SEQ ID NO 44 in the 10/412,699 US patent application
  misc_feature: The sequence is a functional homolog of SEQ ID NO 55 in the 10/838,616 US patent application
  misc_feature: The sequence is a functional homolog of SEQ ID NO 574 in the 11/435,388 US patent application
  misc_feature: The sequence is a functional homolog of SEQ ID NO 70 in the 10/669,824 US patent application
  misc_feature: The sequence is a functional homolog of SEQ ID NO 70 in the 10/870,198 US patent application
  misc_feature: The sequence is a functional homolog of SEQ ID NO 96 in the 10/675,852 US patent application
  misc_feature: Functional homolog of the protein sequence given in SEQ ID NO 51026
  misc_feature: Useful for making plants with modulated water use efficiency
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1225 in the 10/374,780 US patent application
  misc_feature: The sequence is a functional homolog of SEQ ID NO 780 in the 11/435,388 US patent application
  misc_feature: The sequence is a functional homolog of SEQ ID NO 1314 in the 11/479,226 US patent application
  misc_feature: The sequence is a functional homolog of SEQ ID NO 16 in the 10/225,068 US patent application
  misc_feature: The sequence is a functional homolog of SEQ ID NO 186 in the 10/374,780 US patent application
  misc_feature: The sequence is a functional homolog of SEQ ID NO 190 in the 11/375,241 US patent application
  misc_feature: The sequence is a functional homolog of SEQ ID NO 516 in the 11/435,388 US patent application
  misc_feature: The sequence is a functional homolog of SEQ ID NO 566 in the 10/225,066 US patent application
  misc_feature: The sequence is a functional homolog of SEQ ID NO 616 in the 10/412,699 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 1236 in the 10/374,780 US patent application
  misc_feature: Functional homolog of the protein sequence given in SEQ ID NO 51263
  misc_feature: Useful for making plants with modulated flowering time
  misc_feature: The sequence is a functional homolog of SEQ ID NO 696 in the 11/435,388 US patent application
  misc_feature: The sequence is a functional homolog of SEQ ID NO 692 in the 11/435,388 US patent application
  misc_feature: The sequence is a functional homolog of SEQ ID NO 1226 in the 10/374,780 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: Functional homolog of the protein sequence given in SEQ ID NO 50529
  misc_feature: Useful for making plants with altered terpenoid content
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 700 in the 11/435,388 US patent application
  misc_feature: The sequence is a functional homolog of SEQ ID NO 694 in the 11/435,388 US patent application
  misc_feature: The sequence is a functional homolog of SEQ ID NO 704 in the 11/435,388 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: The sequence is a functional homolog of SEQ ID NO 776 in the 11/435,388 US patent application
  misc_feature: The sequence is a functional homolog of SEQ ID NO 698 in the 11/435,388 US patent application
  misc_feature: Functional homolog of the protein sequence given in SEQ ID NO 51068
  misc_feature: Useful for making plants with modulated biomass
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: The sequence is a functional homolog of SEQ ID NO 1234 in the 10/374,780 US patent application
MCLIKKEMSAESGSPSASTSPEHHPTVWTSPPKRPAGRTKFRETRHPVFRGVRRRGNAGRWVCEVRVPGRRGCRLWLGTFDTAEAAARAHDAAMLAIAGAGACLNFADSEWLLAVPASYASLAEVRHAVAEAV

SEQ ID NO: 27822 - DNA, 920 bp, Panicum virgatum
  misc_feature: Ceres CLONE 1879494
  misc_feature: Encodes the peptide sequence at SEQ ID NO. 27823
aacggggggcgctgccattgtatacgtgctcgaacggtcgaacctgctcgtgcactccagcatctcaagttctcatagcgagaggggagagagcggcagaggtgggagggaggaagatgagcggcagcgtggagacgcaggcgcgggcgttcgcggacgaggtgcgcggcggcgccctggaggcgaagaactggatgctggacctcggccacccgctcctcaaccgtgtcgccgagagcttcgtcaaggccgccgggatcggcgcggtccaggcggtcgcgagggagtcgtacttcatggccatcgaaggcgagggaggatcggtgtccggcgccaccggctcgaggaaacgctcgttcccggaactcaatgggacgaacagtggtagcaagtcggccgaggccatggtgaaaaacgtgagcaaagagtcgttgcagtggggactcgcggctggcgtgcactccggcctgacctacggcctgacggaggtgcgcgggacgcacgactggcgtaacagcgccgtggccggcgccatcacgggcgccgccgtcgcgctcacgtcggaccgcgcgtcgcacgagcaggtcgtgcagtgcgcaatcgccggcgcggcgctctccacggccgccaacgtgctctccggcatattctgaatccgtcctgagcccgccggccgaagctatgttgcgctggatgttgcgcaccctaatgttgccatcgctatgttcttagtagtagtagtagccccccttatacgataatttggggtgttgcatcaatgtgtcgcggatgctttcagctacagcatcttgtaagcggactagatgacattgatttgtcgttaccgtcgccgatatatctgttgctgcggctattgagcctcccgtggcagatcatgagttcatgaccgtcttcagtgc

SEQ ID NO: 27823 - protein, 178 aa, Panicum virgatum
  misc_feature: Ceres CLONE 1879494
  misc_feature (27)..(178): Pfam Name: Tim17 Pfam Description: Tim17/Tim22/Tim23 family
MSGSVETQARAFADEVRGGALEAKNWMLDLGHPLLNRVAESFVKAAGIGAVQAVARESYFMAIEGEGGSVSGATGSRKRSFPELNGTNSGSKSAEAMVKNVSKESLQWGLAAGVHSGLTYGLTEVRGTHDWRNSAVAGAITGAAVALTSDRASHEQVVQCAIAGAALSTAANVLSGIF

SEQ ID NO: 27824 - DNA, 733 bp, Panicum virgatum
  misc_feature: Ceres CLONE 1879515
  misc_feature: Encodes the peptide sequence at SEQ ID NO. 27825
aaaatgaaattctccagccggagaaggacaaaaaaatctcaggcctgcacaccccacctctcgccgtcgccgtcgccgtccatggagtccgtcgcggccgccgcgatcgccaccacctcccggtccctcccgctccccttctcctctacgccgctccaccgccggcgccgtcccgccttcctccccgtcaccgcctccaagcgtcataacgacgacaacgacaacgaggaggccgcaaatggccccgggagcgagcccaccggccttgcgccgcacgggctctccatctcgccgctctcaaaggacgcggccatggggatagtggtgagcgctgccacggggagcggctggacgacgggatcgggcatggaggggccgccaacggcgaacagagccggtggggaggacaggccagaggtgtcgacgctcccttggtcgctcttcacaaaatcgccgcggcgacggatgcgggtggccttcacctgcaacgtgtgtgggcagcgtacaaccagggccatcaatcctcatgcctacaccgatggaactgtgtttgttcagtgctgtggttgcaatgtattccataagttggtcgacaacctgaacctgtttcatgagatgaagtgctacgttggtccagacttccgctacgaaggagatgctgcattcaactacattgacgataacgaggatggcgatactatcttccctctctaaaccctctcccttatgttcc

SEQ ID NO: 27825 - protein, 210 aa, Panicum virgatum
  misc_feature: Ceres CLONE 1879515
  misc_feature (129)..(194): Pfam Name: zf-DNL Pfam Description: DNL zinc finger
MESVAAAAIATTSRSLPLPFSSTPLHRRRRPAFLPVTASKRHNDDNDNEEAANGPGSEPTGLAPHGLSISPLSKDAAMGIVVSAATGSGWTTGSGMEGPPTANRAGGEDRPEVSTLPWSLFTKSPRRRMRVAFTCNVCGQRTTRAINPHAYTDGTVFVQCCGCNVFHKLVDNLNLFHEMKCYVGPDFRYEGDAAFNYIDDNEDGDTIFPL

SEQ ID NO: 27826 - DNA, 743 bp, Panicum virgatum
  misc_feature: Ceres CLONE 1879524
  misc_feature: Encodes the peptide sequence at SEQ ID NO. 27827
agtccaaacccacgcccctcccctctcctctgaatcccaatcgccccaaaacgaggcacgagctcctctcgccggaatcctaaaccctagctcgctcgggcgcgcgtcgagaccgctcgccggagccgggagcgggagggagggaggaggagatgggcaccgggggagatggggagaagtcggcgcccgcgctgccgctggaggcgctgctggcgctcgggctcgaccagcgcaccgcggagaatgcgctcgtcaacagcaaggtcaccgccaacctcgccgccgtcatagccgaggctggtataaaggaatgtgacaaatcagttggcaatcttctctatgcagttgccactaagtacccaactaatgcacttgttcatcgtcctgtccttattaaatatgtcttgtcaacaaagataaagaaccctgcacaactagatggtgctctatcatttctttctaatactggtcctgattctctggatgtcaagaagtttgaagaagcatgtggtgtaggtgtggttgtttctattgaggagattaagtcaactgttactgatgtacttgaggagaatatggaagctataaaggagcagcggtatcacataaatgttggtaccctatgtggacaggttaggaagagacacccgtggggtgatgctagggcaataaaggaggaaattgacaagaggcttgcagaaatactaggcccgaagacagaagctgacaatataaaaccagcg

SEQ ID NO: 27827 - protein, 196 aa, Panicum virgatum
  misc_feature: Ceres CLONE 1879524
  misc_feature (14)..(171): Pfam Name: tRNA_synt_1c_R1 Pfam Description: Glutaminyl-tRNA synthetase, non-specific RNA binding region part 1
  misc_feature: SWISSPROT Homolog: EC 6.1.1.18 Glutamine--tRNA ligase
MGTGGDGEKSAPALPLEALLALGLDQRTAENALVNSKVTANLAAVIAEAGIKECDKSVGNLLYAVATKYPTNALVHRPVLIKYVLSTKIKNPAQLDGALSFLSNTGPDSLDVKKFEEACGVGVVVSIEEIKSTVTDVLEENMEAIKEQRYHINVGTLCGQVRKRHPWGDARAIKEEIDKRLAEILGPKTEADNIKP

SEQ ID NO: 27828 - DNA, 670 bp, Panicum virgatum
  misc_feature: Ceres CLONE 1879535
  misc_feature: Encodes the peptide sequence at SEQ ID NO. 27829
atccgcaccatccgctaatccgcatcgtgctgcccttctcatgctctctcctcctccgcccgaccgcccccatgcgctttgcctccgtagggaggaggttctccttcagggatggcagtgccgcgaccggggacacacacgctgagcaagggagtgtggagatggaggtggatcggggaagggatcgcgcagatggacgcgtgcatcgcccggagatggcgtcagccgggggcgttagcgacggcgacggccttctctccgcctcctcagctacgaatctcttgtgctctgtattaaaggttgacttcataccaaactttgataactcacagagggagccatctctgctgctggctcgtgttccatctctatttttgaatggttcttctgggattgcggtcggaatggcaacaaacattcctcctcacaatctgggggatcttgttgatgcactttctgttataattcaaaagcctgaagccacagttcagccgtggtcatcacgagtacaagctgataagagcaacaaccgtatggagcattgcagatttggagaggaaggttgtttgttcttcctgccattccaagaagatccggagaggaaggctgaggtttccacactgatacaacatgattgactaatttcagcagaaggcactgcaagatccct

SEQ ID NO: 27829 - protein, 140 aa, Panicum virgatum
  misc_feature: Ceres CLONE 1879535
  misc_feature: SWISSPROT Homolog: EC 5.99.1.3 DNA topoisomerase (ATP-hydrolyzing)
MASAGGVSDGDGLLSASSATNLLCSVLKVDFIPNFDNSQREPSLLLARVPSLFLNGSSGIAVGMATNIPPHNLGDLVDALSVIIQKPEATVQPWSSRVQADKSNNRMEHCRFGEEGCLFFLPFQEDPERKAEVSTLIQHD

SEQ ID NO: 27830 - DNA, 684 bp, Panicum virgatum
  misc_feature: Ceres CLONE 1879536
  misc_feature: Encodes the peptide sequence at SEQ ID NO. 27831
tcccttctcttcccgatcattccattccggctttccccaacccttcgaccacccgaggaagaaaagaagttgaagcatggggaagagaaagtcagctgctaagccacctcctaagaagcggatggacaagcttgacactgtcttttcctgcccattctgcaatcatgggagcagtgttgagtgccgtattgacatgaagaatttgattggcgaggcttcttgcagaatctgtcaggaaaacttcagcaccactgttaatgcactcactgagcctattgacatatatagtgaatggattgatgagtgtgagcgtgtcaacactgttgaaggtgatgatgatgcatgagctccccccatgctgatggaacggttactggcaactgtattgtactggcatgcttggatgccatagtcagccatggcttgtaatggcgctgtaagggcatattggctgcctgatacgccgttaggcggtatcagtttatctagtacttaataaactctaaaaaaatacgtgtatgccaactagtgactgcctacaatgatataacaggttttctgtgagtatgttaacgtgttttaaaccattctagatttcagtgccagcaaaagagcgatgtaaattgcacgcgaccacagctttttcaacaattcaagaatgtgaaccctccggttcatggtagg

SEQ ID NO: 27831 - protein, 89 aa, Panicum virgatum
  misc_feature: Ceres CLONE 1879536
  misc_feature (8)..(68): Pfam Name: Elf1 Pfam Description: Transcription elongation factor Elf1 like
MGKRKSAAKPPPKKRMDKLDTVFSCPFCNHGSSVECRIDMKNLIGEASCRICQENFSTTVNALTEPIDIYSEWIDECERVNTVEGDDDA

SEQ ID NO: 27832 - DNA, 727 bp, Panicum virgatum
  misc_feature: Ceres CLONE 1879558
  misc_feature: Encodes the peptide sequence at SEQ ID NO. 27833
agcgaaacggtggtgggttagtgggtatagctagctcgagcaggcagccacacctggcgccggagcggagcacaatacatccgatccatcgatcgctgtaggtgtccttctctgagatggccggagggaagatgtactcgttcgaggaggtgaggaagcacaacgaccgcaaggattgctggctcatcatcgccggcaaggtgtacgacgtcacgccgtacatggaggagcaccccggcggcgacgaggtcctgctggcgtgcacaggcaaggacgcgacggccgactacgaggacatcggccacagcgccgacgccaaggagctcatgaagcagtactgcatcggcgaggtcgacgcggccaccgtcccggccaagctcacctacacctaccccagcgactcgagcgcccagaaggcgtcggcgagcgcgggcgcctgggccacgacgctcctgcagctcggcgcgcccctcctgctgctggcgctggccctggcgagctacggcaaggcctgggccaaggcagagtaggaggcgagcacgagatgccgtcgttgattccgcggggcgcgcatagctgcagcctcttggaagcatctgggagttgtttttgggtcctaaaaaaagtacgagtggttcgtgtgttcacctcaaccgctgggtggtatcgtcaattttaaattcctgggtattgtgtatcgaacatgatgtatacagcatgctgctat

SEQ ID NO: 27833 - protein, 137 aa, Panicum virgatum
  misc_feature: Ceres CLONE 1879558
  misc_feature (6)..(80): Pfam Name: Cyt-b5 Pfam Description: Cytochrome b5-like Heme/Steroid binding domain
MAGGKMYSFEEVRKHNDRKDCWLIIAGKVYDVTPYMEEHPGGDEVLLACTGKDATADYEDIGHSADAKELMKQYCIGEVDAATVPAKLTYTYPSDSSAQKASASAGAWATTLLQLGAPLLLLALALASYGKAWAKAE

SEQ ID NO: 27834 - DNA, 802 bp, Panicum virgatum
  misc_feature: Ceres CLONE 1879560
  misc_feature: Encodes the peptide sequence at SEQ ID NO. 27835
ttactagctcctttctcacgagctcacccctcctaatccagcatgaacagctactattactacaatcggcgcaaccagtggaaatggtggtcggggagataggggatgtggctcgaacctactacggatggtagacgctatcctgcagttaatatagtaatattaactccggacaccttccgttatgcggtggcaatacatgcgttgggagacaaaccaatattaaccaaaccccctcaggataactctcccgaccatgtgatctcgatcaaagatatgaaggaatggcaatcgcgttgggaccgggctgctccacacaagctgttggtgtatgagttctacgacaagaaatccacactgtacaaggccatggacgagctgttggaggacctcgccaagaagtataaaggccaggcagagttctgcaagttggacgtcgacaacttcgagcttttggcgcggatttgcggagtggagggagcgtatccgacgttcgtgctattcaagaactgcaagcaggtgggcaaggtcgtcggcctcaaggaagacgaactccagcagagcatcaagaaagcgctgactgactagctagtactcaataattttcgtgtgaagacatataatatggcgttcatatatatacgcatcaggagtgcgaggtacatgttgtacatgctacgtagaataagcatggtacgaaacttgtcgagagatgttgagtattagatgtatttatctctgtggtcgaccacacaataatctattctgcagccggacgggtgaatccgactgagccaccggc

SEQ ID NO: 27835 - protein, 160 aa, Panicum virgatum
  misc_feature: Ceres CLONE 1879560
  misc_feature (52)..(157): Pfam Name: Thioredoxin Pfam Description: Thioredoxin
MWLEPTTDGRRYPAVNIVILTPDTFRYAVAIHALGDKPILTKPPQDNSPDHVISIKDMKEWQSRWDRAAPHKLLVYEFYDKKSTLYKAMDELLEDLAKKYKGQAEFCKLDVDNFELLARICGVEGAYPTFVLFKNCKQVGKVVGLKEDELQQSIKKALTD

SEQ ID NO: 27836 - DNA, 330 bp, Panicum virgatum
  misc_feature: Ceres CLONE 1879609
  misc_feature: Encodes the peptide sequence at SEQ ID NO. 27837
acctcttcgatcgagccagccatccagccagtcccctatcctcgcctgctgcgcgcgtctctctgctctcctagggagatctcgcgcagcgcggtaacccaccttcccacctcgtcgccgtcgcgcatggccggcctcaggatgaagctcgtcgccgccgccgccgtggccgccgcggtcatggcgtccgccgccaccaccgccgaggccccccccccggcgcccgcctcgcacggcgccgaggcgctgccctacccccggccgtacctcaacaacaccgacttcctgagccgcttctgctccttgcgccgcctggtccccgagatccct

SEQ ID NO: 27837 - protein, 67 aa, Panicum virgatum
  misc_feature: Ceres CLONE 1879609
  misc_feature: Functional homolog of the protein sequence given in SEQ ID NO 50390
  misc_feature: Useful for making plants with altered carbohydrate content
MAGLRMKLVAAAAVAAAVMASAATTAEAPPPAPASHGAEALPYPRPYLNNTDFLSRFCSLRRLVPEI

SEQ ID NO: 27838 - DNA, 693 bp, Panicum virgatum
  misc_feature: Ceres CLONE 1879610
  misc_feature: Encodes the peptide sequence at SEQ ID NO. 27839
cgcaccgcaggccgcagccagccacaggctcccgtcgcattcgctcgctctctcgcgtcgtcgctcccgcccggtgctcccgcctccgccgatccgcgcacgcagatcgccgaagcccggcggcgcaggggcaaaggggatcgagcgagggagggagctcgcgcggcggcggaggaggaaggcgttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcactaccatccccaccatcggattcaacgttgaagctgtcgagtacaagaacattagctttactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactggtacatccagagcacttgtgctacatct

SEQ ID NO: 27839 - protein, 161 aa, Panicum virgatum
  misc_feature: Ceres CLONE 1879610
  misc_feature (1)..(161): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLSFGKLFSRLFAKKEMRILMVGLDAAGKTTILYKLKLGEIVTTIPTIGFNVEAVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 27840 - DNA, 589 bp, Panicum virgatum
  misc_feature: Ceres CLONE 1879625
  misc_feature: Encodes the peptide sequence at SEQ ID NO. 27841
ccatatttccacaacttgtactgctacagcggacaaggaatattgataacttgactggccaatatgtcttcttcttgggtgcataccgcattctttacatccttaactggatataccgctacttcactgagccccattttgttcactggataagctgggttgcaggaattgtgcaaactctattgtatgctgacttcttctactattatataatgagttggaagaacaatgtgaagctagagcttccagcttaagcttgttgttcgcttccaagatagactatggtaatacgtggtaatacaatggataggaagactcggtacgcagcatgagcatcgataccttcagggtcatgacatgcattttggttctctggcttataccctttgtatcgttctcctattattgggagaagaggcagctccggctcaccttgtaccttagaataagctgtgtaagctcagcaccaagaagataggagttacgagtgctttggggtttcgtgctgctgtgacctttcagcaagtgattctcattcatacaatataatctcatactgtgaatgcagtaattgtttggaatgcttcag

SEQ ID NO: 27841 - protein, 83 aa, Panicum virgatum
  misc_feature: Ceres CLONE 1879625
  misc_feature (1)..(73): Pfam Name: ER_lumen_recept Pfam Description: ER lumen protein retaining receptor
IFPQLVLLQRTRNIDNLTGQYVFFLGAYRILYILNWIYRYFTEPHFVHWISWVAGIVQTLLYADFFYYYIMSWKNNVKLELPA

SEQ ID NO: 27842 - DNA, 674 bp, Panicum virgatum
  misc_feature: Ceres CLONE 1879672
  misc_feature: Encodes the peptide sequence at SEQ ID NO. 27843
gagctcggctcattgacagccctcccgctcagagggctcagccgctcagggtctggggcgggggcctcaagttgatctcctcccttgctcttcctttcccttctctcggactctcacctccctttgctcttccttccctggcgacggcgactgggcgagcggcggcgccatttgtcctgtcttcgcccagccctttgacggcaacaagcgcatcctccaggtcatggcagagatcatagatttatcaggggacggaggtgttcttaagacggtggtccggaaagcaaaggatgatgctatagcgccatctgatagtctgcccttggttgatgttcattacgaaggcacacttgctgagaatggtgaagtttttgacaccacccaggaagacaactctattttctcatttgaaattggacagggggctgtcatcaaagcatgggatatagccttaagaactatgaaggttggcgaggttgcaaaaattacatgcaagccagaatatgcatatggaactgcgggttcaccaccggagatacctcctaatgcaaccctcatttttgaggtggagttagtagcctgcaggccgaggaaaggttcaagtgtgggtagtgtctctgatgagaaagccagacttgaggaacttaagaagcagcgagagctagctgctgcta

SEQ ID NO: 27843 - protein, 150 aa, Panicum virgatum
  misc_feature: Ceres CLONE 1879672
  misc_feature (15)..(118): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Functional homolog of the protein sequence given in SEQ ID NO 50112
  misc_feature: Useful for making plants with modulated biomass
MAEIIDLSGDGGVLKTVVRKAKDDAIAPSDSLPLVDVHYEGTLAENGEVFDTTQEDNSIFSFEIGQGAVIKAWDIALRTMKVGEVAKITCKPEYAYGTAGSPPEIPPNATLIFEVELVACRPRKGSSVGSVSDEKARLEELKKQRELAAA

SEQ ID NO: 27844 - DNA, 656 bp, Panicum virgatum
  misc_feature: Ceres CLONE 1879693
  misc_feature: Encodes the peptide sequence at SEQ ID NO. 27845
gtccacctaaaaccctaacccctccgccgccccccaaccccagccaccagcagcagccaccgccgccgccgtccgccggcgagatggcgctgtacctgctgttcgagtcggcctccggctacggcctcttccacgcgtacggcatcgatgagatcggccagagcgtggaagccgtgcgctcctccgtcctggacctcgaacgcttcggcaaggccgtcaagctcactgccttcaaccccttctcctccgccgtcgacgcgctcaaccagtgcaacgccatctccgaagggatcatgaccgatgagctgaggagcttcttggagctgaatctgcccaagcccaaggaggggaagaaggccaagtacagcctcggcgtcgtcgagccaaaggtcggctcccagatcgccgaggtcacaggcatcccctgccagagcaacgagttcgtccaggagctgcttcgcggcgtccgtctccacttcgaccgcttcatcaaggagctcaaggagtcggacttagagaaggcacaactcggcctggggcatagctacagcagggccaaggtgaagttcaatgtgaaccgtgttgacaacatggtgattcaggcaatctttctgttggatactcttgacaaggacatcaactccttctccatgaga

SEQ ID NO: 27845 - protein, 190 aa, Panicum virgatum
  misc_feature: Ceres CLONE 1879693
  misc_feature (3)..(69): Pfam Name: NOP5NT Pfam Description: NOP5NT (NUC127) domain
MALYLLFESASGYGLFHAYGIDEIGQSVEAVRSSVLDLERFGKAVKLTAFNPFSSAVDALNQCNAISEGIMTDELRSFLELNLPKPKEGKKAKYSLGVVEPKVGSQIAEVTGIPCQSNEFVQELLRGVRLHFDRFIKELKESDLEKAQLGLGHSYSRAKVKFNVNRVDNMVIQAIFLLDTLDKDINSFSM

SEQ ID NO: 27846 - DNA, 412 bp, Panicum virgatum
  misc_feature: Ceres CLONE 1879699
  misc_feature: Encodes the peptide sequence at SEQ ID NO. 27847
atcgatcgagccagccgtccagccagtcgcctatatcctcgcctgctgcgcgcgtctctctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccaccgaggcccccgccccggcgcccgcctctgacgccgccaccgcggtgcccctcgccgaggagtccctcgcctacgacgccttcggctacctcttctgctatgatccgccgcccgttccccgtgggtcctgttgattcgatgattcgtcctggcgtgccttgattcgactctacgagacgacgatgtcgccgggcttgtgtaagagaaagctca

SEQ ID NO: 27847 - protein, 69 aa, Panicum virgatum
  misc_feature: Ceres CLONE 1879699
  misc_feature: Functional homolog of the protein sequence given in SEQ ID NO 50390
  misc_feature: Useful for making plants with altered carbohydrate content
MAGLRMKLVAAAAVAAALVASAAAATEAPAPAPASDAATAVPLAEESLAYDAFGYLFCYDPPPVPRGSC

SEQ ID NO: 27848 - DNA, 609 bp, Panicum virgatum
  misc_feature: Ceres CLONE 1879725
  misc_feature: Encodes the peptide sequence at SEQ ID NO. 27849
acacagttccggcagcacgcactgcactgcagtacaaacacttgtagcaacaaaaaaaaaatgccgcggcgaactcgagtgctgcttggtctcgccttcgctgccttgttgctgctggccagcggcgccgccgctgcagaagccggaggactctcggctggccgtgaggcgatgccgtcactgcacgcgctgcggcgcgtcgaggacgacgcgagcagctccgtgttggagggcgaggaggcgccggcgtacccgcggaggagggcgctgtacagcggcgggtacatcaactacggcgctcttaccgcgagcaaggccgcttgctatggcccgtgccccgcccgcgggcaggcctacagcaacggctgccaggccatataccagtgccgcggttaagcagcgctgcagtcagtcgtcgatctgcacggttcttccgtaagttcaggcgcgtttgatctgggtgtaattcgccatggatcggagtggttatatatttatgtgtatagtctcagcctcttatgttcggtttccatttgatattattgtgaaaacagttcactgctcaataagagcacttattcatagtttgattttaaattaacttgatgc

SEQ ID NO: 27849 - protein, 111 aa, Panicum virgatum
  misc_feature: Ceres CLONE 1879725
  misc_feature (54)..(111): Pfam Name: RALF Pfam Description: Rapid ALkalinization Factor (RALF)
MPRRTRVLLGLAFAALLLLASGAAAAEAGGLSAGREAMPSLHALRRVEDDASSSVLEGEEAPAYPRRRALYSGGYINYGALTASKAACYGPCPARGQAYSNGCQAIYQCRG

SEQ ID NO: 27850 - DNA, 562 bp, Panicum virgatum
  misc_feature: Ceres CLONE 1879778
  misc_feature: Encodes the peptide sequence at SEQ ID NO. 27851
acgcgcttgccgtgcagctccatttgaccacttgagcaggagtagagcagggcagggcatcatctcattctcaggggctcgtgtagcgggatctcatcggtgcggtgagggtcaggtcttgcatcttctccaccaccggtcctccatgctcggcggcggaggcagcacggcgctgcggagggtcggcagctcgccgagggcgccgccgccgccgaggggccggctgttgttctccaacagcgactccatcaacaacaggatcgccaccgccgccgccaaagggtccaactccaaacgagcgcggctgcgagcgaggatcgccgccgcttcgcttgaatttacgcaagattgtcccagccagacacgaagtggtcggtttgtctctatgatgtttcacccaaatatatatgctgatggatgcatctgcttgcatatcctacatacccattggagtcctatatatgacgtagctgctatattgacttctattccgaccctgctctgtgatctaaacccaaactctccatcaaactccgaatctgtcatactgttcactgagaac

SEQ ID NO: 27851 - protein, 138 aa, Panicum virgatum
  misc_feature: Ceres CLONE 1879778
  misc_feature (38)..(137): Pfam Name: UQ_con Pfam Description: Ubiquitin-conjugating enzyme
  misc_feature: SWISSPROT Homolog: EC 6.3.2.19 Ubiquitin--protein ligase
MLGGGGSTALRRVGSSPRAPPPPRGRLLFSNSDSINNRIATAAAKGSNSKRARLRARIAAASLEFTQDCPSQTRSGRFVSMMFHPNIYADGCICLHILHTHWSPIYDVAAILTSIPTLLCDLNPNSPSNSESVILFTE

SEQ ID NO: 27852 - DNA, 670 bp, Panicum virgatum
  misc_feature: Ceres CLONE 1879785
  misc_feature: Encodes the peptide sequence at SEQ ID NO. 27853
aaaaaggaacaactcttcccgatttgggatcagattcagatgagggtttcgttcgctctttgcagacaagagaagagatggcactgaatcggaggagaggatggacgctgcgctgtgctgcgattccgttcgggaagctgtttaatcggaccgccgcgtcttcatctggaactggatgcacctccaaactgttcgtcggtggtctttcttacgatactaatgaaacagctctcaaggacgctttctctcaacatggtgctgttatttcagtgaaggttgtatgccatccaacgacgggcaagtcaaaagggtttggctttgtcaccttttcttcacaagatgaagctgcagcagcagcgcacaagatgaacggtgaggtgaggcaagtcatcttctcaacacctctgtgtagtgtagctaacacacgtttgtactgtaacaatttgttgaacaggtgcttgatgggaggaacattcgggtgcaccactcaaacactggatgacctgccactgcttatgttgctcatgttcagtccagcctacaaatagacagtctgctgatttctcagcacagcacagggtggttccctgagttgttcctcactttattttgagacttaacagatctcaggaccaccgcgtctttaaaccgttttctttcgctggcacct

SEQ ID NO: 27853 - protein, 156 aa, Panicum virgatum
  misc_feature: Ceres CLONE 1879785
  misc_feature (38)..(106): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MALNRRRGWTLRCAAIPFGKLFNRTAASSSGTGCTSKLFVGGLSYDTNETALKDAFSQHGAVISVKVVCHPTTGKSKGFGFVTFSSQDEAAAAAHKMNGEVRQVIFSTPLCSVANTRLYCNNLLNRCLMGGTFGCTTQTLDDLPLLMLLMFSPAYK

SEQ ID NO: 27854 - DNA, 726 bp, Panicum virgatum
  misc_feature: Ceres CLONE 1879803
  misc_feature: Encodes the peptide sequence at SEQ ID NO. 27855
agctcacacacgcagtccatctcccatccacccaaccaacgcacctacaccatggagccgatgcggctggcgctggccctgcttgtggtcgccgtggcggcgtcgcagctgccatcggcggcggaggcggccaactacacggtgggcgacgacaagggctggaaccccgacgtggactacacggcctgggtcaagaagcacaagcccttctacaagggagactggctcatcttcgagtaccagacggggcgggcggacgtggtgcaggtgggcgaggtgggctacgacaagtgcgacaaggccggcgccctcaccagctacagcaagggcacctcctacgccttccagctcaaggaggccaaggactactacttcatctgcagctacggctactgctacactggcatgaagctacacctcaccgccaagtcctcctcctcctcctcctccggcggctcctcctcatctgctgatgattcctcctcttccgacgactcctccgacacgccctcgccgtcctccaagaaggacaaggccaaagccaagtcgtcgtccagcgccgcgccgccgtccatcctcgccgccaccccctacgccgccattgctgccacaggcgccgccctgctccatctccacaggattgtgctgtgactctgactctgactctgatatccattcagagatcaggcagaggtcgagtattcattcagtcagatcttcagtggt

SEQ ID NO: 27855 - protein, 199 aa, Panicum virgatum
  misc_feature: Ceres CLONE 1879803
  misc_feature (37)..(119): Pfam Name: Cu_bind_like Pfam Description: Plastocyanin-like domain
MEPMRLALALLVVAVAASQLPSAAEAANYTVGDDKGWNPDVDYTAWVKKHKPFYKGDWLIFEYQTGRADVVQVGEVGYDKCDKAGALTSYSKGTSYAFQLKEAKDYYFICSYGYCYTGMKLHLTAKSSSSSSSGGSSSSADDSSSSDDSSDTPSPSSKKDKAKAKSSSSAAPPSILAATPYAAIAATGAALLHLHRIVL

SEQ ID NO: 27856 - DNA, 588 bp, Panicum virgatum
  misc_feature: Ceres CLONE 1879838
  misc_feature: Encodes the peptide sequence at SEQ ID NO. 27857
cacaggtcacgccttcttcccgcctgcctcgagctctctccccctcttcgccggtgttgtgtcgggttgccagctcttctcctgaaatggagtcaagggcggcgctcctcctctgcgcttcggtggtcctcgccgcggcggccgccgtcgaggccagggacttcgtcgtcagcggcgccaacgacgcctggaaggcgcaggcccagcccgacgcgctcaccaagtgggcctcgatcaaccgcttccaagtcggcgacaacctcgtgttcaagctgggcggcgcggcggacgactcggtgctggaagtgacccgcgacgactacaacagctgcagcacggcggccccgctcgccacccacagggccaccgccggcggaggcgccgccacggtgccgctcccacgctccggcccgtactacttcgtcggcagcaccccgggcagctgccagaaagacgagcgcctcctcctcgtcgtcatgtccgaaaagcacgaacgcggccgtctgcgtggcctcgcgccggtgcccgctccggcacacgcggacgaagctgagtccccgctggccgccagcatcaaaaaaggcccag

SEQ ID NO: 27857 - protein, 167 aa, Panicum virgatum
  misc_feature: Ceres CLONE 1879838
  misc_feature (35)..(124): Pfam Name: Cu_bind_like Pfam Description: Plastocyanin-like domain
MESRAALLLCASVVLAAAAAVEARDFVVSGANDAWKAQAQPDALTKWASINRFQVGDNLVFKLGGAADDSVLEVTRDDYNSCSTAAPLATHRATAGGGAATVPLPRSGPYYFVGSTPGSCQKDERLLLVVMSEKHERGRLRGLAPVPAPAHADEAESPLAASIKKGP

SEQ ID NO: 27858 - DNA, 701 bp, Panicum virgatum
  misc_feature: Ceres CLONE 1879861
  misc_feature: Encodes the peptide sequence at SEQ ID NO. 27859
acagagcgccacgaggcgagcagtcgagtgttccctagagtccccgtctctccgccgccgcctgcaaccgcttcacgtgccctaatccatcgcagctcccctttccgaccccaaatggagcccaagaagacctccgcccagcaccagcctcacgccatggagcccaagaagtcctctccccgccgcaccggggccgccaccggcgccgccaacgacgccgaggactccccgttaagcagcttgttctatccgccggcgcctggggcaaatgggaaagatcaggacttgtacagcattctctacaaaggtcagagcggcagcgcacatcctggcatgacagatggtaaaaaccaatgggctccatccagaagtcgttccacttgcaccaaggatggtaaacattcaccgccccaagattcagttgatacatcttgttttggatcatctgtgcattatggtggtcgagactatttctacggcagctcgacaaccaagcaagggacagaatcctccactaattacaaggcggacaagaaggatccaaccacagattctcatggcgactggtggcaaggctcattctactactaggtgaatctggtggcctctcccttggacatcaaggaactaaaagggggaggcagtgaagttcgacttccttgactgttggcactatcatcagttaccctgtgtcgatagtg

SEQ ID NO: 27859 - protein, 158 aa, Panicum virgatum
  misc_feature: Ceres CLONE 1879861
  misc_feature: Functional homolog of the protein sequence given in SEQ ID NO 51264
  misc_feature: Useful for making plants with modulated biomass
  misc_feature: Useful for making plants with modulated flowering time
MEPKKTSAQHQPHAMEPKKSSPRRTGAATGAANDAEDSPLSSLFYPPAPGANGKDQDLYSILYKGQSGSAHPGMTDGKNQWAPSRSRSTCTKDGKHSPPQDSVDTSCFGSSVHYGGRDYFYGSSTTKQGTESSTNYKADKKDPTTDSHGDWWQGSFYY

SEQ ID NO: 27860 - DNA, 455 bp, Panicum virgatum
  misc_feature: Ceres CLONE 1879867
  misc_feature: Encodes the peptide sequence at SEQ ID NO. 27861
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgaccaccactcgctcctcaaccccttccgccccttcggcgaggtcctcgagtccaagatcatcctcgatcgtgagacccccaggtcccgcggcttcggcttcgtcaccttctcgagcgagcaggctatgcccgatgccttctaggggatgaacggcaaggagctggaccgccgctgcctcgccgtctacgaccgcccagtcccgcgtcggcccgcgctccgggggccgcggatgcggcgggttccggcgccgcgagggcggcgcctgctactggctccgccagcgcggctgtggccacggccg

SEQ ID NO: 27861 - protein, 66 aa, Panicum virgatum
  misc_feature: Ceres CLONE 1879867
  misc_feature (10)..(66): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDHHSLLNPFRPFGEVLESKIILDRETPRSRGFGFVTFSSEQAMPDAF

SEQ ID NO: 27862 - DNA, 635 bp, Panicum virgatum
  misc_feature: Ceres CLONE 1879878
  misc_feature: Encodes the peptide sequence at SEQ ID NO. 27863
aggcagcagtggatccgcgcacgcctctccctcccgagtgttcttcttcttcaggtcccgaagcggcggcgcgtgctaccggagagcaggacgcgagacaccatgctggaagggaaggcgatggtggaggacacggacatgccggcgaagatgcaggcgcaggcgatggcggcggcgtccagggccctcgaccgcttcgacgtcctcgactgccggagcatcgcggcgcacatcaagaaggagtttgacacgatccacggccccgggtggcaatgcgtggtgggctccagcttcggctgctacttcacgcacagcaaggggagcttcatctacttccggctcgagtcgctcaggttcctcatcttcaaaggggcggcagcctagcccaggtgcagcacgttctcttttcctccggcttttgttgagcaaagcctacctagggaggcgccgcggcgggcggtgtgtgcgtgtctgtatgaaattggctcgctgtatactatgagggtaggatgtaacatcggcaagattgcagaacggtggatttcatcgctggtcgaattgcttctttgtgtacgatgaaatccaggtgtatgaatttggtggtgtataaatggaaatttgaaaatattggggat

SEQ ID NO: 27863 - protein, 93 aa, Panicum virgatum
  misc_feature: Ceres CLONE 1879878
  misc_feature (1)..(91): Pfam Name: Dynein_light Pfam Description: Dynein light chain type 1
MLEGKAMVEDTDMPAKMQAQAMAAASRALDRFDVLDCRSIAAHIKKEFDTIHGPGWQCVVGSSFGCYFTHSKGSFIYFRLESLRFLIFKGAAA

SEQ ID NO: 27864 - DNA, 707 bp, Panicum virgatum
  misc_feature: Ceres CLONE 1879883
  misc_feature: Encodes the peptide sequence at SEQ ID NO. 27865
agtccattccgtgcccaacctctccactcgcgcacgggccgccgcctaccaacgccaagcacgagccggaacctggaagaaacaatttgttcttcgctggctcgctcgccattcttatttctgcccattctccgcccagcgccccggctcccagcagcgaagggagctaggactagaagtctagaacaagtagagacgtagagtacagggagaagccatggccggcaggagcttcttgatccggtctcccaaggaggagtccgacgccgccgtcaaagaggctgtactactgggagcgaagaatgctgcaatagctggtactgtggtagcggttcccacgttggtcggctgccgtgtccttccttgggctaaggctaatctcaactacactgcacaagcactcatcatatctgcagcctgtatcgctggcttcttcatcactgccgataaaaccattctacggaacgcaagacaaaacaccatcgggaagcttgacaagtagatttcggtgcagaactatggctgtaatggctcactgattttggtgtttcgctactcaagccaattgtgctgtaaagacttgcttacctgacggactcaaccggtgcatgcagttttcccctaattttatttggaataaaatatggggctaatgggtatacgcctttgtaatgtggaatacgagacctgcttctttgtcacttgtc

SEQ ID NO: 27865 - protein, 94 aa, Panicum virgatum; identical to SEQ ID NO: 12673
  misc_feature: Ceres CLONE 1879883
  misc_feature (10)..(88): Pfam Name: ENOD93 Pfam Description: Early nodulin 93 ENOD93 protein

SEQ ID NO: 27866 - DNA, 743 bp, Panicum virgatum
  misc_feature: Ceres CLONE 1879892
  misc_feature: Encodes the peptide sequence at SEQ ID NO. 27867
cctgagcccgctcgcaaacccctcacaaccctcgccgccgccggccgctccgccccgccgtcgccatgggtaacttccgcaagctcaaccgccccgccgcccaccgcgtctccatgctcaggacgatggtgtcgcagctggtgaagcacgagcgcatcgagaccaccgtcgccaaggcgaaggaggtgcggcggaaggcggatcagatggtgcagctcgggaaggagggcactttggatgcggcaagacgtgctgctgcctttgttcgaggtgatgatgttgttcataagctattcacagagctggcctaccgctacagagatcgagctggcggatacacaagactcttacgcaccaagatacgtgttggtgatgctgcagaaatggcatacatcgagttcgtggacagggagaatgagcttcgagaggccaaacctgcaatcccacagccgccccaacgagctcctcttgatccatgggccaagtctcgggctagccaacagtgggcaggacctaagctcaccaagaactctgcatcagatggcctatgagaacattagcaagtgtatccatgttttgaaaagggcttcatttatttgcttgatatgcgtatggaatttttctctagagataactggcaatagaataattcgaacatgtattgttatactctatactcatgagatgaatgctctgaatcattaacagaaaattgcaaggctgtccatgcaagattttgaccc

SEQ ID NO: 27867 - protein, 161 aa, Panicum virgatum
  misc_feature: Ceres CLONE 1879892
  misc_feature (17)..(113): Pfam Name: Ribosomal_L17 Pfam Description: Ribosomal protein L17
  misc_feature: Functional homolog of the protein sequence given in SEQ ID NO 51265
  misc_feature: Useful for making plants with modulated heat sensitivity
MGNFRKLNRPAAHRVSMLRTMVSQLVKHERIETTVAKAKEVRRKADQMVQLGKEGTLDAARRAAAFVRGDDVVHKLFTELAYRYRDRAGGYTRLLRTKIRVGDAAEMAYIEFVDRENELREAKPAIPQPPQRAPLDPWAKSRASQQWAGPKLTKNSASDGL

SEQ ID NO: 27868 - DNA, 720 bp, Panicum virgatum
  misc_feature: Ceres CLONE 1879898
  misc_feature: Encodes the peptide sequence at SEQ ID NO. 27869
acacagaaacatagagggcgcggctcccgagtccaagtcgttgcgttgcatcgcctttcccctcctccgtccccggtccccgtccctcgccagtcgcctcgcattccgttcgtcgggcgcgccgccaaccaagttctttcagagagaccgactcgtgaaaatcagtgatctgtttggggactaatcaaactcaacaagcaagtttcatgtctgatctcgacgtccagcttccgtctgtttttgatccgtttgcggaggcaaatgctgaggactccagcactggtgctggatcaaaggactatgtgcatgtgcccattcagcagcgcaacggaagaaagagtctgacaactgttcagggcttgaagaaagagtacagctataacaaaatcctcaaggatctcaaaaaggagttctgctgcaatggtactgtagtccaggatccagagctaggccaggtcattcaactgcaaggtgatcaacgtaaaaatgttgctactttcctagtccaggctggaatcgcaaagaaagagagcatcaagattcacggattttaggcagcaacatataaatgcttgtgtggtatcatatgatacaagtattctaggtttctttagcttggtagtcgtaatatcagtagtcgtctgaacctttgtgtcactattggattgagaagtctactattgaatgcaagttatccttgcagtatggtttttaagcgtt

SEQ ID NO: 27869 - protein, 115 aa, Panicum virgatum
  misc_feature: Ceres CLONE 1879898
  misc_feature (27)..(108): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time
MSDLDVQLPSVFDPFAEANAEDSSTGAGSKDYVHVPIQQRNGRKSLTTVQGLKKEYSYNKILKDLKKEFCCNGTVVQDPELGQVIQLQGDQRKNVATFLVQAGIAKKESIKIHGF

SEQ ID NO: 27870 - DNA, 731 bp, Panicum virgatum
  misc_feature: Ceres CLONE 1879911
  misc_feature: Encodes the peptide sequence at SEQ ID NO. 27871
tctcttccttccctggcggcgacgactgggcgagcggcggcgccatttgtcacgtcttcgcccagccctttgccggcgacgagcgcatcctccagccacttcttcgagatgccgagggccacgagcgacgcaaagcttctgatccagtccctcaacaaggcgtatgctgccacaccgacaaatcttaagattatcgacctgtacgtgatttgtgctctcgctaccgccgtgattcaggttgcatacatgggattggttgggtcattccctttcaactccttcctctcaggtgtactttcatgcataggaaccgcagtgcttgctggtagcaacttcttatcccttgtcagttagctctggttatccttttacttttcgttgcctagtagatggcctccacctttcattatttttttttcagtttgtctccgcattcaagtgaacaaagacaacaaggaatttaaggatctacccccagaaagggcctttgctgactttgttctgtgcaacctggtgctccacctggtgatcatgaacttccttggataagcaactgccgtacaccgagtggttaagattttgcagccccagattttggtcgctgatcagtgttttaaagtttggaactgtcataataccgagtatccatatgatctctcacagattacctatgtaaagctagaattctcgaggaactgttagtcgaatggacagtgttgatccagtattga

SEQ ID NO: 27871 - protein, 81 aa, Panicum virgatum
  misc_feature: Ceres CLONE 1879911
  misc_feature (3)..(78): Pfam Name: DAD Pfam Description: DAD family
  misc_feature: SWISSPROT Homolog: EC 2.4.1.119 Dolichyl-diphosphooligosaccharide--protein glycotransferase
  misc_feature: Functional homolog of the protein sequence given in SEQ ID NO 50454
  misc_feature: Useful for making plants with modulated flowering time
MPRATSDAKLLIQSLNKAYAATPTNLKIIDLYVICALATAVIQVAYMGLVGSFPFNSFLSGVLSCIGTAVLAGSNFLSLVS

SEQ ID NO: 27872 - DNA, 673 bp, Panicum virgatum
  misc_feature: Ceres CLONE 1879931
  misc_feature: Encodes the peptide sequence at SEQ ID NO. 27873
  misc_feature (592)..(592): n is a, c, t, g, unknown, or other
aaaccgaagcggcgacagcagcaatggcggcctccatgatctcgtcgtcagctctggcggcaccggccagggcccagggcctgccgtccctcggccgccgcgcgtcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccactggacttctgatctgggccgtcaccctcgccgggctccttggcggcggcgccctccttgtttacaacaccagcgccctcgccagctaagaacactattcatgcatagtccatgcaagcgcttgtggttcatgtaagatcagctcgggtgtctgtcgtctgtaatctagcctgcagctttgatgcgcaatataatgcttggttcatgtaacaatgctactacggccctccatacttttgggacagttattatataacaaagnaggggaaaggggcgcgctatggcgcgcctgtagcaaaaaggtttgatctaaaattataataaaaatatattattatgtgcc

SEQ ID NO: 27873 - protein, 131 aa, Panicum virgatum
  misc_feature: Ceres CLONE 1879931
  misc_feature (35)..(131): Pfam Name: PsbR Pfam Description: Photosystem II 10 kDa polypeptide PsbR
MAASMISSSALAAPARAQGLPSLGRRASSFAVVCGTGKKIKTDKPFGIGGGLTVDHDASGRKVKGKGVYQFVDKYGANVDGYSPIYKEEDWSPTGDVYVGGTTGLLIWAVTLAGLLGGGALLVYNTSALAS

SEQ ID NO: 27874 - DNA, 866 bp, Panicum virgatum
  misc_feature: Ceres CLONE 1879950
  misc_feature: Encodes the peptide sequence at SEQ ID NO. 27875
attcaaagctcgtcgcaaccacctagctcctggcacgttgtgagtgtgagtggccaaatttcaagaagaggacaggctgttcgtttcatactttcatccttggagggagaggccggccggccttgttgacggtgataggattcgatcacacagctcggtttcagagagctttcagcaggcgccatgggaggcaccctggagtacttgtccgacctgctcggcggtggcggcggcagccggcggcggtacaagaagaggaagcagttccagacggtggagctgagggtgcgcatggactgtgacggctgcgagatgaaagtcaggaacgccctctccagcatgaaaggggtgcagtcggtggagatcaaccggaagcagtacaaggtgacggtgcaggggtacgtggagccgcacaaggtggtgaagcgcgtgcaggccacggggaagaaggccgagatctggccgtacgtgccctacagccacgtcgcccacccctacgccgcgccggcctacgacaagaaggcgccgccggggtacgtgcgccgggtcgacgccgtcatgcccgtctccagctacggcggccccacggcggccggaccgcaggagaagcggcttgtcaccatgttcagcgacgacaaccccaacgcctgctccatcatgtgatcatcagatcatcagctagctagtagcttgctaggaacctgtggatgtgaaaattaatgtgctgcgatcaatgatagatgttcgtgttcatggtggtgagcggtgacacacatgtatgcacgcgtacatatatatcatgtttgtgtaaatttaatatatagaagtttgagaagatggcaggggagatggggaaatttttttcc

SEQ ID NO: 27875 - protein, 159 aa, Panicum virgatum
  misc_feature: Ceres CLONE 1879950
  misc_feature (32)..(92): Pfam Name: HMA Pfam Description: Heavy-metal-associated domain
  misc_feature: SWISSPROT Homolog: EC 3.6.3.4 Copper-exporting ATPase
  misc_feature: Functional homolog of the protein sequence given in SEQ ID NO 50155
  misc_feature: Useful for biocontainment applications
MGGTLEYLSDLLGGGGGSRRRYKKRKQFQTVELRVRMDCDGCEMKVRNALSSMKGVQSVEINRKQYKVTVQGYVEPHKVVKRVQATGKKAEIWPYVPYSHVAHPYAAPAYDKKAPPGYVRRVDAVMPVSSYGGPTAAGPQEKRLVTMFSDDNPNACSIM

SEQ ID NO: 27876 - DNA, 434 bp, Panicum virgatum
  misc_feature: Ceres CLONE 1879953
  misc_feature: Encodes the peptide sequence at SEQ ID NO. 27877
aaccgccccccatccgccgccagccgattccgaaacctccgccaaatctctcgcagcagcagagttttctccctctccctcctccgcgatgtctgcgctcgtcccgggcggcgaggggctggccaagggcggcgccccccccccccccaaggcgccccgcgacaacatccagggcatcaccaagccggccatccccaggctggcgaggaggggcggcgtgaagcacatctcctggctcctctaccaggagacccgcgacgtgctcaacatcctcctcgataacttcctccgcgacgccctctcctacaccgaccacgcccgccgacggaccctcacccccatggacctcctctacgcgctcactcgccagggcccccccctctacggatttcgcggctgagcgcgccctctccctcctatgcgcctgctggcgg

SEQ ID NO: 27877 - protein, 103 aa, Panicum virgatum
  misc_feature: Ceres CLONE 1879953
  misc_feature (25)..(94): Pfam Name: Histone Pfam Description: Core histone H2A/H2B/H3/H4
MSALVPGGEGLAKGGAPPPPKAPRDNIQGITKPAIPRLARRGGVKHISWLLYQETRDVLNILLDNFLRDALSYTDHARRRTLTPMDLLYALTRQGPPLYGFRG

SEQ ID NO: 27878 - DNA, 677 bp, Panicum virgatum
  misc_feature: Ceres CLONE 1879956
  misc_feature: Encodes the peptide sequence at SEQ ID NO. 27879
gatttggttctgttcactgcagggcatcggtttcgctcggagcggaggagatggccggggagggaggcaaggggctgctcgcggcgaagacgacggcggccaagacggcggagaaggacaaggggaagaaggcccccgtctcccgctcctcccgcgccggcctgcagttccctgttggccgtatccaccgccaacttaagcagaggactcaggcaaatggtcgtgttggtgccactgcagccgtctactctgctgccatcctggagtacttgaccgctgaggttctggagttggctgggaatgctagcaaggatctgaaggttaagcgtatcacccctcgccaccttcagctggccatccgtggagatgaggagctcgacaccctcatcaagggcaccatcgcaggtggaggtgtaatcccgcacatccataagtccttgatcaacaagtcctccaaggagtgagtgaggggctagagatgatgtgcatcttagtttaaactggacttttgtgtgcccctgtgttgtaagtcctggttgtttagtttttagtggagctgtctggttgaagggatccttgtgtgtaacactttcctggtactgcatctgttatttgaacatcgtgactgtgttgagttgttaacttcaggggtgcacacctggatgcttatttagtta

SEQ ID NO: 27879 - protein, 137 aa, Panicum virgatum
  misc_feature: Ceres CLONE 1879956
  misc_feature (32)..(106): Pfam Name: Histone Pfam Description: Core histone H2A/H2B/H3/H4
  misc_feature: SWISSPROT Homolog: EC 2.7.7.7 DNA-directed DNA polymerase
MAGEGGKGLLAAKTTAAKTAEKDKGKKAPVSRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 27880 - DNA, 681 bp, Panicum virgatum
  misc_feature: Ceres CLONE 1879963
  misc_feature: Encodes the peptide sequence at SEQ ID NO. 27881
ctccccgaagccggcggcggcggacgaagccgcggcagccgcggcaggccatggcgtcgtcgtcgaccccggcggccgtccgcgagatgcagaaggatctcgaggtccaggctaacgccctcagcaagatccaaaaagacatcgcgaagaaccaccaggtccgcaagcagtacaccatccaggtcggcgagaacgagctcgtcctcaaggagttggagctgctgaatgatggggcgaacgtgtacaagctcattggaccggtgctcgtcaagcaggaccttgcggaggccaaggccaacgtcaagaagcgcatcgagtacatctcggcagagctgaagcggatggatcgggcgctgaaggatttggaagacaagcagaacagcaagaaggaatcgatattcaagttgcaacagaggatgcaggctgtacaagctaaggcttagacacctgcttgctgaatgcaactagtccaaggccttcctgcaaccacccatcccaatagcatccgcttttttttgtgtggaattaggtgtccagtgttctggtctctgaaaagaaagattggttgcgcctgtattcaggatgtccagtgtttatgtgagattcaaacgttcttgacgtctctgtagcaaagaatgttatctggatgctctgatgtaaaagtcggtcactaggttgaag

SEQ ID NO: 27881 - protein, 130 aa, Panicum virgatum
  misc_feature: Ceres CLONE 1879963
  misc_feature (18)..(123): Pfam Name: Prefoldin_2 Pfam Description: Prefoldin subunit
MASSSTPAAVREMQKDLEVQANALSKIQKDIAKNHQVRKQYTIQVGENELVLKELELLNDGANVYKLIGPVLVKQDLAEAKANVKKRIEYISAELKRMDRALKDLEDKQNSKKESIFKLQQRMQAVQAKA

SEQ ID NO: 27882 - DNA, 747 bp, Panicum virgatum
  misc_feature: Ceres CLONE 1879969
  misc_feature: Encodes the peptide sequence at SEQ ID NO. 27883
tttaagaggataagccaagcttcccctgccttcactatcccctcctcccctcagcctctcatcctatccatccaagaacccagaaaattccagatccgggagcgcgcagaaattagcgccagctagccagccagccagccgaagcaggccgcagccatggccgcccccgcctcgacctccctgctgagcacgctgctgcagctgccccttgccccgttctcggggaagagctcgccgccgtccgtggtgcacgtggcgcggcgggcgccgacggcggtggtggccgccaaggggtacaatgtgcagatcctggtggacgagaacgagggcgaggagtccatcttccggcggttccgccgcgaggtgatgcgcgccggcgtgctgcaggagatcaagcgccgccggaggtacgagagcaagaaggacgagaagaagcggaaggcgcgggaggctgggcgccgcaaccgccgcaggcgcatgatggatgaaccaaggttcccagaagaagatgcaggggcagctgcaagagctcgcgatgaggacgatgacaactgggaaattgatggcctcctgtgaaacaatggagttcataagttcagaaccggtccagatacgaagtttcgacatttgagttcttttttgggcatgcaaagcacaaaactgtattgagttttggcagtgttcatttccacttcaattgtacgatcgccatgtgtaactaaatcttagctaacgcagcatccttcg

SEQ ID NO: 27883 - protein, 139 aa, Panicum virgatum
  misc_feature: Ceres CLONE 1879969
  misc_feature (49)..(102): Pfam Name: Ribosomal_S21 Pfam Description: Ribosomal protein S21
MAAPASTSLLSTLLQLPLAPFSGKSSPPSVVHVARRAPTAVVAAKGYNVQILVDENEGEESIFRRFRREVMRAGVLQEIKRRRRYESKKDEKKRKAREAGRRNRRRRMMDEPRFPEEDAGAAARARDEDDDNWEIDGLL

SEQ ID NO: 27884 - DNA, 693 bp, Panicum virgatum
  misc_feature: Ceres CLONE 1879993
  misc_feature: Encodes the peptide sequence at SEQ ID NO. 27885
gtccgatcccgatttgtttcgtttccccatccttgcggccgctccaccgccgccgccctccgctccggccgccgaggtcaccgattcagatccaggtaacccccgcgccgagatccctcccccggtccgtccgctctctccccctcctcccgatcgctcgccgccggctccagatccgcccgagatcgcccgtacgtcccgtcggtgcgatccctggaacccaaatctctctcccccccctctctctctctcttgccgggctactgggacgcgagctatccagtttcgtcgcggattcggggtctcctccgccgcgtgacggcgtggaattccccgtctggcgtagtggggggtgcttgatctgagagttgctgacgtgtttagcccgatttctgaatcctgttccttcgtccaggacacgagagatggacgcgagcaggcgccagagcgggatccagcagctgctggccgcggagcaggaggcgcagcagatcgtcaatgcggccagggctgctaagtcggcaaggcttaggcaagcgaaagaggaggctgagagggaaatagctgaataccgtaaacagatggaggatgaattccagaggaaggttgcagagagcagcggtgactctggtgcaaatgtcaagcgcctcgagcaggagacagcggcgaagatcgaacagctcaaccacaggc

SEQ ID NO: 27885 - protein, 89 aa, Panicum virgatum
  misc_feature: Ceres CLONE 1879993
  misc_feature (5)..(89): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDASRRQSGIQQLLAAEQEAQQIVNAARAAKSARLRQAKEEAEREIAEYRKQMEDEFQRKVAESSGDSGANVKRLEQETAAKIEQLNHR

SEQ ID NO: 27886 - DNA, 712 bp, Panicum virgatum
  misc_feature: Ceres CLONE 1879997
  misc_feature: Encodes the peptide sequence at SEQ ID NO. 27887
gctcaggttcatctcctccctccgtttctgtcggactccccctcctcccgtgctcttccttccccggcggcgacgactgggcgagcggcggcgccatttgtcctgtcttggcccagccctttgccggggatgagcgcatcctacagacttggggttgatggattcagtggagatgcttgtggctttgagcaatctaatttagggaaaaggcctagagatgaaccatcttcatctggtccgaaatccaaagcttgtcgtgaaaaaatgaggagggacaggctgaatgacagatttctggaattaagttcggttatgaatcctggtaagcaagctaagttgaataaagcaaatatcttaaatgatgcaacccgtatgttggcacaacttagaggtgaggcagaaaagcttaaagaatcaaatgagaagctgcgagagaatatcaaggacctgaaggaggagaagaatgagctccgagaagagaaagtgagactgaaggcagaaaaggagaggctggagcagcaagttaaagcaatgagtgcagctcctacaggatatgttccccatctccctcatccagctgcataccatccggctgcttttgctccatttgcaccaccacagcaggatccaaccaataaaggcgctccaatccccgcagcgttccctgggatggcgatgtggcagtggctgcctccgactatggtggacacaa

SEQ ID NO: 27887 - protein, 194 aa, Panicum virgatum
  misc_feature: Ceres CLONE 1879997
  misc_feature (36)..(87): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Functional homolog of the protein sequence given in SEQ ID NO 50577
  misc_feature: Useful for making plants with altered terpenoid content
  misc_feature: The sequence is a functional homolog of SEQ ID NO 917 in the 11/479,226 US patent application
MSASYRLGVDGFSGDACGFEQSNLGKRPRDEPSSSGPKSKACREKMRRDRLNDRFLELSSVMNPGKQAKLNKANILNDATRMLAQLRGEAEKLKESNEKLRENIKDLKEEKNELREEKVRLKAEKERLEQQVKAMSAAPTGYVPHLPHPAAYHPAAFAPFAPPQQDPTNKGAPIPAAFPGMAMWQWLPPTMVDT

SEQ ID NO: 27888 - DNA, 574 bp, Panicum virgatum
  misc_feature: Ceres CLONE 1880005
  misc_feature: Encodes the peptide sequence at SEQ ID NO. 27889
aaaaatccatagaccagcaatcggcatcgagactagccatggcgctgtccctctccctcgcgcgccacgcgcccctcgccgtctccgcgggcgccggggccaggaggctccccgccgccagccccgccttcccgcccaagtccttcttgggcgcgccgctggccgccgtcgccgcctccgtcacgccgccgctcccgcgcacgccggccacctcctccacctcgctcgcggtcgtcgcggcggggaagaaggggtacaagatgaagacccaccaggcgtcggcgaagcggttccgggtgacggggaggggcaagatcgtgcggcggtgcgccgggaagcagcacctgctcggcaagaagaacaccaagcgcaagaagaggctttccaagatggtccaagtaaacaagagtgactatgacaatgtgacacgcgcactgccctacctcaaagtgaataggaaagcagactgagttcttcttggtcttcaaaagccattctgtttcattcaccaacctgtcattttgtgcatcttcagctgtatttcctttcgaatatggaggccgtaattcatttc

SEQ ID NO: 27889 - protein, 143 aa, Panicum virgatum
  misc_feature: Ceres CLONE 1880005
  misc_feature (75)..(133): Pfam Name: Ribosomal_L35p Pfam Description: Ribosomal protein L35
MALSLSLARHAPLAVSAGAGARRLPAASPAFPPKSFLGAPLAAVAASVTPPLPRTPATSSTSLAVVAAGKKGYKMKTHQASAKRFRVTGRGKIVRRCAGKQHLLGKKNTKRKKRLSKMVQVNKSDYDNVTRALPYLKVNRKAD

SEQ ID NO: 27890 - DNA, 621 bp, Panicum virgatum
  misc_feature: Ceres CLONE 1880009
  misc_feature: Encodes the peptide sequence at SEQ ID NO. 27891
gtcatcgtgtactaccacgtacggcggcgggttcgcgctcttctccccggccatcgggcccttcaacggcgtgtgccgccgcctctgcgccgcgatcggcgccgtcgtcgtgtcggtgaactaccccctcgcgcccgagcaccggtggcccgcggcctacgacgacggcgtcgacgcgctccagttcatcgacacgactggcgtcccggggctcggcgccgaggtccccgtcgacctcgccagctgcttcctggccggggagagcgcgggcggcaacattgtgcaccacgtcgccaaccgctgggcggcgcggtggccggcgtcggcgaagcgcgtccgcgtcgccggcatcttccccgtgcagccctacttcggcggcgtcgagcgcacggagtcggagctgaggctggagggcgtggcgcccgtggtgaacctcaagcgctccgacttctcgtggacggcgttcctgcccgtgggcgccacccgcgaccccccggcggcgcacgtcaccgacgagaacgccgacctggcggaggacttcccgcccgccatggtggtgaatcggcgggttcgacccgctcatggactggcagcgccggtacgccgacgtgctgcggcgga

SEQ ID NO: 27891 - protein, 206 aa, Panicum virgatum
  misc_feature: Ceres CLONE 1880009
  misc_feature (6)..(201): Pfam Name: Abhydrolase_3 Pfam Description: alpha/beta hydrolase fold
  misc_feature: SWISSPROT Homolog: EC 3.1.1.3 Triacylglycerol lipase
SSCTTTYGGGFALFSPAIGPFNGVCRRLCAAIGAVVVSVNYPLAPEHRWPAAYDDGVDALQFIDTTGVPGLGAEVPVDLASCFLAGESAGGNIVHHVANRWAARWPASAKRVRVAGIFPVQPYFGGVERTESELRLEGVAPVVNLKRSDFSWTAFLPVGATRDPPAAHVTDENADLAEDFPPAMVVNRRVRPAHGLAAPVRRRAAA

SEQ ID NO: 27892 - DNA, 699 bp, Panicum virgatum
  misc_feature: Ceres CLONE 1880017
  misc_feature: Encodes the peptide sequence at SEQ ID NO. 27893
tccgccgccccactccccaagccgccaaaccctagcgccgccgccgcaaccatggctgccgtgctcacccgcccggccgcgggcaccgtccagtgcttcggccgcaagaagacggccgtggccgtggcctacaccaagcccgggcgcgggctgatcaaggtgaacggtgtccccatcgagctcatccgcccggagatcctccgcctcaaggccttcgagcccatcatgctcgccgggcgctcccggttcaaggacatcgacatgaggatccgcgtccgcggcggagggaagacgtcgcagatctacgccatccgccaggccgtcgccaaggcgctcgtcgcctacttccagaagtacgtcgacgaggccgccaagaaggaggtcaaggacatcttcggccgctacgaccgcaccctcctcgtcgccgaccccaggcgctgcgagcccaagaagttcggtggtcgcggtgcccgcgccaggttccagaaatcgtaccgttaagcagcgattgcttgacgcgtcacaatctgccatatcactctgggtgtgtgttcttggcttcgtgttcaatcaatggatcaacttatctggttctatatctagctgctgctttaccttcatgtctagacttttaagcctagtgttgaacttttttttttttgacattgtgatgtgaaatgtgagagatattcaagaaga

SEQ ID NO: 27893 - protein, 149 aa, Panicum virgatum; identical to SEQ ID NO: 25949
  misc_feature: Ceres CLONE 1880017
  misc_feature (17)..(149): Pfam Name: Ribosomal_S9 Pfam Description: Ribosomal protein S9/S16

SEQ ID NO: 27894 - DNA, 706 bp, Panicum virgatum
  misc_feature: Ceres CLONE 1880019
  misc_feature: Encodes the peptide sequence at SEQ ID NO. 27895
aaatcaaatcccccacccaaaaccaagagatccaatcgaccaagaccaccaccatgggctccgccagccgcgccgtctcctgcctctgctgcccctgcaagtgcctcgcctgcggcctcttcagctgcctctgcagcatcctcatctccctcctcgtcaccctcggcgtcctcgccctcatcttctacctcatcttccgcccccacatgatcgccgccaccgtcgactccgcctccctcgccacattcaccctctccccgacctcctcgctcgcatacaacctcaccgtcgccatgaccgtgcgcaaccccaacaagcgcgtcggcctctactacgacaacgtcgaggccctcgccttctacaaggaccagcgcttcggctacgacccgctcgacgccttctaccagggcaccgaggcctccacccagctcaagcccgagttccacggacagcagctgctgcaaggggacgtcaccgccgcgcagttcaggcaggaccagaccgacggcagcttcgccatcaacgtcggcctcaacgccaagctcagggtcaaggtctgggccttcaaggtccgggggcccaaggccaggatcacctgcaagctcctcgtcccggcggcgggagccaccaacggagccaccttccagcccacagactgcaaagtctggttctgagatctgcttgcattgctgctgctttgcctgcc

SEQ ID NO: 27895 - protein, 206 aa, Panicum virgatum
  misc_feature: Ceres CLONE 1880019
  misc_feature (45)..(182): Pfam Name: Hin1 Pfam Description: Harpin-induced protein 1 (Hin1)
MGSASRAVSCLCCPCKCLACGLFSCLCSILISLLVTLGVLALIFYLIFRPHMIAATVDSASLATFTLSPTSSLAYNLTVAMTVRNPNKRVGLYYDNVEALAFYKDQRFGYDPLDAFYQGTEASTQLKPEFHGQQLLQGDVTAAQFRQDQTDGSFAINVGLNAKLRVKVWAFKVRGPKARITCKLLVPAAGATNGATFQPTDCKVWF

SEQ ID NO: 27896 - DNA, 660 bp, Panicum virgatum
  misc_feature: Ceres CLONE 1880026
  misc_feature: Encodes the peptide sequence at SEQ ID NO. 27897
tagagatagagaatgagctgaaggatttccttggggtcacaaaggtcatctggatacctcgtgggctgtacggtgacgaggacacaaacggccacgttgacaacctctgctgcttcatcaaacccggcgtgatcctcctgtcctggacggatgacgagaaggacccccagtacgagaggtccgtcgaggcgctgtcggtcctcacccaatcggtggacgccaaagtacggcacctggaggtggtgaagatccacgtcccggggcctctgtacatgacagaggaagaggcggacggcgttctttcaacgggtcacgccgtggcgagggagccgggcacgaggctggccgcctcgtacgtgaacttctacgtcgccaacggcggggtcgtggcgccggccttcggcgacgacaggtgggacaaggaggcgtacgcggtcctgcagaaggcgttccctgaccacgaggtggtgatggtcgagggcgcgcgggagatcgtgctgggcggcggcaacgtccactgcatcacgcagcagcagcccgtgcgcccgtcgtaggcgagccggtcggcgtcgacgcgtgcgatggctggcgacgagggacatgctgtgcccagtagcactggtagtaggagtgtccatctccggtcgttgtcgagctcgc

SEQ ID NO: 27897 - protein, 183 aa, Panicum virgatum
  misc_feature: Ceres CLONE 1880026
  misc_feature (1)..(179): Pfam Name: PAD_porph Pfam Description: Porphyromonas-type peptidyl-arginine deiminase
  misc_feature: SWISSPROT Homolog: EC 3.5.3.12 Agmatine deiminase
EIENELKDFLGVTKVIWIPRGLYGDEDTNGHVDNLCCFIKPGVILLSWTDDEKDPQYERSVEALSVLTQSVDAKVRHLEVVKIHVPGPLYMTEEEADGVLSTGHAVAREPGTRLAASYVNFYVANGGVVAPAFGDDRWDKEAYAVLQKAFPDHEVVMVEGAREIVLGGGNVHCITQQQPVRPS

SEQ ID NO: 27898 - DNA, 705 bp, Panicum virgatum
  misc_feature: Ceres CLONE 1880040
  misc_feature: Encodes the peptide sequence at SEQ ID NO. 27899
ttttaggatctgcatagtattccttgtgtttggcttcattggctatgcattgcctttcattctctgtacaatgatatgttgctgcctgccctgcataatctccattctgggcgtccacgaggatttggatccaaacagaggcgctaccacggacacaatcaatgctttggtggcatacaagttcaaatcgaaaagagttcacgatggggatgtgggagaagagggcggtggagtcttggcagctggaactgacaaggagcgaacgatctccgcagaagatgctatctgctgcatctgcttgtcaaagttctcgaacaatgaagatctacgagaacttccctgcgcgcatgtcttccacatggaatgcatagataaatggctccagataaacgcattgtgccctctttgcaaggctgagatagggggctccaaaagtgctgcagaaactggctccgaggggcctcgggatgataacagagtagccagtgacgttgagtcacagcgataactgctgaatgctctctcacatgagcatgaggatgatggatgatgtgcttttgatacggcctaagcttgttaacataaccgactacaagtaggaagtgcagggcaatgttctctcagattttctcatgcatttcggaagcaacattttcacgtacctaccatggcttcctagctggactgagctggtgatggtggcta

SEQ ID NO: 27899 - protein, 168 aa, Panicum virgatum
  misc_feature: Ceres CLONE 1880040
  misc_feature (96)..(136): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 2 in US patent 7053203
  misc_feature: The sequence is a functional homolog of SEQ ID NO 178 in the 10/666,642 US patent application
  misc_feature: The sequence is a functional homolog of SEQ ID NO 404 in the 10/666,642 US patent application
FRICIVFLVFGFIGYALPFILCTMICCCLPCIISILGVHEDLDPNRGATTDTINALVAYKFKSKRVHDGDVGEEGGGVLAAGTDKERTISAEDAICCICLSKFSNNEDLRELPCAHVFHMECIDKWLQINALCPLCKAEIGGSKSAAETGSEGPRDDNRVASDVESQR

SEQ ID NO: 27900 - DNA, 576 bp, Panicum virgatum
  misc_feature: Ceres CLONE 1880045
  misc_feature: Encodes the peptide sequence at SEQ ID NO. 27901
attaattactccccatcccctccttccctagctccctgcctccgagaggtttgaaacagagggagggccatcatcctcatccatcgagtcccctctcgtcgtcgatccaccggaaactcgtcgtcgatggcggactggggccccgtggtgatcgcgacggtgctgttcgtgctgctgacgccgggcctgctcttccagctccccgcgcacggccgcatcgtcggcttcggcaccatgcacaccagcggcatcgccatcctcgtccacgccgtcctctacttcgcgctcatcaccatcttcctcatcgccatcggagtccacatctacgccggctagctggagccgcggagctcggcctcttccgcccgcccttcgccaagcctcagtcctcctctcgtcgctcccttttcctatctactcctcctagtagtgtaaacatgtgagtggcgactgttgttgctggtggtgtttcttgttaattaatttaactgcagcgaaagcaatctggtggatgctgcagtgtgttgtattgtaatgaagggattatcgtgagattctctgttcgttgcttttttt

SEQ ID NO: 27901 - protein, 69 aa, Panicum virgatum
  misc_feature: Ceres CLONE 1880045
  misc_feature: Functional homolog of the protein sequence given in SEQ ID NO 50117
  misc_feature: Useful for making plants with altered cell wall content and/or composition
MADWGPVVIATVLFVLLTPGLLFQLPAHGRIVGFGTMHTSGIAILVHAVLYFALITIFLIAIGVHIYAG

SEQ ID NO: 27902 - DNA, 528 bp, Panicum virgatum
  misc_feature: Ceres CLONE 1880061
  misc_feature: Encodes the peptide sequence at SEQ ID NO. 27903
gaacatgccctgcagggaagcacaagaaacaatcttttgtagccatggacttcttcgtcttcttcgtcaccgtcttcaactcttcatcggctcgtaccctggatagcgaccgagaaataagaagatgagctccgccgcggaagcagctgatcagggcggcggcggttggacatcgtgggcggagggggaggggaggagcagagaggaggccaagaaggagatccgcggagacacccccgacgccgacatccacgggctggcggtcgggacgccggcgacgcctgatttccgcccctcccgtgtccgcgtcttcgtcggggccatcacccagacgcctgatgtgggctagcagctctgcccatatctttcttgctcactacatcgtgctcgttccaaacagagccttcctatgtatgtatggatgtgtgttgttaccctatggatccgatatagaagggatgtaaaaggtgaataatgcctcaattgtgggtagccttacaagaaccgccttcttgtttcttactctca

SEQ ID NO: 27903 - protein, 74 aa, Panicum virgatum
  misc_feature: Ceres CLONE 1880061
  misc_feature (15)..(74): Pfam Name: potato_inhibit Pfam Description: Potato inhibitor I family
MSSAAEAADQGGGGWTSWAEGEGRSREEAKKEIRGDTPDADIHGLAVGTPATPDFRPSRVRVFVGAITQTPDVG

SEQ ID NO: 27904 - DNA, 734 bp, Panicum virgatum
  misc_feature: Ceres CLONE 1880074
  misc_feature: Encodes the peptide sequence at SEQ ID NO. 27905
gagaaggtattccagaaaccgtgagttgatcagaatttagaagcaatgagttacctgctaaagaccaggaaggagagggaaccacccctgcaggagcatgcggcttcagaagagcaggcaaagataaataaggtacgggaacttctgggtgagctgccgacagagatgccgggcttcctgtcggacgccaccatccgccgcttcctccatgcaaaaaattggagcgtggttcaggccaccaagactctgaaagaagctgtcaaatggaggcgtcagtacaagccagaaaaaatctgttgggaagacattgctgaacccgagaatgaggtgcagagagcgtatataaccgactaccttgacaaaaatgggcgtactgtgttggtcgcacggccgtcagtaaagagcctaacttcagtgaaggaacagatcaaacaactagtgtacaacctggaaaatttgaccatgagctcagagaatgcaccagaaaatgttgtttgggtaattgacttccaaggatggacactatcaagtacgccattggcaatgagccgtcaatcattggacataattcagaactattatccagggttggtagcagttataattctttgcaatccaccaaagatatttgaatctttttggaaggtattcacgaacagaaacatattatattgttcctattcatgacattatctaaacatttgagatacaagttcacaagcatttttcacatc

SEQ ID NO: 27905 - protein, 213 aa, Panicum virgatum
  misc_feature: Ceres CLONE 1880074
  misc_feature (14)..(83): Pfam Name: CRAL_TRIO_N Pfam Description: CRAL/TRIO, N-terminus
MSYLLKTRKEREPPLQEHAASEEQAKINKVRELLGELPTEMPGFLSDATIRRFLHAKNWSVVQATKTLKEAVKWRRQYKPEKICWEDIAEPENEVQRAYITDYLDKNGRTVLVARPSVKSLTSVKEQIKQLVYNLENLTMSSENAPENVVWVIDFQGWTLSSTPLAMSRQSLDIIQNYYPGLVAVIILCNPPKIFESFWKVFTNRNILYCSYS

SEQ ID NO: 27906 - DNA, 581 bp, Panicum virgatum
  misc_feature: Ceres CLONE 1880083
  misc_feature: Encodes the peptide sequence at SEQ ID NO. 27907
gcgacactcaacgaccatcacaattattcaatcctcgcatttgcagcgcccacaaacccgcgaagaaaggaaggaagagaagctgctcccgatggagaacgccgacgcccctcccgccgagctccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtgtggggcgcctagctgcagcgcccctgcgttgccagccctctactgcgtgttgacatgttctgcagcacctaaagactggaggaggagcaaccacaacatcagtaacttgtgccacgttttaaagtactaagggttgtgttagtttggtagcttgggaatagtcatggtgtgtgtcgtcagaatccagttgatgacttgtgatttcagtgtgttctaagttctaactgtggtggtcacgtccaccactgatgtaggtactgtgcttctctcgtgtctgatgtctcccttgctctaataaaccatctgaacattagac

SEQ ID NO: 27907 - protein, 61 aa, Panicum virgatum
  misc_feature: Ceres CLONE 1880083
  misc_feature (28)..(56): Pfam Name: efhand Pfam Description: EF hand
  misc_feature: SWISSPROT Homolog: EC 2.7.11.1 Non-specific serine/threonine protein kinase
MENADAPPAELQAVLKKLGLPEARNLATVQEMICNVDSDRDGRVDFGEFKNMMQGITVWGA

SEQ ID NO: 27908 - DNA, 658 bp, Panicum virgatum
  misc_feature: Ceres CLONE 1880121
  misc_feature: Encodes the peptide sequence at SEQ ID NO. 27909
attcagagctctcgcttcgaaactgaaccagcacacccagctgccgttgccgtttctagagaactccctgccgttcgagatcccgctcgccacgatgcctgctctcgccaagcccgcctcgcggcccgccaagaccgccgcggcgccgaagccgaagcccgccgccgccaagcccaaggccgcggccgccgctggcgcctcgcacccgccctacttcgaggtgagcactgtccgatccccgtctggtttcgtcttcgattggggctgttccgtggtgagtgcgggctgatcgggattttggttttgttccttgcagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagaccgccgcggccaagccagccaaggccgccgcgaaaccgaagaagagtgccgccgccgccgccgccgccgccgccaagcccaagaagaccgccgccgggaccaagcgcaaggcgccggag

SEQ ID NO: 27909 - protein, 113 aa, Panicum virgatum
  misc_feature: Ceres CLONE 1880121
  misc_feature (1)..(64): Pfam Name: Linker_histone Pfam Description: linker histone H1 and H5 family
  misc_feature: Functional homolog of the protein sequence given in SEQ ID NO 50919
  misc_feature: Useful for making plants with modulated nitrogen use efficiency
  misc_feature: Useful for making plants with modulated oxidative stress sensitivity
MIKEAITALKERTGSSSHAIAKYMEDKHGPSLPANYKKMLSIQLRGFAAKGKLVKVKASYKLSDAAKKEAPKAKTAAAKPAKAAAKPKKSAAAAAAAAAKPKKTAAGTKRKAP

SEQ ID NO: 27910 - DNA, 683 bp, Panicum virgatum
  misc_feature: Ceres CLONE 1880135
  misc_feature: Encodes the peptide sequence at SEQ ID NO. 27911
accaatgcagtagccagccgagccgcctcaccccacctcgctgctcgcgatggcggtcacgcgcgtcgcggtggccgtcgcactcccgtccgcgccgccctcctcccgccgccgccaggccgtgctcccctcctcctgccggcctctccccacctcccgcgcgtccaaggcgatgcacgcccccgccgcaggcgcggtcgacgaggagacccccgctgcgtcgccttcgtcagattctagcaagggagtggagaacctggtgatcattggttccggcccggccgggtacactgctgcaatctacgctgccagggcaaacctgaggcccgtcgtgttcgaaggttaccaggtgggtggtgtccctggtgggcagctgatgaccacgactgaggtggagaatttccctgcgcaaggggaggggagggcgacgggagggtttcgtggaggtcgagctgccgtgccgccttcgtgtccgatggttcgcgcggggggcgccgcgccggaaggccgccggatccacctcgccgccactcccgttcccttctgagcctcggcggcgacggacgcttctgccaattccataagtctggcccaaagcccatcatcgctactgggcgcggcgaggcacgcggcccacctagtatgtacatagcagtcctagctggctcgtgatagtgtgccgg

SEQ ID NO: 27911 - protein, 124 aa, Panicum virgatum
  misc_feature: Ceres CLONE 1880135
  misc_feature: SWISSPROT Homolog: EC 1.8.1.9 Thioredoxin-disulfide reductase
MHAPAAGAVDEETPAASPSSDSSKGVENLVIIGSGPAGYTAAIYAARANLRPVVFEGYQVGGVPGGQLMTTTEVENFPAQGEGRATGGFRGGRAAVPPSCPMVRAGGAAPEGRRIHLAATPVPF

SEQ ID NO: 27912 - DNA, 513 bp, Panicum virgatum
  misc_feature: Ceres CLONE 1880148
  misc_feature: Encodes the peptide sequence at SEQ ID NO. 27913
cggcggcgggggcgtccggcgacgactcgtgctggggctccccggacgagtgccccgtcgtgtacgacctggacgccgagggcggcgccggcgccagcggcggcgccgcggcgagggcccggatgcggctgcaggaggcggcgtactacgacgtggacaccgcggcgagcctgctgccgacggcgcagttcatcagctacgccgcgctgatgcgggactcggtgccgtgctccatccccggcgcgtcctactacaactgccagccgggcgccgaggccaacccatacacgcgcggctgctccgagattgcccagtgccgcggctagctcctccgcctcgccgtcttctgctgccgtggtcgtcgctctccttctctccggccatctgcttgatggcctcattgtctccaggggaagaaactgggagagatttattgtaccccctgctgatacgcttattgttacgcggatggaagaaactgattaaatgagatagattggaagcttccccccc

SEQ ID NO: 27913 - protein, 107 aa, Panicum virgatum
  misc_feature: Ceres CLONE 1880148
  misc_feature (43)..(107): Pfam Name: RALF Pfam Description: Rapid ALkalinization Factor (RALF)
  misc_feature: Functional homolog of the protein sequence given in SEQ ID NO 50453
  misc_feature: Useful for making plants with modulated biomass
AAGASGDDSCWGSPDECPVVYDLDAEGGAGASGGAAARARMRLQEAAYYDVDTAASLLPTAQFISYAALMRDSVPCSIPGASYYNCQPGAEANPYTRGCSEIAQCRG

SEQ ID NO: 27914 - DNA, 525 bp, Panicum virgatum
  misc_feature: Ceres CLONE 1880194
  misc_feature: Encodes the peptide sequence at SEQ ID NO. 27915
atcgctccctctccctctccaccacagcaggctagctagggttttctggggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggaggcggcgcgctcgccggcggggagcgcccggacaacagctactgtggacgcggtggcggcggcaagaggagcggatcgaaccgcccctcacgtggcagggggggacctgctcctccgtgcgacgggaaggtcgtcgctagctccgacgaccaaaccgagcatagcgtccacgacgacaaccaggtcaccagggacggggtgctgacctgccccacc

SEQ ID NO: 27915 - protein, 144 aa, Panicum virgatum
  misc_feature: Ceres CLONE 1880194
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGTKGFGFISPDDGGQDLFVHHSSVKADGFPNLKDGDAVEFTVGADNDGRAKAIDVSAPGGGALAGGERPDNSYCGRGGGGKRSGSNRPSRGRGGPAPPCDGKVVASSDDQTEHSVHDDNQVTRDGVLTCP

SEQ ID NO: 27916 - DNA, 878 bp, Panicum virgatum
  misc_feature: Ceres CLONE 1880206
  misc_feature: Encodes the peptide sequence at SEQ ID NO. 27917
tacgcccggcacttccccacctctccctcgcttcgtgtgcgtgttgcttcccgtcggccgagtggtagagtcgcagagagcgccgcagggcagagcagcaggagatgagccggctggacacccggacgctcaaggacgagctgaccagcatggaccggcgcccgctcctggacctgggccacccgctcctcaaccgcgtcgccgacagcttcatccgcgccgccggcgtcggcgccgccagggccgtctccagggaggcctacttcgtcaccgtcgaaggcctttctggggactcggccgggctcgaccccaacggcggcaagaggagccatttctccagcatcaggggcgacgatggccagaagtcgctcgacgtcgtggtaaaaacggccggcaaggaggccttccagtggggcctggcagccggggtgtactccgggctgacgtacggcctcagggaggccaggggttgccatgactggaagaacagcatgatcgcaggtgccatcgccggcgcagccgtggcgctgacgggggacgccggcggccactccgacaagctcgtccatttcgccatcaccggcgcggcgctgtccagtgccgcgagcctgctctccggcgtattctgaatccagggacgggcgccggacacgggagcggttgtccggcaaggttctcgagggtgtttagcataaagaagttgcattgcagctcaccgaccatgaaaaatgtattcctagatccgtgtctcagcttcctgcagcgaagtctagcaccatgtggttgcagtgtaatcgttgctcgtttgtttccaaggcattctacatttacctttaggttttaccccagttccaataatcttctaagttgatgacttc

SEQ ID NO: 27917 - protein, 174 aa, Panicum virgatum
  misc_feature: Ceres CLONE 1880206
  misc_feature (21)..(174): Pfam Name: Tim17 Pfam Description: Tim17/Tim22/Tim23 family
MSRLDTRTLKDELTSMDRRPLLDLGHPLLNRVADSFIRAAGVGAARAVSREAYFVTVEGLSGDSAGLDPNGGKRSHFSSIRGDDGQKSLDVVVKTAGKEAFQWGLAAGVYSGLTYGLREARGCHDWKNSMIAGAIAGAAVALTGDAGGHSDKLVHFAITGAALSSAASLLSGVF

SEQ ID NO: 27918 - DNA, 720 bp, Panicum virgatum
  misc_feature: Ceres CLONE 1880216
  misc_feature: Encodes the peptide sequence at SEQ ID NO. 27919
actcatcactgcccacacctaagccctcctgcatcattgtactactcatctgtctaggccggccattgttccagaagccatcatggctggcgccgcagttatcgccggcctggtgctcctcgccgccgccgccgcggctccggcgtccgccacggattacgtggtcggcgactcgtccgggtggaacagtggcgtggactacaccacctgggcgaaaggcaagaccttcagcgttggcgacaacctggtgttccagtacagcgcgatgcacacggtggcggaggtgagctcggcggactacagcgcgtgctcggccagcaactcgctgcagtcgtacagcgaccagaacaccaagatcgcgctcaccgcgcccggcacgcgctacttcatctgcggcaccgcgggccactgcagcggcggcatgaagctcgccgtgaaggtgtccgccgcggccgccaccgctccggcggcgtcgtccccgcccgccgacgacggtacgcccccggagaccaccacgccgtccgcgtcgacgccccccgcgacgacgacgacggcgcccacgaccaggtccacctcgaccagcaccgccggggaggccccgctcgcgatgggcgtcctggccggcgccgcggggctcgtcggcctcgccctgatggcctaggcaagaggcagtgctgtccgtccccgtggcttctccgtttggaacacacaggtcggttg

SEQ ID NO: 27919 - protein, 192 aa, Panicum virgatum
  misc_feature: Ceres CLONE 1880216
  misc_feature (34)..(114): Pfam Name: Cu_bind_like Pfam Description: Plastocyanin-like domain
MAGAAVIAGLVLLAAAAAAPASATDYVVGDSSGWNSGVDYTTWAKGKTFSVGDNLVFQYSAMHTVAEVSSADYSACSASNSLQSYSDQNTKIALTAPGTRYFICGTAGHCSGGMKLAVKVSAAAATAPAASSPPADDGTPPETTTPSASTPPATTTTAPTTRSTSTSTAGEAPLAMGVLAGAAGLVGLALMA

SEQ ID NO: 27920 - DNA, 667 bp, Panicum virgatum
  misc_feature: Ceres CLONE 1880222
  misc_feature: Encodes the peptide sequence at SEQ ID NO. 27921
aaaaaaaaaacagctcccgcgcagcatcaccaccggagcatcagggagcacgggagagagcagagcgccacaggccgtccgatcctccgcgcgaagcagatcagatggctctcgctccctccggctcggccgcgctccgcgccgcgctggcctcgctggccccgcgggccgccaggggctacgcggcgtcggcggcgtccggggccatgcggcgcgcggcggccgcggcggagggcgccgccgcgggggaggccaaggaggccgggcgcggcgccgccgccgccgagatctcctgggtccccgaccccgtcaccggccactaccgccccgccaactgggccgccgccgccgaccccgccgacctccgcgccgcgcacctagcccgggcctgaaccctgcccgcccccgcccacccgtctgacataacataccaattaccaacaaaggggaaggtggggtggaggttcgtttggcgtcgtcgtcggccgcgcgcgcacgcgctgtcacggcggcggcccggcatggccgggaagtcgtctcggtcggtcgctgtcggacgcttgacgccgcgacatcatctcggcctcgaccaatcgggagatactgtacatggaggggcggcctctggtcgccgtgtcgtgcgtgcgtgcgtggtgtgggctggacg

SEQ ID NO: 27921 - protein, 95 aa, Panicum virgatum
  misc_feature: Ceres CLONE 1880222
  misc_feature (1)..(93): Pfam Name: LEA_3 Pfam Description: Late embryogenesis abundant protein
MALAPSGSAALRAALASLAPRAARGYAASAASGAMRRAAAAAEGAAAGEAKEAGRGAAAAEISWVPDPVTGHYRPANWAAAADPADLRAAHLARA

SEQ ID NO: 27922 - DNA, 701 bp, Panicum virgatum
  misc_feature: Ceres CLONE 1880225
  misc_feature: Encodes the peptide sequence at SEQ ID NO. 27923
agcaagccacagctcaacttcatcagcgagttgcagcagagatcgagatggagatccgcggcatgggcaccaccgccgtcctcgctctcctcgtcgccggcctcgccgccgccgccgccgcgaggccctcccacgccggcgccatcatccgtcgtgcgggacccggacttccggccgccgcggtggcagtgcaacgacgtggcggccgagtgccccgccgcctgcagccggtgcgaggaggcgccgggcgacggcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgagtgcgagctggcggaggcggacccgcgccgctaccgctgcctcgaccagttccacggctaccctgggcccaagtgcacgccgttgccgtggatgggcaactagcccagcacgtacacgcccgatcagctatatctacggacacgtacgtacgcccacaaataaataaaattagctactgtagcaagtgattgttcatccgacgtggacaattagctaccctgctcgctagctcctactgtatttcgtgcaactcaataagagacgtggccaagtagacctcggtc

SEQ ID NO: 27923 - protein, 172 aa, Panicum virgatum
  misc_feature: Ceres CLONE 1880225
  misc_feature (110)..(134): Pfam Name: Bowman-Birk_leg Pfam Description: Bowman-Birk serine protease inhibitor family
SKPQLNFISELQQRSRWRSAAWAPPPSSLSSSPASPPPPPRGPPTPAPSSVVRDPDFRPPRWQCNDVAAECPAACSRCEEAPGDGGGYVCRDWVVSLLEPPVCTPRPWDCCDAAVCTREYIPFCRCADEVEACPSNCSECELAEADPRRYRCLDQFHGYPGPKCTPLPWMGN

SEQ ID NO: 27924 - DNA, 618 bp, Panicum virgatum
  misc_feature: Ceres CLONE 1880229
  misc_feature: Encodes the peptide sequence at SEQ ID NO. 27925
gccaaggcgacaatcctgctcaacagtgtcgcttgcaccactccactcagctctcagcttcgccaatcgccatggccacgctcgccatgcgcctcatcctctgctcctccacctcctcgtccccctcgcagcgccgccgacggcccatgcctcccggagccagcggcgcaggcggctcaaacaagccgccgcagcctccggaagcgccggcgacagaccccaccgcgtggtcgacggcggcgcgctctccggcgagcccccgagctacctgaccggcgagttccctggcgactacggctgggacaccgccgggctctcggccgaccccgagaccttcgccaagaaccgggagctggaggtcatccactcccgctgggccatgctcggcgcgctaggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcatcgccggcggcccgctcggcgaggtcgt

SEQ ID NO: 27925 - protein, 205 aa, Panicum virgatum
  misc_feature: Ceres CLONE 1880229
  misc_feature (85)..(205): Pfam Name: Chloroa_b-bind Pfam Description: Chlorophyll A-B binding protein
PRRQSCSTVSLAPLHSALSFANRHGHARHAPHPLLLHLLVPLAAPPTAHASRSQRRRRLKQAAAASGSAGDRPHRVVDGGALSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEV

SEQ ID NO: 27926 - DNA, 374 bp, Panicum virgatum
  misc_feature: Ceres CLONE 1880247
  misc_feature: Encodes the peptide sequence at SEQ ID NO. 27927
cccacactcagccaaccgagcgagcgagggaggcggcggagaacggcatcgccatgtcctcctcagcggcaggagatggggacacggagccggcgtcccccatcctcatcgagcacgagggctcccgcctcaagtcctactggaaggaccccgacggacgcgtcatctcctcccccgcccgagccgactccaccccgcgcctcctcgacctccccaacccgatccttgccggccgggccaacttcgccaacctcgccgcgcgcccctcctactgctcctccgcgcgccgcggcggatacctcggttcctttggcaggaggctgatgcatacaccctttcacgacgcttccttcgccctctcggttggtgagctc

SEQ ID NO: 27927 - protein, 106 aa, Panicum virgatum
  misc_feature: Ceres CLONE 1880247
  misc_feature: SWISSPROT Homolog: EC 5.2.1.8 Peptidylprolyl isomerase
MSSSAAGDGDTEPASPILIEHEGSRLKSYWKDPDGRVISSPARADSTPRLLDLPNPILAGRANFANLAARPSYCSSARRGGYLGSFGRRLMHTPFHDASFALSVGE

SEQ ID NO: 27928 - DNA, 709 bp, Panicum virgatum
  misc_feature: Ceres CLONE 1880251
  misc_feature: Encodes the peptide sequence at SEQ ID NO. 27929
agaccatggagaagttcatcgaggacaggaagcgcagcccaaccaagcaggccgtcttcctcgacgtgctcctcgcgaacaaggagctcactcacgacgacaaggtcgccttcctgctggactcgctgctagcaggccacgagaccacctctgtgctgctctccattctcgtctatttcattgggaaatctcccagcatcatcgaccaactcaagaaagagcatgaggccatcaggtccacaaaggggaaggaggagcccttgacgcctgacgactacaggaagatggagtacaccagtcgtgttatcaatgagggactgagatgtggcaacatcgtcaagctagtgcacaggaaggttctcaaggacgtcacctacaaaggatacgtgatcccggctggttggaaaatcctgcccatcttgggtgctgtccacgtggacccatcgcatcatctggaacccgagcagtttcagcctcgcagatgggaggggctgaaccagccggctggcaagagcttcgcgccgttcggaggtggactgcggctctgccctggatcggagattgtcaaagtggaggctgctttcttcctgcaccaccttgtgctcaactacaggtggaggatgggtgaagaggacgctcccatgctgcaccagtacgtggaattcaagaagggcctgcccatacagctcgagccggtcagctgatgctc

SEQ ID NO: 27929 - protein, 232 aa, Panicum virgatum
  misc_feature: Ceres CLONE 1880251
  misc_feature: SWISSPROT Homolog: EC 1.14.13.93 (+)-abscisic acid 8'-hydroxylase
  misc_feature: Functional homolog of the protein sequence given in SEQ ID NO 50272
  misc_feature: Useful for making plants with modulated oxidative stress sensitivity
MEKFIEDRKRSPTKQAVFLDVLLANKELTHDDKVAFLLDSLLAGHETTSVLLSILVYFIGKSPSIIDQLKKEHEAIRSTKGKEEPLTPDDYRKMEYTSRVINEGLRCGNIVKLVHRKVLKDVTYKGYVIPAGWKILPILGAVHVDPSHHLEPEQFQPRRWEGLNQPAGKSFAPFGGGLRLCPGSEIVKVEAAFFLHHLVLNYRWRMGEEDAPMLHQYVEFKKGLPIQLEPVS

SEQ ID NO: 27930 - DNA, 695 bp, Panicum virgatum
  misc_feature: Ceres CLONE 1880272
  misc_feature: Encodes the peptide sequence at SEQ ID NO. 27931
acggcggcggcacagcgcggcgtcagccctccttggcctcctcctccattccgggccgagtcaaatccgaagccacacagcgagaggaaatggcggcggcggcgctccgtccggcgatcctccgccgcatccgcctctccccctccccgccgctcgccctcgccgccgcggcgtcccacccgcacgcgctggcgcggtggctagcgcggcccatgtcctcccacgacgcgcaccttacccgcgaggaggtcgtcgaccgcgtcctcgacgtcctcaagagccaccccaaggtagatccctccaaggtgactcccgaggcgcacttcgagaaggacctggggttggatagcctggacacagtcgaggtggtgatggccatcgaggaggagttcaagctcgagatcccggacaaggaggccgacaagatcgactcgctcccgctcgccatcgagtacgtcgccaaccaccccatggccggctgagcctcagctcgccggaggtgaggtctcttggtgtttggtttctgagggcaaataattggccgcagcggctgaggaaaacgtgtccctggcgctccgcattgcttcgcgggcggacgattatgtcgaaatggaacgttaacattttgtttctcagatgatgcaatgttagattgttgttttcagtgtgtgttatatctatatgctgtttttgac

SEQ ID NO: 27931 - protein, 130 aa, Panicum virgatum
  misc_feature: Ceres CLONE 1880272
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLSPSPPLALAAAASHPHALARWLARPMSSHDAHLTREEVVDRVLDVLKSHPKVDPSKVTPEAHFEKDLGLDSLDTVEVVMAIEEEFKLEIPDKEADKIDSLPLAIEYVANHPMAG

SEQ ID NO: 27932 - DNA, 664 bp, Panicum virgatum
  misc_feature: Ceres CLONE 1880299
  misc_feature: Encodes the peptide sequence at SEQ ID NO. 27933
cctcctccgccgtcgcctctccactttccccatccttcgccgccgtcgcctctccactttccccatccttcgccgccgtcgcggtcgcctcgcagtccgaagagccgcccccgactccgatggccagccgctgggtccgacccgaggtgagctttcctcggtcgcttcgtctctctctctctctcatggggcgttgctgccgcgcaggtgtacccgctgttcgcggcgatgggcgtggccgtcggcatctgcggatttcagctcttccggaacatcaccgggaacccggaagtcagggtaaacaaggctgggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgctattgtcgagtgtacccatttaaggcattcaatgtaatgtcatccataaattggaggacagcggatacctgtaaaagtcccgcgtgagtgattggtgatggcttgctatgtgtatgatggtttatgagtgctgcatcacccctgtttgatgttcatgctcatctgtcatgtggatttgctgtgcctc

SEQ ID NO: 27933 - protein, 71 aa, Panicum virgatum
  misc_feature: Ceres CLONE 1880299
  misc_feature (1)..(71): Pfam Name: B12D Pfam Description: B12D protein
MGVAVGICGFQLFRNITGNPEVRVNKAGRAAGVLENHEEGRRYAMHSLRSFVHDKTPEIMPAINKFFTEPK

SEQ ID NO: 27934 - DNA, 707 bp, Panicum virgatum
  misc_feature: Ceres CLONE 1880303
  misc_feature: Encodes the peptide sequence at SEQ ID NO. 27935
atttcggcgcaagtccaaagggcaaaccagaagttgcagttcgcctcctcctcttctccgtcggctcggatctctctgcgcgcgcgcggcggcggcgatggcgtctttctcggaggctccccccggcaaccccaaggccggcgagaagatcttcaagaccaagtgcgcgcagtgccacaccgtcgagaagggcgccggccacaagcaaggtccaaacttgaatggtctctttgggaggcagtccggaaccactgctggctactcctactccgcaggaaacaagaacaaggctgtggtctgggaggagaacactttatatgagtacctgcttaaccctaagaagtacattcctggaaccaagatggtcttccctgggctgaagaagccgcaggagcgtgctgatctcattgcgtatctcaaggaagctaccacatagaaatactcaaggaagctacagtttaataaagaggtttagacaattcgggtcactctggttgaacagggtgcaatctacgagacaattattgagtattttggttcatatgtttgtttcgaatgtctaggtgtttagctgaacaaaaacagtcaaaactttgacggctcttgttccaactgctggagaaatcccagcgccctatttttgaccaccgggtggtggaactggaaatctgaaatgcacccattttgaaggacctgagatgtgtaat

SEQ ID NO: 27935 - protein, 112 aa, Panicum virgatum
  misc_feature: Ceres CLONE 1880303
  misc_feature (12)..(111): Pfam Name: Cytochrom_C Pfam Description: Cytochrome c
  misc_feature: SWISSPROT Homolog: EC 1.9.3.1 Cytochrome-c oxidase
MASFSEAPPGNPKAGEKIFKTKCAQCHTVEKGAGHKQGPNLNGLFGRQSGTTAGYSYSAGNKNKAVVWEENTLYEYLLNPKKYIPGTKMVFPGLKKPQERADLIAYLKEATT

SEQ ID NO: 27936 - DNA, 638 bp, Panicum virgatum
  misc_feature: Ceres CLONE 1880312
  misc_feature: Encodes the peptide sequence at SEQ ID NO. 27937
ggactcccatccccacctcagacctcacctctccccgcgacgaatcggcggcggcggcggcggcggcggcggcagcgagcgctagagacccggctagagacccgggatggccggcatgggcgagatgccgatgaggccggcgcggccgggcccgccgatgcagcaccgggggccgccgccgatggcgcgcctccgccccgaaccgatagaccgcgagaagacctgtcctctcttgctcagggtcttcacaagggttgctggccatcaccaaaatgaagagtttgcggtgagagggaaggagccaaaagatgaagttcagatttacacatggaaggatgccacgctccgtgagctcacagaccttgtaaaagaggttgctcttccagcaaggaaaagaaatgctaggctttcttttgcttttgtgtacccagacaagaatggccgttttgttgtcagacaggtgggttcgacctttgcatatggtcatggaagaggggatgatgccaaaactctggcagagctcgggttccagattggtgattacttgagcgttgcaatcatgtagacgatgcccatgctgaactcgatcactgcaccggactggatgtaactgttgtgacgtcaaaagccccaggggg

SEQ ID NO: 27937 - protein, 152 aa, Panicum virgatum; identical to SEQ ID NO: 12928
  misc_feature: Ceres CLONE 1880312
  misc_feature (30)..(151): Pfam Name: SAP18 Pfam Description: Sin3 associated polypeptide p18 (SAP18)

SEQ ID NO: 27938 - DNA, 783 bp, Panicum virgatum
  misc_feature: Ceres CLONE 1880339
  misc_feature: Encodes the peptide sequence at SEQ ID NO. 27939
aggctagtttcactaccctcctctcccctttcccaccaaataaaggctcccaccccttttttctccagcatccaggggaggggaaacattaacccggcggccatggcctcgctccgcatccttccggcagccgccgtcgccatcctcttcttcattgtggctaccgtcgccaccaaagctcctgactatgtcatccagggccgcgtctactgcgacacctgccgtgccgggttcgaaaccaatgtcaccgagtacatgaagggcgccaaggtcaggctggagtgcaagcactacggcaccggcaacgtcgagcgcgccatcgacggcgtgaccgacgagactggcacctacaagatcgagctcaaggacagccacgaggaggacatctgtgaggtcgtccttgtccagagcccgcgcaaggactgcgacgaggtccaggatctcagggaccgcgccagcgtcctgctcaccaggaacgtcggcatctgcgacagcgtgcgccttgccaacccgctcggctacttcaaggacgtgccgctgcccgtctgcggtgagctgctcaagaagctcgacttggatgatcagactgagtaagaaaagagtacggtggcatcactggacaggctgcacaaactacaaatcagtcgcctggcctgcatctgcatgtagcatggatgtgtcagtaaagtacagagtcaatgattaacaatatctggacaaaacaaaaaggaaaaatgtaactatgctgtctatctaatgttactcacagatttgcgactggcc

SEQ ID NO: 27939 - protein, 163 aa, Panicum virgatum
  misc_feature: Ceres CLONE 1880339
  misc_feature (31)..(151): Pfam Name: Pollen_Ole_e_I Pfam Description: Pollen proteins Ole e I family
MASLRILPAAAVAILFFIVATVATKAPDYVIQGRVYCDTCRAGFETNVTEYMKGAKVRLECKHYGTGNVERAIDGVTDETGTYKIELKDSHEEDICEVVLVQSPRKDCDEVQDLRDRASVLLTRNVGICDSVRLANPLGYFKDVPLPVCGELLKKLDLDDQTE

SEQ ID NO: 27940 - DNA, 1040 bp, Panicum virgatum
  misc_feature: Ceres CLONE 1880342
  misc_feature: Encodes the peptide sequence at SEQ ID NO. 27941
ccattgcatctgaagtacttcacttttgcgggacgaataattggattagccttgatgcataaagtgcaagtcggaatcgtgctagaccgtaccctgttcttgcaccttgctgggagaagtattacactagaagatatttctgtggcagatcctgtcaaatatgcaagctttaaaaggattctggagatgaatgctgctgaaattgatgatctatacctaacattttcccgaggagctcatgaattaggtactcaagagattattgacctttgcccaggagggcaggatatcagtgtgaatatcagaaacagagagcaatacattgatcttcttattaagaacacctttgtggattctatttcagctcagctaacccatttcacccaaggatttactgacatactagttaatcctgatcgccgtaaagatttttttgagtgcttagatctggaagacttagaccgactgctaggaggaagcaacgacacaataaatctgcaagattggaaatcacatactcaatataatggctacaaagaaaaggatcgcctgattacttggttctggaaggcagtcgagcgcatgtcaatggagcaacagaggctgctcctcttcttctggacttcagtgaagtacttaccatcagatggctttggtgggctgagctccaaactgtacatatacaagacatccgattcacctgaccgtctcccatcgtctcagacctgcttctaccgcctctgcctccctccttatacatccttgaaaatgatggaaaaccagctgcagaagatcacacaagagcatgtgagctgcagcttcggtgcatggtagttgctgccattctggagccggaaccggcatattctgtacatatcgtagtctagtgccatcctgttatctcattgcatctgatcgtagaagcttgaatgaaggtaataggttgtttttttccccttttgtatgtaccgtgagttagtgttctgagacacttaacctaatgtagatggaattggtagaaagcagattccttttatttc

SEQ ID NO: 27941 - protein, 277 aa, Panicum virgatum
  misc_feature: Ceres CLONE 1880342
  misc_feature (1)..(277): Pfam Name: HECT Pfam Description: HECT-domain (ubiquitin-transferase)
PLHLKYFTFAGRIIGLALMHKVQVGIVLDRTLFLHLAGRSITLEDISVADPVKYASFKRILEMNAAEIDDLYLTFSRGAHELGTQEIIDLCPGGQDISVNIRNREQYIDLLIKNTFVDSISAQLTHFTQGFTDILVNPDRRKDFFECLDLEDLDRLLGGSNDTINLQDWKSHTQYNGYKEKDRLITWFWKAVERMSMEQQRLLLFFWTSVKYLPSDGFGGLSSKLYIYKTSDSPDRLPSSQTCFYRLCLPPYTSLKMMENQLQKITQEHVSCSFGAW

SEQ ID NO: 27942 - DNA, 604 bp, Panicum virgatum
  misc_feature: Ceres CLONE 1880376
  misc_feature: Encodes the peptide sequence at SEQ ID NO. 27943
ctgccgccgccgccccggcgacgcctcaccacccgcagctcctccaccagcagcagcagcagcaagacgtcgttgcggcgatgagcggcggcggggagcccgtgggcgcggcggccgcggcggcgtcggagctgatccggcgcaacctggcggagcagatggcgatgaccctgacgagggaccccagcttcaaggcggccctcgtcaccgcgctgtccggccggatcctcgagctctcgcccaccaaggattaacataccatcaccatcacacgagattcttcttggttgctcagattttctcgcagccatggtcaactgttgttggccttcctctgctcactgttctggcaaaacagcgagaacactggacatgaggatctgcagttcggcatcaggaattcaggatcaaccgcgccgcgcgcatccggacatggcgcggaccgaagatcatcacggcgggtggtctgatcggccggcgagatggtcgagtttagcagatcgaaaacagcacaggaaacaacatgaaactgtacaatccttataggcaaaaaacattgttcgcccatttttgcttgatcaaatgaaatcaatatttttttttg

SEQ ID NO: 27943 - protein, 83 aa, Panicum virgatum
  misc_feature: Ceres CLONE 1880376
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
AAAAPATPHHPQLLHQQQQQQDVVAAMSGGGEPVGAAAAAASELIRRNLAEQMAMTLTRDPSFKAALVTALSGRILELSPTKD

SEQ ID NO: 27944 - DNA, 826 bp, Panicum virgatum
  misc_feature: Ceres CLONE 1880418
  misc_feature: Encodes the peptide sequence at SEQ ID NO. 27945
gtcgcagcagcaatccatatccaagcaagaagaagagcagcataagaccacttgatctgagacacatcatcgatcagacatctatctctgctggcgagctcgatcaagctcaccgccggccggcgatcatatcaattcatatattatcgattaggtacctcgaaggcgaagcagaccgatcgaggatggttgtcgcgtcgtcgtcttctgccaccaccaccaccagcagaagcagcagcagcagcagcagcagcgagctgggtgccctgttcgccgcgttcgacaaggacggcgacggccggatctcggcggcggagctgcggctgtgcatgaaggcgacgcttggcgaggacgtgtcggcggaggacgcggaggcgctggtggcctcggtggacgcggacggcgacgggctgcttgccgcggccgagttcgcgcggctggtgcacgccgaggtcggggaggaggagcgccaccgggggctccgccaggcgttcggcttgtacgagatggagggccagggctgcatcacccccaccagcctcaagcggatgctcagcaggctcggcgcgcaccaggagatcgacgactgccgcgccatgatctgcaggttcgacctcgacggcgacggcgtcctcagcttcgacgagttcaagatcatgatgaacgccgcatgaaacacagatacatgtatagattgtgcttgcatgcgcttcattgctctaggatttgttcatatacatatcccatccattcattcaatttcatttggtatatatatggttaataaatctggcactgtgtctgtgcatattcgtttattcagcag

SEQ ID NO: 27945 - protein, 162 aa, Panicum virgatum
  misc_feature: Ceres CLONE 1880418
  misc_feature (24)..(52): Pfam Name: efhand Pfam Description: EF hand
  misc_feature (134)..(162): Pfam Name: efhand Pfam Description: EF hand
  misc_feature: SWISSPROT Homolog: EC 2.7.11.1 Non-specific serine/threonine protein kinase
MVVASSSSATTTTSRSSSSSSSSELGALFAAFDKDGDGRISAAELRLCMKATLGEDVSAEDAEALVASVDADGDGLLAAAEFARLVHAEVGEEERHRGLRQAFGLYEMEGQGCITPTSLKRMLSRLGAHQEIDDCRAMICRFDLDGDGVLSFDEFKIMMNAA

SEQ ID NO: 27946 - DNA, 480 bp, Panicum virgatum
  misc_feature: Ceres CLONE 1880447
  misc_feature: Encodes the peptide sequence at SEQ ID NO. 27947
ctaacaaaagttgatctgagaaaggtgttcaggaagagaactattaaggaattgaccgagactaacctttctgcaaatcaaaagaagtcagatatgaagaaactcaactggaaggttgtcggggacactgaaaatggtcccgctccaataaaaggcggcccggttgatagtcaagctctggttattgagctcggacccatggagatacgcacgttcttgctgaaattttaattgcatttatatatgatgtatataagaaaacaaatacgcctagaaaagttcaaggaatgtttttacgggcacatgataacagtctgcggattgatagtcattagtatgtttgtttcttcttttttatatgtaaaggttgtgtgtccatcaggcaaaggtcgggagcctttcaattttttgttatatggattttcgttatatcatcctgatgtaactttacttgaaattaataaaacttctttttttttg

SEQ ID NO: 27947 - protein, 76 aa, Panicum virgatum
  misc_feature: Ceres CLONE 1880447
  misc_feature: SWISSPROT Homolog: EC 3.2.1.24 Alpha-mannosidase
LTKVDLRKVFRKRTIKELTETNLSANQKKSDMKKLNWKVVGDTENGPAPIKGGPVDSQALVIELGPMEIRTFLLKF

SEQ ID NO: 27948 - DNA, 716 bp, Panicum virgatum
  misc_feature: Ceres CLONE 1880460
  misc_feature: Encodes the peptide sequence at SEQ ID NO. 27949
aacaacacatcaacgcaagaaaagtcgaccctcgtgcgatccagagctaggatttgcgctcgacgtagccaagcttttcgagtccacgaggagaagcggcaggtcaagctagcgagaaaagctttgcaggtcagcagcggggcgcatggccatggaggtccagggctccaggcggcaccaggacgccggcgtgaaggtcaagttcatcgagacgcacttcatcagctccgacgccgccagcttcaaggccgtcgtgcagcgcctcaccggcaacggcaagtcccccgccgcctcatcgaggccggcccaggcgccactggcgccgcagccgcagaggccgcgtccttgccggccggccttcggtggcgcggtgcagcagcaccagcagcatcaggccgccgggtggccggagcagcaccaggctggcgcctacctggtcgctccggcggcgaagcaggtgccgctcgcggcggcggcggcaaccctggaggagatgcacgagctctgcgacttcgcggacctgttctacaccaccagcgcggccgcgggcgcgcggcgcgacattactggctgcgccttcccttactgaatttgttttaccgagcaccaatgcttgtagtttgcctttgcaaattcgcagtctgtctagcacattattaatggtcgaggagttgatgcgacgagagatggtcatggtctgccacgccttttttttt

SEQ ID NO: 27949 - protein, 147 aa, Panicum virgatum
  misc_feature: Ceres CLONE 1880460
  misc_feature (19)..(49): Pfam Name: VQ Pfam Description: VQ motif
MAMEVQGSRRHQDAGVKVKFIETHFISSDAASFKAVVQRLTGNGKSPAASSRPAQAPLAPQPQRPRPCRPAFGGAVQQHQQHQAAGWPEQHQAGAYLVAPAAKQVPLAAAAATLEEMHELCDFADLFYTTSAAAGARRDITGCAFPY

SEQ ID NO: 27950 - DNA, 706 bp, Panicum virgatum
  misc_feature: Ceres CLONE 1880463
  misc_feature: Encodes the peptide sequence at SEQ ID NO. 27951
aaaagcgcagcgcagcgaaggctttggttccgcgaccgcgacctcgattcggaccgaagctagggtttaggcttccgcagcgaatcgaggaggggggagggagtaggagcggcggcggcgatggcggcggaggaggacatggcggtgaaggagccgctggatctgatacggctcagccttgacgagcgcatctacgtcaagctccgctccgagcgcgagctccgcggcaagctccatccatatgatcagcatctcaatatgatacttggagatgtcgaagagacagtgactagtgtagaaattgatgatgagacttatgaggagatcgttcgcacgagcaaacgcactgtcccctttctttttgtccgaggagatggtgtaatactggtttccccacccttgcggacggtgtgaacgttggggcggtgcattctgcagtcctacagcagtggtcggggaagttttattgggagaagcaaacggctggtttctgagatggacaggttaagacaggagcattgtgcttcaactatggctgtgtatttgaatccacctcccagtttgggcagcttaatcttatcctgttatcagctcggtaaagtacggcgaacgagaatcacatgttgtggattcactggtgtgatcctcttcataagcacttgttttccgatgtgtaaatttgaactgacttgacattgattcatgt

SEQ ID NO: 27951 - protein, 97 aa, Panicum virgatum
  misc_feature: Ceres CLONE 1880463
  misc_feature (14)..(92): Pfam Name: LSM Pfam Description: LSM domain
MAAEEDMAVKEPLDLIRLSLDERIYVKLRSERELRGKLHPYDQHLNMILGDVEETVTSVEIDDETYEEIVRTSKRTVPFLFVRGDGVILVSPPLRTV

SEQ ID NO: 27952 - DNA, 493 bp, Panicum virgatum
  misc_feature: Ceres CLONE 1880534
  misc_feature: Encodes the peptide sequence at SEQ ID NO. 27953
tttggaaagcattaccccaagcatgttcaccaccgcggtgcgtcgatccccaagaacggtgttcactatggctgcaaaggagggtggaagtggagggacaccaagaagccaaaccctaacatcatagttggagccatggttgctggcccggatcgccatgatggattcaaagatgcccgcaagaactccaactacactgaagcaacgctggcgggcaatgctggtctagtcgcagcattggtagctctgtcaggtgaaggccatggggtggacaagaacacgatgttctctgccgtgccacccatgttcccttcgcctccaccaccaccggcgccatggaaaccatagtgcgtgcgagtatctgattcttttgtatgctacgtattttagattagttttttcttatatcctgccgcaatactgctgtggagttctaacaagtgaagatgtagcatcgccatttggtctcatttggtctctttttcagtgttgt

SEQ ID NO: 27953 - protein, 115 aa, Panicum virgatum
  misc_feature: Ceres CLONE 1880534
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
FGKHYPKHVHHRGASIPKNGVHYGCKGGWKWRDTKKPNPNIIVGAMVAGPDRHDGFKDARKNSNYTEATLAGNAGLVAALVALSGEGHGVDKNTMFSAVPPMFPSPPPPPAPWKP

SEQ ID NO: 27954 - DNA, 592 bp, Panicum virgatum
  misc_feature: Ceres CLONE 1880599
  misc_feature: Encodes the peptide sequence at SEQ ID NO. 27955
gaaactgacgcacgcaaaaggactggactgcggcgaccagcgcgacgaccggaggaggaggaggagagaggaggaggaagccaaggagaccaaccgaggaagaggatggtggcgccgacggatccgatgctgtggcacaaggtggccgccgtctccggggtcgctgctcttggactcggcacctacggcgcgcacatgttccgccccaagaaccccgcgtacaaggaggtctggcacaccgcgtccctgtaccatctcgtccacaccgccgcgctgctcggggctcccctcacaaagcatcccaatgttttcggagggctactcactgctggaatcgtgctattctctggaacgtgctacaccgtggcttatcttgaagacaggaagttctcttcaccggcaccactgggtggctttgcattcatcgccgcttgggccagccttctcttctgatgaaactgtgctttagccaataaaacaaaaaatcttaaagctctgtatttggtgctttattattaggttatgaaaactgtacttgtacattgtacggtatgcatcctgggttaaataattcaatctgtggttttgtgtc

SEQ ID NO: 27955 - protein, 115 aa, Panicum virgatum
  misc_feature: Ceres CLONE 1880599
  misc_feature: Functional homolog of the protein sequence given in SEQ ID NO 51266
  misc_feature: Useful for biocontainment applications
  misc_feature: Useful for making plants with modulated biomass
MVAPTDPMLWHKVAAVSGVAALGLGTYGAHMFRPKNPAYKEVWHTASLYHLVHTAALLGAPLTKHPNVFGGLLTAGIVLFSGTCYTVAYLEDRKFSSPAPLGGFAFIAAWASLLF

SEQ ID NO: 27956 - DNA, 712 bp, Panicum virgatum
  misc_feature: Ceres CLONE 1880611
  misc_feature: Encodes the peptide sequence at SEQ ID NO. 27957
agccagctcccagctctcctctcacactgctccactccctcacctagaagagaacacagaaccggatccagagcagagcgtgttgcgccggcctagctcttgggtcgtcaagtctccgttcgttctttctttctccaaccggcagctgatctcctgtgttaatcccgaccggagctgcctgcgatgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggagtagctagtagccggggaggagtagtagatagagtagcaagttgctgctggtgtttgttgctgttggatcattttttttcctactttatattctctgctacgcttgtgtgcgctctagttggatgttgatttggaaatccttagtggtagtaagtaaggcttgtaaaggctagctagtagtagtgtttgttgccttgttgatctctgttttcttt

SEQ ID NO: 27957 - protein, 103 aa, Panicum virgatum
  misc_feature: Ceres CLONE 1880611
  misc_feature: Functional homolog of the protein sequence given in SEQ ID NO 50155
  misc_feature: Useful for biocontainment applications
MSSVEVAPRQHKVTVAGYVDAGKVMRRLARRTGKRVEPWPYVPYDVVAHPYAPGAYDKKAPPGYVRNVVADPAAAPLARASSTEVRYTAAFSDENPNAACAVM

SEQ ID NO: 27958 - DNA, 525 bp, Panicum virgatum
  misc_feature: Ceres CLONE 1880617
  misc_feature: Encodes the peptide sequence at SEQ ID NO. 27959
gacagcagttggacacaccctgcacggagggctctcctcgtacacagctcgccacaccaccaccaagtattaataggcgagaggttgacgtacgaacagctaggtagaggtcatttcggggaaaaaggacaagacaacagaacatgcctgactgggcgccgatgttcatctcgctggtgctctgcatcctgctgtcgccgggcctgctgttcccgatcaccggcaagtgccgggtcatcaagttcggcaacttccacacctacctcgctctccatcctcgtccactccatcctcttcttcgccctcgtccccatcttcctcaacgccatcggcctgcacatgtacctcttgtcctagctagactggtactagcttttgttaccctgatgcctacatctgtgtttgtagatccgcttgcacctgcatcgtgttcttcactgctatgcctccatctctaattaagacttctttcactataaacgtggtgaataactgtgcaagtatcatcaatgttcatttctttct

SEQ ID NO: 27959 - protein, 104 aa, Panicum virgatum
  misc_feature: Ceres CLONE 1880617
  misc_feature: Functional homolog of the protein sequence given in SEQ ID NO 50117
  misc_feature: Useful for making plants with altered cell wall content and/or composition
MPDWAPMFISLVLCILLSPGLLFPITGKCRVIKFGNFHTYLALHPRPLHPLLRPRPHLPQRHRPAHVPLVLARLVLAFVTLMPTSVFVDPLAPASCSSLLCLHL

SEQ ID NO: 27960 - DNA, 749 bp, Panicum virgatum
  misc_feature: Ceres CLONE 1880619
  misc_feature: Encodes the peptide sequence at SEQ ID NO. 27961
aacttgctctttctcctcctcgtcgctctcgctcctattctgaacacaccaccaaggccgtcttcctgacggtgaggtcgcccacagccacaatgtcgtggctcctggtcgtcgccgtgctcgccggattcgcggtcgatccgtcggcggcgacggaccacatcgtgggcgccaaccacgggtggaaccccaacatcaactactccctctggtccggcaaccagaccttctacgtcggcggcctcatctcgttccggtaccagaaggggacgcacaacgtgttcgaggtgaacgagacggggtacgacaactgcaccatggacggggtcgccggcaactggacctccggcaaggacttcatccccctccccgaggcccgccgctactacttcatctgcggcaacggcttctgcatgcaaggcatgaaggtcgccatcaccgtccacccgctccggcacaacgcctcctctaatggctccggcgcgcagggagaggcctccgcggcagcgctcaggacgaggagcgccgcgtggctggcggcaaccgctgtcgccgtggctgcctttggtgcattctgctaggactttgattcccagatttctctgaacattttttatttgttctattttttatttgttctatttgtgtgctatgctcccgtttcatgggtcttcatcaacttctctgcaagcgaaactgcctgtgtctcgagtaacgttgagctgaacgagaactgctacagattcagc

SEQ ID NO: 27961 - protein, 162 aa, Panicum virgatum
  misc_feature: Ceres CLONE 1880619
  misc_feature (31)..(111): Pfam Name: Cu_bind_like Pfam Description: Plastocyanin-like domain
MSWLLVVAVLAGFAVDPSAATDHIVGANHGWNPNINYSLWSGNQTFYVGGLISFRYQKGTHNVFEVNETGYDNCTMDGVAGNWTSGKDFIPLPEARRYYFICGNGFCMQGMKVAITVHPLRHNASSNGSGAQGEASAAALRTRSAAWLAATAVAVAAFGAFC

SEQ ID NO: 27962 - DNA, 559 bp, Panicum virgatum
  misc_feature: Ceres CLONE 1880635
  misc_feature: Encodes the peptide sequence at SEQ ID NO. 27963
ctgcagcgccggtttggtttggtttggttggggtcggagcagggggtcgccgtcggcttgctttaatacgcgggggagcgggcgcctccccagcgtctgccgagagagttcgggaggaggaagaagagggtgaggagggtcatcggacatgtcggactgggggccggtggtggtggcggtggtgctgttcgtgctgctctcgccggggctgctgctgcagctgccggccaagggcggccgcctcatcgagttcggcaacttccagaccagcggcgcctccatcttcgtccacgccatcatcttcttcgccctcaccgccgtcttcctcatcgccatcggggtccacatcaccaccgactagccggccggccttagctgccgagcacctcgtacgatacggcagcctgtatgtgcatcagtatttgcagattgtaaatttgtaactgtactgtacccctcggctagcagttaaagcgtttatatatgcagggatttgtaatcttcttatcagacggattttaaaactattgtacactatccactgaatttctttctgatc

SEQ ID NO: 27963 - protein, 70 aa, Panicum virgatum
  misc_feature: Ceres CLONE 1880635
  misc_feature: Functional homolog of the protein sequence given in SEQ ID NO 50117
  misc_feature: Useful for making plants with altered cell wall content and/or composition
MSDWGPVVVAVVLFVLLSPGLLLQLPAKGGRLIEFGNFQTSGASIFVHAIIFFALTAVFLIAIGVHITTD

SEQ ID NO: 27964 - DNA, 733 bp, Panicum virgatum
  misc_feature: Ceres CLONE 1880645
  misc_feature: Encodes the peptide sequence at SEQ ID NO. 27965
agctgtgccggtgtcagtcacttccgcacaagcacaaacacacaccgccgaccgacaaccgcttctccgccatccttagccgcatcctccgcgagaacctgagaagtgatcggcgaggagccacggctgcagcggcagcaccatctcgccgcgcgccggcgccgctgctcctcgtggcggtggcggccgccgcgctggcgctggcgctcgcgccgcggcccgcgggggcggcgctgtcgtgctccacggtgtacaacacgctgatgccgtgcctcgggtacgtgcagtcgggcggggcggtgccccaggcgtgctgctcggggatccagagcctcctgtccgaggcgcgcaccacccccgaccgccgcgccgtctgcacctgcctcaagaacgtggcggcgggcgccgccggcgggccctacatcagccgcgccgccgggctgcccggcaggtgcggcgtctcgctgccctacaagctcagccccaacatcaactgcaactcgatcaactgatgaggtgcctctactgtcagccctggagtcgtcggcacgagatcatgggagggccgtaggacctgctgatgcttctactggccttaataaagttgtgagatttaggaccggtgaatctcttactatatactgtatatgtgtcccataatatgcttgaggcatacagacgaatacgttgtgaaatgatacgaataaatggacgtacgatgatgcagccgtac

SEQ ID NO: 27965 - protein, 169 aa, Panicum virgatum
  misc_feature: Ceres CLONE 1880645
  misc_feature (80)..(165): Pfam Name: Tryp_alpha_amyl Pfam Description: Protease inhibitor/seed storage/LTP family
LCRCQSLPHKHKHTPPTDNRFSAILSRILRENLRSDRRGATAAAAAPSRRAPAPLLLVAVAAAALALALAPRPAGAALSCSTVYNTLMPCLGYVQSGGAVPQACCSGIQSLLSEARTTPDRRAVCTCLKNVAAGAAGGPYISRAAGLPGRCGVSLPYKLSPNINCNSIN

SEQ ID NO: 27966 - DNA, 670 bp, Panicum virgatum
  misc_feature: Ceres CLONE 1880663
  misc_feature: Encodes the peptide sequence at SEQ ID NO. 27967
agatcccgattcgatcagccgccatggcccgctcctcttcgcagtcccagtcctccgtcggcggcgccggcgccggcgccggagcccgcccggccaccgttggcccgcgcggcacggccgcagctgccgccggcatgcgccgccgccgcgccaccgccagcgccgggggagggggcttctccggcggcggagggagcaacatgcttcgattctacaccgacgaggccccgggtctgcgcctctcgccaaccatggtgctcgtcatgtcgctgtgcttcatcggattcgtcaccgccctccacgtcttcggcaagctctaccgctcccgcaccgcagcagcctccgcgtgatccatcccatcccatcccatcccatccctccggcgcgagtatcatcagatcacaaggttttcaatatatcatcatcagtctacttactcgtcttgcctagctttccttcctgtgctagatctggagggagatgaatggaaccctacaacttaaatgatgccctttcttttgccttgttcatcccctttccttttttttagtgcctttttatttactcccagatgcaaagagttgtgcctagtcactgtaatcatggggttgctacaattaattttgcatctcagtaacttagcgtgtgctccaggaatcgtgcatcttgc

SEQ ID NO: 27967 - protein, 108 aa, Panicum virgatum
  misc_feature: Ceres CLONE 1880663
  misc_feature (54)..(99): Pfam Name: Sec61_beta Pfam Description: Sec61beta family
MARSSSQSQSSVGGAGAGAGARPATVGPRGTAAAAAGMRRRRATASAGGGGFSGGGGSNMLRFYTDEAPGLRLSPTMVLVMSLCFIGFVTALHVFGKLYRSRTAAASA

SEQ ID NO: 27968 - DNA, 725 bp, Panicum virgatum
  misc_feature: Ceres CLONE 1880669
  misc_feature: Encodes the peptide sequence at SEQ ID NO. 27969
agaacatcacgtttgagaactcagctccccagggctctggacaggcagttgcagtacgggtgacagcagatagatgcgctttctatagctgccggttcctcggttggcaagacacattatatttacactacggaaaacagtacttaagaaactgttacattgaaggccattgcgacttcatctttggcaactctgttgcacttatggaacattgccacatccattgcaaagcagctggatacatcactgctcatagccggaaatctacttccgaaactactggctatgtattcttgaggtgcattattactggaaatggagaagctggatatatgttcctaggtcgcccatggggaccctttgggagggttgtctttgcacacacttttatggatcgatgcatcaagccttctgggtggcataattgggacaaatccgagaatgagcggactgcttgcttctatgagtacagatgctcagggccaggctctcgctcatcaaaccgggtggcttggtgcagacagttgctcgatgtagaagcagagcatttcctctcgcacacttttattgatccagacctcgataggccatggctcctccagatgatgtcaacaagaataccagcctcagcataggctgatccccataggatcctggtttatccctcctatcgagtccatctaataaataaagctggagggtgtatttatttaattttatagttt

SEQ ID NO: 27969 - protein, 210 aa, Panicum virgatum
  misc_feature: Ceres CLONE 1880669
  misc_feature (1)..(192): Pfam Name: Pectinesterase Pfam Description: Pectinesterase
  misc_feature: SWISSPROT Homolog: EC 3.1.1.11 Pectinesterase
  misc_feature: Functional homolog of the protein sequence given in SEQ ID NO 51267
  misc_feature: Useful for making plants with altered cell wall content and/or composition
  misc_feature: Functional homolog of the protein sequence given in SEQ ID NO 51268
  misc_feature: Useful for making plants with altered carbohydrate content
NITFENSAPQGSGQAVAVRVTADRCAFYSCRFLGWQDTLYLHYGKQYLRNCYIEGHCDFIFGNSVALMEHCHIHCKAAGYITAHSRKSTSETTGYVFLRCIITGNGEAGYMFLGRPWGPFGRVVFAHTFMDRCIKPSGWHNWDKSENERTACFYEYRCSGPGSRSSNRVAWCRQLLDVEAEHFLSHTFIDPDLDRPWLLQMMSTRIPASA

SEQ ID NO: 27970 - DNA, 686 bp, Panicum virgatum
  misc_feature: Ceres CLONE 1880708
  misc_feature: Encodes the peptide sequence at SEQ ID NO. 27971
acggatatttccccgccctcctcctgccgcggttcgcgttgctgcgccgcgatccgggaacagaatcgaggaggagggcggaggagccctggcgagcgagcacgcggagcccaagcacacgcagagcctgatggaccaggccaaggagttcgtggcggacaagatcccgcacctcccccagccggaggcgacgctcgacggcgtctccttcaggagcatgagccgcgagtgcatctccctgcgcagcaacgtcaacgtctccaacccctacgaccaccgcctccccatctgcgaggtcacctacgccctcaagtgcgccggcaaggttgtggcgtccggcaccgtgcccgaccccggctggatcgccgccagcgacaccaccatgctggagatccccgccaaggtgccctactacttcctcatctcgctcatgacggacgtgggcagggactgggacatctactacgagctccaggtcgggctctccgtcgacctccccatcatcggaaacttcaccatcccgctctcctccatcggccagctcgagctcccttccctcgaggacatgttctaatagttcttcgtattccgtggcgtcgaccttgtaccaccaatgtaactctgtcatctcatccccacggctgtatgaatcctagtgccgtcttgcatatatacgcatatgctct

SEQ ID NO: 27971 - protein, 147 aa, Panicum virgatum
  misc_feature: Ceres CLONE 1880708
  misc_feature (1)..(147): Pfam Name: LEA_2 Pfam Description: Late embryogenesis abundant protein
MDQAKEFVADKIPHLPQPEATLDGVSFRSMSRECISLRSNVNVSNPYDHRLPICEVTYALKCAGKVVASGTVPDPGWIAASDTTMLEIPAKVPYYFLISLMTDVGRDWDIYYELQVGLSVDLPIIGNFTIPLSSIGQLELPSLEDMF

SEQ ID NO: 27972 - DNA, 708 bp, Panicum virgatum
  misc_feature: Ceres CLONE 1880727
  misc_feature: Encodes the peptide sequence at SEQ ID NO. 27973
gaccatcaccattattcatttctcgcatttgccgcgcccacccgaccacgaaggaaggagaagaaaagatcccgatggacaacgccaccacgaagccatcgctgtccattaagccctcgccggctgtccgccacgggaacagccgcctgttcgcgctggggctgcgcctgctgttccacctcttcgaccgcgacgggaacagggagatcgccctcgaccaggtggcctccgcgctcgacacgctccggctccgcgcccaccgctccggcctggacgccgacgtcgggcggtccgtccccgccggggccgcggagctccgcttccacgacttcgagtccctccaccgcgcgctcggggactccctgttcggccccatcccggaggcggtgcccgacgaggaggacgaggagggggacgtgatggacgcgttccgcgtgttcgacgaggacggcgaccgctacctctccgccgccgagctcctggccgtgctcaagaagctcggcctgcccgaggcgcgcaacctcgccacggtgcacgagatgatctgcaacgtctacagcgaccgcgacggccgcgtcgacttcgagcaagttcaagaacgtgatgcaggggatcaccgtgtggggcgcctagctgcaccgtccctgcgttgccaaccttctacagtgtgttgacgtgttctgaggcatctaaggactggaggaggag

SEQ ID NO: 27973 - protein, 199 aa, Panicum virgatum
  misc_feature: Ceres CLONE 1880727
  misc_feature (114)..(142): Pfam Name: efhand Pfam Description: EF hand
MDNATTKPSLSIKPSPAVRHGNSRLFALGLRLLFHLFDRDGNREIALDQVASALDTLRLRAHRSGLDADVGRSVPAGAAELRFHDFESLHRALGDSLFGPIPEAVPDEEDEEGDVMDAFRVFDEDGDRYLSAAELLAVLKKLGLPEARNLATVHEMICNVYSDRDGRVDFEQVQERDAGDHRVGRLAAPSLRCQPSTVC

SEQ ID NO: 27974 - DNA, 682 bp, Panicum virgatum
  misc_feature: Ceres CLONE 1880733
  misc_feature: Encodes the peptide sequence at SEQ ID NO. 27975
aaaaaaaaaaaaaaaaatccatcgtcgcatctctcctcggtagccatctcttcaaggcagcgggtggcggtggtgcatttctgggatgggactgctgttcgtggagcggctcgagggggagggcgtgttcaggtgccggcgctgccgcgtggacgccgcctccaaggacgccatcatctccagggacttctacggccgcaccggccgcgcctacctcttcgaccacgttgtgaacatatgcctaggaccgaatgaggatcgaaatcttgcaactggcctccacacagtgaatgacatctactgtagctgctgccaacagattcttggctggagatatgagagagcctacgaccaaagccagaaatacaaggaagggaagtacatcctggagagagctagaatggtgaaagacggctgacgatcatcggaatgttttttttgaaagtttatcatcggaatgttcttaccaccgaaaattgaagaagcgcacaaccataaagatatcgggcagcttgagctcgctgccgattagctagggagatgattgcagatgctgtgatttgtggaaaattactgattctgaattctcgtaaaaggattctggtaacttgttagcagtgctaacgtttggtgacttattggtgatccggtgaatagtaatgaagctgatttcactctgatc

SEQ ID NO: 27975 - protein, 110 aa, Panicum virgatum
  misc_feature: Ceres CLONE 1880733
  misc_feature (1)..(109): Pfam Name: Yippee Pfam Description: Yippee putative zinc-binding protein
MGLLFVERLEGEGVFRCRRCRVDAASKDAIISRDFYGRTGRAYLFDHVVNICLGPNEDRNLATGLHTVNDIYCSCCQQILGWRYERAYDQSQKYKEGKYILERARMVKDG

SEQ ID NO: 27976 - DNA, 620 bp, Panicum virgatum
  misc_feature: Ceres CLONE 1880773
  misc_feature: Encodes the peptide sequence at SEQ ID NO. 27977
actccttccagaacagctggcaatcgacgagagggggccagctagctcctcttcaggttgcaacacacacagacacacacaagccatggcgatccggggcgtcgcctcctccctcgaccgcgaggacatgacgctggaggagttcaaagagtggctcaagcagttcgacgccgacggcgacggccggatcagcaggaacgagctccgggaggccctccgccgccgcggcgggcggttcaccaccttgaggagcggccgcgcccttcgccaggccgacaagaacaacagcggcttcctggacgactccgagatcgagaacctcgtcgccttcgcccagaaagatctcggcatgaaggtatccacctggtagaacaaccaagcagcgcggagtggcagacagatgcatcatcctcctgcatcgatctatgacagaacgaatctggctatgaactgatgagccagcagtgtccttgtatcgtagcacctagctagattttgagatgctgtctttgtttaattttctccccttgctataatttgtgtggcggattctacaaactttaatatccagggtatggtatgtgtaaacaccgcaaattaatggaggggtgttagtttgt

SEQ ID NO: 27977 - protein, 94 aa, Panicum virgatum
  misc_feature: Ceres CLONE 1880773
  misc_feature (19)..(47): Pfam Name: efhand Pfam Description: EF hand
MAIRGVASSLDREDMTLEEFKEWLKQFDADGDGRISRNELREALRRRGGRFTTLRSGRALRQADKNNSGFLDDSEIENLVAFAQKDLGMKVSTW

SEQ ID NO: 27978 - DNA, 501 bp, Panicum virgatum
  misc_feature: Ceres CLONE 1880775
  misc_feature: Encodes the peptide sequence at SEQ ID NO. 27979
tttgcttgatgtgaaaccatgggatgatgagactgacatggccaagcttgaggaagcagtaaggaatgtcaagatggaaggactgctctggggagcatccaagcttgtcccagttgggtatggcatcaagaagcttcagatcatgttgactattgttgatgaccttgtttctgttgacactctgatcgaggaccatctgtgcgctgagccagtgaacgagcacgtccagagctgtgacattgttgccttcaacaagatctaaatctgctgggcgcaggctgtggtcagtggacactgcaccgatccaaaatatcctgagttttgcatgtggactagttatgtctgttccgtgtgtcgactagttattgcctgtgaggtttttggaacctagtcaaaagtgtaccagttctgttaccagggttaatttgcattatttgaaagaccgactggctggattttctgtttcttctattcgtaatatactctctctttcctggttag

SEQ ID NO: 27979 - protein, 86 aa, Panicum virgatum
  misc_feature: Ceres CLONE 1880775
  misc_feature (1)..(86): Pfam Name: EF1_GNE Pfam Description: EF-1 guanine nucleotide exchange domain
LLDVKPWDDETDMAKLEEAVRNVKMEGLLWGASKLVPVGYGIKKLQIMLTIVDDLVSVDTLIEDHLCAEPVNEHVQSCDIVAFNKI

SEQ ID NO: 27980 - DNA, 703 bp, Panicum virgatum
  misc_feature: Ceres CLONE 1880799
  misc_feature: Encodes the peptide sequence at SEQ ID NO. 27981
caagatcaccagaccattgatacgtgtgcccacactggccatacatcttaaccgcacagtgaattctgatggcttcaagcctaacctagagacccatcttgttccacttcttgcaacaaagcatgaagaagcaactataaattctgatgacaaaagttctagctctacaaaagtcgcccaccatccgctacttttgcagattctctcagaggaaattggttgtgaatctgatgaaataattggtatggagttgaacgtatgtgatactcagcctagctgccttggtgggggaaacaatgagatcatctattctggaagactggataatcttgcttcatgttattgtgctctcagatctctcatggactcttccaaggtggcagaacaactgtccagtgagaaggctataagaatggttgctatgttcgataacgaggaggtgggttcagattcaatgcaaggggcaggtgcaccaaccatgttccaggctatgagacgaatcgtcgattccttgatgcatcaatcaatgggggagggagctttggaacgtgcaatacattcttcattccttgtttcggcagacatggctcatgccctgcacccgaactattcagacaagcatgaagagtgccatagaccagaactacagaagggtcttgtcatcaagcacaatgctaaccaacgttatgccacaagtgctatt

SEQ ID NO: 27981 - protein, 233 aa, Panicum virgatum
  misc_feature: Ceres CLONE 1880799
  misc_feature (1)..(233): Pfam Name: Peptidase_M18 Pfam Description: Aminopeptidase I zinc metalloprotease (M18)
  misc_feature: SWISSPROT Homolog: EC 3.4.11.21 Aspartyl aminopeptidase
KITRPLIRVPTLAIHLNRTVNSDGFKPNLETHLVPLLATKHEEATINSDDKSSSSTKVAHHPLLLQILSEEIGCESDEIIGMELNVCDTQPSCLGGGNNEIIYSGRLDNLASCYCALRSLMDSSKVAEQLSSEKAIRMVAMFDNEEVGSDSMQGAGAPTMFQAMRRIVDSLMHQSMGEGALERAIHSSFLVSADMAHALHPNYSDKHEECHRPELQKGLVIKHNANQRYATSA

SEQ ID NO: 27982 - DNA, 722 bp, Panicum virgatum
  misc_feature: Ceres CLONE 1880815
  misc_feature: Encodes the peptide sequence at SEQ ID NO. 27983
acctccgaccgagccgagcacctccctctggcccttccccctccaccttcctcccccctaccgccggccggctagtagaaagaaagaatgctactgctgagcccccccttggtgtccccggcgctgcgggtctctccgcagctgcagctgcagctgcagctgcagccggggaatgggtgtcgcctccggatcgaggcggcgaggcagctgacggggcgggtggtgacgaccaaggcggacaagacggtgggcgtggaggtggtgcgcctggcgccgcaccccaagtacaaacgccgggagcgcatcaagaagaagtaccaggcccacgaccccgacaaccagttcaaggtcggcgacgtcgtcgagctccgcagctcccgccccatctccaagaccaagcacttcatcgccgtcccgctcccgccccgcgacacccgccgcaagtcgcagctcctaccgccgctccagtcgcagcagccgccgccgccggccgagtgaccgaccaccaccatcattcgtattcgtattccccatatgtttgtttccttcctgtaatgccttgcatgagtaaccaaccactctagaccagaggttgtgtaatttggccaaaatttcccctgcctacttattattatttattgcatatatatgcatatgtttgcgcctgcgtcgtattgctcttgcccttctcttccttttatctcaccgccaccatcatcata

SEQ ID NO: 27983 - protein, 136 aa, Panicum virgatum
  misc_feature: Ceres CLONE 1880815
  misc_feature (43)..(111): Pfam Name: Ribosomal_S17 Pfam Description: Ribosomal protein S17
MLLLSPPLVSPALRVSPQLQLQLQLQPGNGCRLRIEAARQLTGRVVTTKADKTVGVEVVRLAPHPKYKRRERIKKKYQAHDPDNQFKVGDVVELRSSRPISKTKHFIAVPLPPRDTRRKSQLLPPLQSQQPPPPAE

SEQ ID NO: 27984 - DNA, 654 bp, Panicum virgatum
  misc_feature: Ceres CLONE 1880876
  misc_feature: Encodes the peptide sequence at SEQ ID NO. 27985
gcagaaaccctagacaccgctcgagccgttcgccgccgcgccgcgccgctccgctcgtcttctcgggctctctccctcccggatccagcaggatgaagtttgttgctgcctatctgcttgctgtcctcgctggcaaccccagcccctctgctgaggatctatcgtccattctggaatcagttggctgtgaaattgacaatgaaaagatggagctgctgctgtcccaactgagcggcaaagacattaccgagctcattgctgctggcagggagaagtttgcttcagtcccatgcggtggtggtggtgtggctgtggcagcagctgcccctgctgctggtggagctgctcctgcagctgaggccaagaaagaagagaaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggtggctacactggttgttggtgtttactggtgaaccagagtttatgcatcatatattaagaatcagttacctagttcgttgatgttctc

SEQ ID NO: 27985 - protein, 112 aa, Panicum virgatum
  misc_feature: Ceres CLONE 1880876
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLAGNPSPSAEDLSSILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 27986 - DNA, 710 bp, Panicum virgatum
  misc_feature: Ceres CLONE 1880937
  misc_feature: Encodes the peptide sequence at SEQ ID NO. 27987
aatcccaactcctgtgtgccccgtcggccgcagcagctgcccgtccccgccgcctccggccgagcacgccgccgccaccgcctccggccgagcacgccgccgccaccgccggcgagggcgcgcgtcgacggcccgtccctttcgcatggatatgacccccgcgtccgtctcgtccaacccgcgctcggtcgaggaaatctacaaggacttctccggccgccgcgccggcctcgtccgcgccctcacctccgatgtggacgatttctacagctcctgcgacccagagaaggagaatttgtgcctgtacggcctccccaacgggacctgggcggtggcgccgccagcggaggaggtgccgccggagatgccggagccggcgctcggtatcaacttcgcgcgggacggcatgcaacgccgggactggctctcactcgtcgcagtccactccgactcgtggctcatttccgtcgccttcttcttcggcgcacgcctcaacgccaacgatcggaagcgcttattcagtatggtcagtgatcttccatccgtctttgaagcattctcagacaggaaacacggcagagataggtcaggcgttgatagcagcggcaagtctagacactcgtcaaagagaggaagcgacggccacgtgaagaattctagagcagcagctcctgctgccaaacagtacgatgatgatgatgacgaagacg

SEQ ID NO: 27987 - protein, 188 aa, Panicum virgatum
  misc_feature: Ceres CLONE 1880937
  misc_feature: Functional homolog of the protein sequence given in SEQ ID NO 50175
  misc_feature: Useful for making plants with altered lignin content
  misc_feature: Useful for making plants with modulated flowering time
  misc_feature: Functional homolog of the protein sequence given in SEQ ID NO 50174
  misc_feature: Useful for making plants with altered alkaloid content
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
MDMTPASVSSNPRSVEEIYKDFSGRRAGLVRALTSDVDDFYSSCDPEKENLCLYGLPNGTWAVAPPAEEVPPEMPEPALGINFARDGMQRRDWLSLVAVHSDSWLISVAFFFGARLNANDRKRLFSMVSDLPSVFEAFSDRKHGRDRSGVDSSGKSRHSSKRGSDGHVKNSRAAAPAAKQYDDDDDED

SEQ ID NO: 27988 - DNA, 501 bp, Panicum virgatum
  misc_feature: Ceres CLONE 1880947
  misc_feature: Encodes the peptide sequence at SEQ ID NO. 27989
tagaaccaatcagatccctagagagatccctgcaaggaagtatccatcatggcttcttgtccttggtgcagggactctgccatttggaaccctgtttattgagctcttcttcattctatcgagcatctggcttggaaggttttactatgtgtttggcttcctgctgattgttctgctgctgcttgtcgttgtctgcgctgaggtgtccgttgtcctaacatacatgaatctctgtgtggaggactggaggtggtggtggaaggctttcttcgcctcaggttctgttgctctctacgtattcctctactccatcaactacttggtctttgacctcagaagcctgagcggacctgtctctgcaatgctttatgtcggctattcattcctcatggcattcgcaatcatgctagcaactggaaccattggctttttgacatcgtttgccttcgtgcactacctcttctcatcagtaaagattgattgatgtattccacggacttc

SEQ ID NO: 27989 - protein, 160 aa, Panicum virgatum
  misc_feature: Ceres CLONE 1880947
  misc_feature: Functional homolog of the protein sequence given in SEQ ID NO 50367
  misc_feature: Useful for making plants with altered cell wall content and/or composition
RTNQIPREIPARKYPSWLLVLGAGTLPFGTLFIELFFILSSIWLGRFYYVFGFLLIVLLLLVVVCAEVSVVLTYMNLCVEDWRWWWKAFFASGSVALYVFLYSINYLVFDLRSLSGPVSAMLYVGYSFLMAFAIMLATGTIGFLTSFAFVHYLFSSVKID

SEQ ID NO: 27990 - DNA, 720 bp, Panicum virgatum
  misc_feature: Ceres CLONE 1880950
  misc_feature: Encodes the peptide sequence at SEQ ID NO. 27991
accgtgcgatctcgcattcctctctccaatctctcgagcctttcctcctcgtccgtcccgagacactcgaagcccagcggcggcatggacaacaccggcaccggagctggcggcaaggtgaagaagggagccggtgggcgcaagacaggcgggccaaggaagaagtcggtgacgaggtccgtgaaggctgggctccagttccccgtcggccgtatcgggcgctacctcaagaagggccgctacgcgcagcgcgtcggcagtggtgcccccgtctacctcgccgccgtcctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccatcgcccacggcggcgtcctccccaacatcaacccggtcctgctgcccaagaagacggcggagaaggcgtccagtggcggcagcaaggaggccaagtcgccgaagaaggcggccaagtcccccaagaaggcatagagggtggacttagatccaaatgtgtagcgccgtctcgtgtttcctgtgatgtttaggttgttgatgagggaaagttgtgggcggatatgagccagtggtgtcgtaacttgtgatctgtggttttcaatggaagaaatggttagttcaacttaactc

SEQ ID NO: 27991 - protein, 159 aa, Panicum virgatum
  misc_feature: Ceres CLONE 1880950
  misc_feature (31)..(104): Pfam Name: Histone Pfam Description: Core histone H2A/H2B/H3/H4
MDNTGTGAGGKVKKGAGGRKTGGPRKKSVTRSVKAGLQFPVGRIGRYLKKGRYAQRVGSGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 27992 - DNA, 708 bp, Panicum virgatum
  misc_feature: Ceres CLONE 1880972
  misc_feature: Encodes the peptide sequence at SEQ ID NO. 27993
actcacctccactcccttgcagggtatcttcacaacttcagaccatcactctctccgattgtatctgttcttcagttcctgttctattcctcttttctttttttagctttcagttcagctcagatcaggtgtctgaacttatctgctgatctttttgggttcttgcaggccaacggtcatgctcctgtaccccctgtacgcgtcggtgcaggcgatggagagcccgtccaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgataagttcgtcagggagcagctcaggaagcacggcctctccgccggcggcggctccagcggcaaggtcaagaaggacgacaagtcgccctcgtcttctcccaaggacaaggagaagcccaagagcaagtttcttgccttcgtcacccccaagaaggatcacgaagcttactgaaacaggccgcagggtgcggtgacatgatcccggcggcttgtcgatgcagagcctatagtgtttctagtgttcagctgtgtttgttcatgcttgtcactcgaaatagagctgtttgatgtatatgggcgatcctg

SEQ ID NO: 27993 - protein, 131 aa, Panicum virgatum
  misc_feature: Ceres CLONE 1880972
  misc_feature (2)..(82): Pfam Name: TB2_DP1_HVA22 Pfam Description: TB2/DP1, HVA22 family
MLLYPLYASVQAMESPSKLDDEQWLAYWILYSFITLMEMVLESLIYWIPIWYELKLLFIAWLVLPNFRGAAFIYDKFVREQLRKHGLSAGGGSSGKVKKDDKSPSSSPKDKEKPKSKFLAFVTPKKDHEAY

SEQ ID NO: 27994 - DNA, 664 bp, Panicum virgatum
  misc_feature: Ceres CLONE 1880974
  misc_feature: Encodes the peptide sequence at SEQ ID NO. 27995
agcaacgcctcgtgcagtttcttcgtgacacggcaagtaaaagccacaccaaaactaccacacgagaaggggtttttttttttttggtagcagcgagctgttgcaaatggcgtcgacggtggcgagcctgtccaccccggcgaccttcgcggccgcggacgtggtcccgaggaggaaggtcgtcgccgccggccgcgtctggttccccgtggcgcgccgcggcggcggcttcgcggtgaggtcgagcgggccggcgacgccgccggggatctccgacaaggtgtcggagagcatcaagaaggcggaggagacgtgcttggaggagacggcctccggggagtgcgcggcggcttgggacgaggtggaggagctcagcgccgcggcgagccacgcccgggacaagctcaaggagaacagcgacccgctcgagaactactgcaaggagaaccccgaggccgacgagtgccgcacctacgacaactagaccatgcctgtatgctaaatttgccgcacacgaccggaggatttgcacgaagctttatgtttctctgcctgtaatatatatccactatactcgtgtgtgtgatatagattgaatataagaacgagttatctttcgaaaataaatatataataacgaggtggaaacccgcttgcttgattc

SEQ ID NO: 27995 - protein, 125 aa, Panicum virgatum; identical to SEQ ID NO: 21580
  misc_feature: Ceres CLONE 1880974
  misc_feature (55)..(125): Pfam Name: CP12 Pfam Description: CP12 domain

SEQ ID NO: 27996 - DNA, 690 bp, Panicum virgatum
  misc_feature: Ceres CLONE 1880977
  misc_feature: Encodes the peptide sequence at SEQ ID NO. 27997
ctcgggcggggaacgccgccgcctgccgctcctccagagcacctcagctcgatcccgttggttagatatggcggccgggagtgccagtgccacggcgtcgctctccgtcgcggcggccctgcgcgtgaggcggccgtgcgctggcgctcgcgcttgggtcccctcgcagccggcgcaacaagggtccctcctcaggctcaggccctgcgccgcactggcgccacatgcccctctgtggcgggcggagtcggatggcgcgcgcggcggggccggcgccggcgacgtcatgggcctcctcctccgggagcgcatcgtcttcctcggcaacgagatcgaggacttcctcgcagacgccgtcgtcagccagctcctcctcctcgacgcccttgacccggactccgacatccgcctcttcgtcaactcgcctgggggctcgctcagcgcaacaatggccatctatgatgtaatgcagcttgtgagggcagatgtatccactattggattgggcatagctggatcaacagcttctataatccttggtggtggcacaaagggcaagcgatttgccatgcccaacacgaggattatgatccatcagcctgtgggaggtgcaagtgggcaagccttggatgtagaggtccaagccaaggagatattggctaacaagaggaatgtcattcggcttgtatc

SEQ ID NO: 27997 - protein, 207 aa, Panicum virgatum
  misc_feature: Ceres CLONE 1880977
  misc_feature (65)..(207): Pfam Name: CLP_protease Pfam Description: Clp protease
  misc_feature: SWISSPROT Homolog: EC 3.4.21.92 Endopeptidase Clp
MAAGSASATASLSVAAALRVRRPCAGARAWVPSQPAQQGSLLRLRPCAALAPHAPLWRAESDGARGGAGAGDVMGLLLRERIVFLGNEIEDFLADAVVSQLLLLDALDPDSDIRLFVNSPGGSLSATMAIYDVMQLVRADVSTIGLGIAGSTASIILGGGTKGKRFAMPNTRIMIHQPVGGASGQALDVEVQAKEILANKRNVIRLV

SEQ ID NO: 27998 - DNA, 600 bp, Panicum virgatum
  misc_feature: Ceres CLONE 1880998
  misc_feature: Encodes the peptide sequence at SEQ ID NO. 27999
gccgcccattcacgccgccgccgctcgccgccgcccttgcttgtcgccgcccgcggccgctcgatccgatggctcccaccaacaagtcgaataagagcacggagagcatcaccaacaagctgcagctggagatgaagagcggcaagtacacgctccgctacaagaccgacctcaagacgctgcccaactcccaggggaacctaatcatccttgccaacaactgccctccgcttaggaagtctgagattgagtactatgccatgcttgccaaagttagcgtgcatcatttccatggaaacaatgttgatctccgcgctgcctgcggcaagtactacagagtgtgctgcctcactatcattgacccacgagactcggaccttatcctccccccccctggcgcccagtgagcaaagaacaggagcgagctttgcctatccctagttgagatgagatatagggctcagacctttgttgccgggcccatggccatttcttgtttgtctttagtctatgatgagttgatcttgcatacagattatacctcatatggttgttatgtgaggcatatctatggttttgtttgatgagatcgtcataatt

SEQ ID NO: 27999 - protein, 112 aa, Panicum virgatum
  misc_feature: Ceres CLONE 1880998
  misc_feature (12)..(106): Pfam Name: Ribosomal_L7Ae Pfam Description: Ribosomal protein L7Ae/L30e/S12e/Gadd45 family
MAPTNKSNKSTESITNKLQLEMKSGKYTLRYKTDLKTLPNSQGNLIILANNCPPLRKSEIEYYAMLAKVSVHHFHGNNVDLRAACGKYYRVCCLTIIDPRDSDLILPPPGAQ

SEQ ID NO: 28000 - DNA, 580 bp, Panicum virgatum
  misc_feature: Ceres CLONE 1881027
  misc_feature: Encodes the peptide sequence at SEQ ID NO. 28001
aacaagaggggagagaacgcttgctccctcgacggagccatggggcggtcgccgtgctgcgagaaggcgcacacgaacaagggcgcgtggaccaaggaggaggacgagcggctggtggcgtacatccgggcgcacggcgaggggtgctggcgctcgctgcccaaggccgcggggctgctgcgatgcggcaagagctgccggctgcgctggatgaactacctccgcccagacctcaagcgcggcaacttcaccgacgacgaggatgaggtcatcatccgcctgcacgccatcctcggaaacaagtggtctcttatcgccgggcagctgccgggccggacggacaacgagatcaagaactactggaacacgcacatcaagcgcaagctcctagcccgcggcatcgacccgcagacgcaccgcccgctcggcagcgccgccgcggcggcggcggctcccggcgtcgcggcgcaccgggcgccggcgctgctgcaccccgcgaccgccgtcccggccctcgcagccgcgaagccgtcgccggcggcgtcgtcatcggacgacggcgcgcgcagcagcagtacca

SEQ ID NO: 28001 - protein, 180 aa, Panicum virgatum
  misc_feature: Ceres CLONE 1881027
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: Functional homolog of the protein sequence given in SEQ ID NO 50946
  misc_feature: Useful for making plants with modulated nitrogen use efficiency
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1010 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1004 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1002 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: The sequence is a functional homolog of SEQ ID NO 1073 in the 10/374,780 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 824 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 271 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 442 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 58 in the 10/666,642 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: Functional homolog of the protein sequence given in SEQ ID NO 50235
  misc_feature: Useful for biocontainment applications
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 836 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1681 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 790 in the 11/435,388 US patent application
  misc_feature: The sequence is a functional homolog of SEQ ID NO 743 in the 10/666,642 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: Functional homolog of the protein sequence given in SEQ ID NO 51269
  misc_feature: Useful for making plants with modulated biomass
  misc_feature: The sequence is a functional homolog of SEQ ID NO 126 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
MGRSPCCEKAHTNKGAWTKEEDERLVAYIRAHGEGCWRSLPKAAGLLRCGKSCRLRWMNYLRPDLKRGNFTDDEDEVIIRLHAILGNKWSLIAGQLPGRTDNEIKNYWNTHIKRKLLARGIDPQTHRPLGSAAAAAAAPGVAAHRAPALLHPATAVPALAAAKPSPAASSSDDGARSSST

SEQ ID NO: 28002 - DNA, 1158 bp, Panicum virgatum
  misc_feature: Ceres CLONE 1881035
  misc_feature: Encodes the peptide sequence at SEQ ID NO. 28003
gcacaaccgcgtccgcttcttcccagatcccctgcgcccgccgcatccctgtagccgcccctgctgccactctcgccggcgagcccgatccgatccgccgcctcccgcagcccgcagccatgtcgccgtcggagccgacgcgcgaggagagcgtgtacatggcgaagctcgccgagcaggcggagcggtacgaggagatggtggagttcatggagcgcgtggcgcgcccggcgggcggcgccggcggcggggaggagctctccgtcgaggagcgccgcctgctgtccgtcgcctaccggagcgtcctcggcgcccgccgggcctcgtggcggatcctctcctccgtcgtgccgaaggaggagggccgcgggaacgaggcccacgccgcctccatccgcgcctaccgcgccaagatcgaggccgagctcgcccgcatctgcgacggcatcctcgcgctcctcgactcccaccttgtcccctccgccggcgccgccgagtccaaggtcttctacctcaagatgaagggggactaccacaggtacattgctgagttcaagtcaggcgcggagaggaaggaagctgcagagagcaccatgaatgcttacaaagctgcccaggatattgccctggcagatctggctccaacccaccccatcaggcttgggctcgccctcaacttctcggtgttctactatgagatcctgaactcccctgaccgcgcctgcaaccttgccaagcaggcttttgatgaggctatctctgagctagacagcttgggtgaggagtcctacaaggacagcactctgatcatgcaactcctgcgtgacaacttgaccctatggacatctgacaccaatgaggatggtggtgacgagatcaaggaagccgctgccccgaaggaatccggagagggtcagtaagatggatccaagctctcgatcggatgcgcatgctgatgatcgggagcgaccagagccaatgttcctggatttcgatagctctaccttctagtatacctaccatcaccaccaccgtcctcgcactgagatgatgctgcattgccgctgtttaattaagtaccctagatgtttgttatgacgctttgtttcagttttaagttgataaagtgatggctggatgctggttttcatgctccag

SEQ ID NO: 28003 - protein, 266 aa, Panicum virgatum
  misc_feature: Ceres CLONE 1881035
  misc_feature (8)..(249): Pfam Name: 14-3-3 Pfam Description: 14-3-3 protein
  misc_feature: The sequence is a functional homolog of SEQ ID NO 789 in the 11/479,226 US patent application
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application
MSPSEPTREESVYMAKLAEQAERYEEMVEFMERVARPAGGAGGGEELSVEERRLLSVAYRSVLGARRASWRILSSVVPKEEGRGNEAHAASIRAYRAKIEAELARICDGILALLDSHLVPSAGAAESKVFYLKMKGDYHRYIAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAPKESGEGQ

SEQ ID NO: 28004 - DNA, 515 bp, Panicum virgatum
  misc_feature: Ceres CLONE 1881038
  misc_feature: Encodes the peptide sequence at SEQ ID NO. 28005
ccctgagctcgttaaattgtgcaggaatcctgtttcgcaacggggaggtgatggtctgattgatttacatggactgcatgtgagtgaagcaatccacatcctaaaggttgagcttgctgccatgaagagcgcagcaagggctgcgggggagagggtgcaggtcatggtatgtgtcgggacaggccaccacaccaagggctcgcgcaccgcaaggttgcccatcgccgtggaacagttcctcctggacgaaggcctccactacacgcagcctcaaccgggtcttctccgcgtcatggtgtactaacatctcttattaggtaagacaccacggaggaaaaaaaaggacagcccaaaaaaacgtgaaaagagatgtacgaaaaacacaaaaaaagcgtcgttggacgcgctgtaatttccttgtagctgtatattaaaagaggcagcaggagaatagcctgacaacagaatacagtgtaaaattatacatagcttcattcaattcacattccattccc

SEQ ID NO: 28005 - protein, 100 aa, Panicum virgatum
  misc_feature: Ceres CLONE 1881038
  misc_feature (20)..(100): Pfam Name: Smr Pfam Description: Smr domain
PELVKLCRNPVSQRGGDGLIDLHGLHVSEAIHILKVELAAMKSAARAAGERVQVMVCVGTGHHTKGSRTARLPIAVEQFLLDEGLHYTQPQPGLLRVMVY

SEQ ID NO: 28006 - DNA, 676 bp, Panicum virgatum
  misc_feature: Ceres CLONE 1881055
  misc_feature: Encodes the peptide sequence at SEQ ID NO. 28007
ttactggatggcacctgaggttattaatcctaaaaagatgtatgggccttcagctgacatatggagccttggctgcactgtattggaaatgctaactcggcaaataccatttcctaatgtcgagtggacaaatgctttcttcatgattggaagaggggagaaacctcctattcccaactacctgtcagaagaagcgcaagatttcattggccagtgtgtaagagttgatccagagaaccggccttctgcatcacaacttttggagcacccatttgtcaataggccgctgcgagcttcttttgaatcttcgccccctggcatccgcttgtagtatgatggatgggcgcttggctttgtgaaaccaatgcttaagtcatgcatcgatcttcatgatttccactcgtggtgccagaaaggaacaacgagggtttgtttaggatatagttcagtatgtgtagtcagttgggatggtgagcttcggtattggatgcgttccattgtattctttgggtattcttggttaggcaaagggttttccattcagtagggttctttttcttctttttgtacatttgctaggcaaaaggggtggaatttactgtgataatgatctagacttagccgatgttttgtaatgtttgacatcatcattctttactccctggcttgtttgctc

SEQ ID NO: 28007 - protein, 109 aa, Panicum virgatum
  misc_feature: Ceres CLONE 1881055
  misc_feature: SWISSPROT Homolog: EC 2.7.11.25 Mitogen-activated protein kinase kinase kinase
YWMAPEVINPKKMYGPSADIWSLGCTVLEMLTRQIPFPNVEWTNAFFMIGRGEKPPIPNYLSEEAQDFIGQCVRVDPENRPSASQLLEHPFVNRPLRASFESSPPGIRL

SEQ ID NO: 28008 - DNA, 753 bp, Panicum virgatum
  misc_feature: Ceres CLONE 1881094
  misc_feature: Encodes the peptide sequence at SEQ ID NO. 28009
cgtttctcccaaccctgtcctctgttcaatctcttgtaaccagagcatgctcacgagtcatgagcattttttttatttttatgcggaagcaagagcgtacagggcggtgacgagcgcctactaccgcggcgcgctgggcgccatggtggtgtacgacgtgacccggcgcgccacgttcgagcacgtcccgcggtgggtggaggagctccgcgcgcacgccgacggctccaccgtcgtggcgctcatcgggaacaaggccgacatgcccgcggcgcggcgcgaggtggcggccgacgaggccgcgcgcctcgccgaggagcaggggctcttcttctccgaggcgtccgcgctctcgggggacaacgtggagcgcgccttcctcacgctcctcgaggaggtcttcgccgtcgtctcgcgcagggcgctggagctcgacgaggcacgccggatgcgcggcgaccagggcgatggcggcgccggcggcgaggtgctgtcgctcaaggggaccacggtggacctgggctccatcatggagaccagcgccatgaagaggccgagctcgcagtgcgcctgctcgtgatggcgttttcacttcagatgtaggagttatttcaaaagtactgtgttttttttaagagcttcacatttccaaatcacagatcattacactattggtcttttaggcatgttattaccttgtaaagcctgtaagtatgagacgttctatcgtatctgatcaattgatttgttttc

SEQ ID NO: 28009 - protein, 177 aa, Panicum virgatum
  misc_feature: Ceres CLONE 1881094
  misc_feature (18)..(120): Pfam Name: Ras Pfam Description: Ras family
  misc_feature: Functional homolog of the protein sequence given in SEQ ID NO 50162
  misc_feature: Useful for making plants with altered lignin content
  misc_feature: Functional homolog of the protein sequence given in SEQ ID NO 50164
  misc_feature: Useful for making plants with altered terpenoid content
MLTSHEHFFYFYAEARAYRAVTSAYYRGALGAMVVYDVTRRATFEHVPRWVEELRAHADGSTVVALIGNKADMPAARREVAADEAARLAEEQGLFFSEASALSGDNVERAFLTLLEEVFAVVSRRALELDEARRMRGDQGDGGAGGEVLSLKGTTVDLGSIMETSAMKRPSSQCACS

SEQ ID NO: 28010 - DNA, 653 bp, Panicum virgatum
  misc_feature: Ceres CLONE 1881095
  misc_feature: Encodes the peptide sequence at SEQ ID NO. 28011
atccccgtatccgtgaggaagagaaaggcgtcgtgctctgggctccgtcgccgcgccgcgcccgcaaggccgcaaccgcaacagctagccgtcgattacgtgaggagtcggaggggggaggggagcgaggcgacggtcgatggagacggtggaggaggacgtggaggagtacagctggcgggaggtggtgctgccgcgcctcgtccccgtggtgcccgacgcgccgccggagctcgagcgggagaccggggagcggcggcgcggcagggacctcctcgtcgccgtcgacttcggccccaactccaagcacgccttcgactgggcgctcgcgcacatcgcgcgcatcgccgacacggtccacctcgtccacgccgtctccaatgtgcataatgagattgtgtatgagaaaagtcgggagctaatggaggatctggctattgaggcattcaagacttcattggtccgtaccaaggcacgaattgttgaaggggatgctggaaaagttatatgccgagaagcagaccgactgaagccagcagctgtcattcttggtacacgtggtagaggccttattcaaagaagctggtgaacagtctgtgctttgaaggaagataggcgggaggcagtggttgttgtactttcagtttaggtgt

SEQ ID NO: 28011 - protein, 149 aa, Panicum virgatum
  misc_feature: Ceres CLONE 1881095
  misc_feature (42)..(147): Pfam Name: Usp Pfam Description: Universal stress protein family
METVEEDVEEYSWREVVLPRLVPVVPDAPPELERETGERRRGRDLLVAVDFGPNSKHAFDWALAHIARIADTVHLVHAVSNVHNEIVYEKSRELMEDLAIEAFKTSLVRTKARIVEGDAGKVICREADRLKPAAVILGTRGRGLIQRSW

SEQ ID NO: 28012 - DNA, 697 bp, Panicum virgatum
  misc_feature: Ceres CLONE 1881133
  misc_feature: Encodes the peptide sequence at SEQ ID NO. 28013
atccgtgaggaagagaaaggcgtcgtgctctgggctccgtcgccgcgccgcgcccgcaaggccgcaaccgcaacagctagccgtcgattacgtgaggagtcggaggggggaggggagcgaggcgacggtcgatggagacggtggaggaggacgtggaggagtacagctggcgggaggtggtgctgccgcgcctcgtccccgtggtgcccgacgcgccgccggagctcgagcgggagaccggggagcggcggcgcggcagggacctcctcgtcgccgtcgacttcggccccaactccaagcacgccttcgactgggcgctcgcgcacatcgcgcgcatcgccgacacggtccacctcgtccacgccgtctccaatgtgcataatgagattgtgtatgagaaaagtcgggagctaatggaggatctggctattgaggcattcaagacttcattggtccgtaccaaggcacgaattgttgaaggggatgctggaaaagttatatgccgagaagcagaccgactgaagccagcagctgtcattcttggtacacgtggtagaggccttattcaaagtgtgctgcaggggagtgtcagtgagtactgcttccacaactgtaaagcggcaccagttatcattgtgccaggcaaagaagctggtgaacagtctgtgctttgaaggaagataggcgggaggcagtg

SEQ ID NO: 28013 - protein, 180 aa, Panicum virgatum
  misc_feature: Ceres CLONE 1881133
  misc_feature (42)..(170): Pfam Name: Usp Pfam Description: Universal stress protein family
METVEEDVEEYSWREVVLPRLVPVVPDAPPELERETGERRRGRDLLVAVDFGPNSKHAFDWALAHIARIADTVHLVHAVSNVHNEIVYEKSRELMEDLAIEAFKTSLVRTKARIVEGDAGKVICREADRLKPAAVILGTRGRGLIQSVLQGSVSEYCFHNCKAAPVIIVPGKEAGEQSVL

SEQ ID NO: 28014 - DNA, 651 bp, Panicum virgatum
  misc_feature: Ceres CLONE 1881171
  misc_feature: Encodes the peptide sequence at SEQ ID NO. 28015
acctctgcaccaggctccacacttcacaccagcgcaaccaccaccacctacaagcgggagcgagcggcggcttcggcgatgtcgggcaggggcaagggcggcaaggggctcgggaagggcggcgcgaagcgtcaccggaaggtgctccgcgacaacatccaggggatcacgaagccggcgatccggaggctggcgaggaggggcggcgtgaagcgcatctccgggctgatctatgaggagacccgcggcgtgctcaagatcttcctcgagaacgtcatccgcgacgccgtcacctacacggagcacgcccgccgcaagaccgtcaccgcgatggacgtcgtctacgcgctcaagcgccagggccgcaccctctacggcttcggcggctaggttaggggtctgccgatgtgattcggttcgatgggtagccctatcgccttcatttgttccggtagttgctgtagcggagatgtagtagctggttgcttggtcccttccgtgctggttgggtggatgtaagaaccgctggttcgaggcaattggttttcatgcaggatgctgatgtagaaaatttgaagttcaaatttggttctgttcagtttagacttatgctctttgtctcgatgtggattatacgatgctattttgttt

SEQ ID NO: 28015 - protein, 103 aa, Panicum virgatum; identical to SEQ ID NO: 12044
  misc_feature: Ceres CLONE 1881171
  misc_feature (25)..(94): Pfam Name: Histone Pfam Description: Core histone H2A/H2B/H3/H4

SEQ ID NO: 28016 - DNA, 1079 bp, Panicum virgatum
  misc_feature: Ceres CLONE 1881236
  misc_feature: Encodes the peptide sequence at SEQ ID NO. 28017
cctgttcgcgtcagagtaacggcagcgcgcggtactcctcgctgctcgccgcctttcccctctctcctttctccccgactcgcggctgctcaccttgctgaagccgaactgcctcgctctccctccctcccccccccacccccctctctctctcgcccgccaatcctttccttccggccgatcgcggctcggctcggctccgcttcagattttctcaaggctgaaattttagtggtctgctccagccatgagtagcagaagatatgacatcaatgcgtggagatgtgggactcgctcaacgccaagtgaatcgatgtatctagatgctcaacaagttgtccactaccaagctacggaccgcgatgttagcccctgcgctgttaagcatcacttcccatctccaatcgtatcttggatagaagatctttcgagctttggcagtgtttcttttagcaccgattctgaatatgtggatgagcaagccagggcttcagtgggacagtcttcaacatcaagcaatttgcatgacatgcaaatatcagtgaggttgacagaagaattcatggagcttgcaaaggagaacacaagcaataatctagagacttgtggaattctcggtgcttcatttagggatggaacttactttgtgacgatgttgattataccaaagcaagaaggaactgctcactcatgtcaggctgttaatgaggaggagatacatgccgtattatcagagcagtcactttaccctgcaggatggattcatgtatatattctagaattgccatactttatgtacatacatgctacctgcctcacctaatctgaaaagataagtaagctgatagctgcagtagagtgctacctggttgcagcatgtatgattactcattaattatcatctgatctgaaaccatcatcttgtattcgtttacccttagttttctttctttttgcagttgagggccaagccttcttcctttcattttggtttgttgcaattatttcttgtaatcggtgtaattcctactctcctgctaattttcagggggaaaactgtttatctatttagcattgtc

SEQ ID NO: 28017 - protein, 191 aa, Panicum virgatum
  misc_feature: Ceres CLONE 1881236
  misc_feature: SWISSPROT Homolog: EC 3.1.2.15 Ubiquitin thiolesterase
MSSRRYDINAWRCGTRSTPSESMYLDAQQVVHYQATDRDVSPCAVKHHFPSPIVSWIEDLSSFGSVSFSTDSEYVDEQARASVGQSSTSSNLHDMQISVRLTEEFMELAKENTSNNLETCGILGASFRDGTYFVTMLIIPKQEGTAHSCQAVNEEEIHAVLSEQSLYPAGWIHVYILELPYFMYIHATCLT

SEQ ID NO: 28018 - DNA, 573 bp, Panicum virgatum
  misc_feature: Ceres CLONE 1881248
  misc_feature: Encodes the peptide sequence at SEQ ID NO. 28019
attgccccagcatcatcctgccgccgcgctccccagcttcgaagccgccgccagctcctccaagagctagtaattaagccgatggccatggccacgcaagcctccgccgcgacgcgccacctgctggcggcggcctggtcgccggcgaaggcgccgcggccgtcgcagctcgcgctcccgtcgccctcccgcgggccggccccgctccgcgcggccgccggggagcccgcggcggcgacggaggaggcgcccaagggattcgtgcccccgcagctggaccccgacacgcctgccccgatcttcggcggcaggacggggggcctgctccgcaaggcgcaggtggaggagttctacgtgatcgcttgcacgtcctccaaggagcaggtgttcgagaagccgacgggcggcgccgccatcatgagggacggccccaacctactgaagctggcgcgcaaggagcagtgcctggtgctgggcaccaggctgcgctccaagtactagatcaagtaccagttctaccgcgtcttccgcaacggcgaggtcgtccatctgcatcgcaaggacggcgccaac

SEQ ID NO: 28019 - protein, 139 aa, Panicum virgatum
  misc_feature: Ceres CLONE 1881248
  misc_feature (63)..(139): Pfam Name: PsaD Pfam Description: PsaD
MAMATQASAATRHLLAAAWSPAKAPRPSQLALPSPSRGPAPLRAAAGEPAAATEEAPKGFVPPQLDPDTPAPIFGGRTGGLLRKAQVEEFYVIACTSSKEQVFEKPTGGAAIMRDGPNLLKLARKEQCLVLGTRLRSKY

SEQ ID NO: 28020 - DNA, 693 bp, Panicum virgatum
  misc_feature: Ceres CLONE 1881262
  misc_feature: Encodes the peptide sequence at SEQ ID NO. 28021
caatgttgcacccaagatgaaggcgcttgaaatcgcggagaaagccagggatgctctccttagtggaaagtttgaccaggtacgtgtcaacctgccaaatggtgacatggtgggtcacactggtgatattgaggccacagttgttgcttgcaaggcagctgatgaagccgttaagattattttggatgctgtggagcaagttggcggtatttacgttgtcactgctgatcatggaaatgcagaggacatggtgaaaaggaacaaagctggcaagccggcgcttgacaagagtggtggtatccaaattctcacctcacatacccttcagcctgtcccggttgcaattggaggccctggtctgcaccctggagtgaaattccggaatgacattcagacccctgggctcgccaacgttgctgccactgtgatgaacctccatggctttgaggcccctgctgactacgagacaactctcattgaagttgctgacaactaaatactggccaatcttaatgtccaattttgctgctatagttttgagaatgcatcggtggccatgtcattgaataatttctgtttgcaagcaggctgctcaaactcacggaactttgagaggaagacattttcgcctgcacttagatgctctatgtataacttgagataatgctctatgtataacttgaaattatctcc

SEQ ID NO: 28021 - protein, 164 aa, Panicum virgatum
  misc_feature: Ceres CLONE 1881262
  misc_feature (5)..(132): Pfam Name: Metalloenzyme Pfam Description: Metalloenzyme superfamily
  misc_feature: SWISSPROT Homolog: EC 5.4.2.1 Phosphoglycerate mutase
NVAPKMKALEIAEKARDALLSGKFDQVRVNLPNGDMVGHTGDIEATVVACKAADEAVKIILDAVEQVGGIYVVTADHGNAEDMVKRNKAGKPALDKSGGIQILTSHTLQPVPVAIGGPGLHPGVKFRNDIQTPGLANVAATVMNLHGFEAPADYETTLIEVADN

SEQ ID NO: 28022 - DNA, 689 bp, Panicum virgatum
  misc_feature: Ceres CLONE 1881265
  misc_feature: Encodes the peptide sequence at SEQ ID NO. 28023
accgctgacgctcgcctccacctccacctccgcccccgtcaccactaactccccgccggcgcgtataaagattcgccgcccgcgccgcgaagctcaccgcatcgccgcgcggaaaccctcccgaatcgtcgccatggcagccgccgcaccggcaagctccgtcaaggaagtgctcccgtttcccctgaccgccgcctccgagcccccgcccctcttcgacggcacaaccaggttgtatgttgcctaccattgcccgtacgcgcagcgcgcttggattgccaggaactacaagggtttacacgacaagatcaagatagttgcaatcgatcttgctgacaggccagcatggtacaaggagaaggtttatcccgagaacaaggtgccttccctagagcacaacaaccaggttaaaggggagagcttggatttggtcaagtacattgatagcaatttcgaaggcccatcattgcttcctgatgtaagacatgatcctgcaaagaagcagttcgctgaggagctgcttgcttttaccgatgcttttaacaaagcactgtactcatctataatctctaaggaagatgtgtccgaggaaactgttgctgctctggataaaatagaagaggccctggggaaatttaacgatggaccattcttcctcggtcagttcagtctggtggacatagcatatg

SEQ ID NO: 28023 - protein, 185 aa, Panicum virgatum
  misc_feature: Ceres CLONE 1881265
  misc_feature: SWISSPROT Homolog: EC 2.5.1.18 Glutathione transferase
MAAAAPASSVKEVLPFPLTAASEPPPLFDGTTRLYVAYHCPYAQRAWIARNYKGLHDKIKIVAIDLADRPAWYKEKVYPENKVPSLEHNNQVKGESLDLVKYIDSNFEGPSLLPDVRHDPAKKQFAEELLAFTDAFNKALYSSIISKEDVSEETVAALDKIEEALGKFNDGPFFLGQFSLVDIAY

SEQ ID NO: 28024 - DNA, 698 bp, Panicum virgatum
  misc_feature: Ceres CLONE 1881268
  misc_feature: Encodes the peptide sequence at SEQ ID NO. 28025
aatcaataatcaagattgagaaactcaagctcaccatttcttcagaggaagccatggaaagtgcggtcggcagcgtcgctcctctggaagccgtcctgttcgacatcgacgggacgatggccatctccgaccccttccaccaccgagccacctccgagatgctcatcaaggtgggctacaacgacggcgtgcccatcactcatgagttcggcatgacgcacatggccggccggagcaacgagcagatcggccagttcctgttcccggactgggaccggggcaggctcgacgccttcttcgccgagaaggaggcgctcttcgcccggtacgccggcgaggggctaaaggagatcgccggcctgacggcgctgtgccggtgggccggcgagcgcgggctcaagcccgcggcggtgaccaacgcgccccgggccaacgccgagctcatcatctccatcctcggcctctccgacttcttccagctcatcgtcaccggcgaggactgcgagcgctccaagcccttcccggacccctacctcagggcgctccacctgctcggcgcctcgccggaccacaccctcgtcttcgaggactccaccgtcggggtgcaggccggtgttgccgccggtatgccggtcattgccatcgccgacgagagccgggagggcaagctcctcaccgtctgcgcctcgcttgtcatc

SEQ ID NO: 28025 - protein, 214 aa, Panicum virgatum
  misc_feature: Ceres CLONE 1881268
  misc_feature (11)..(200): Pfam Name: Hydrolase Pfam Description: haloacid dehalogenase-like hydrolase
  misc_feature: SWISSPROT Homolog: EC 3.1.3.18 Phosphoglycolate phosphatase
MESAVGSVAPLEAVLFDIDGTMAISDPFHHRATSEMLIKVGYNDGVPITHEFGMTHMAGRSNEQIGQFLFPDWDRGRLDAFFAEKEALFARYAGEGLKEIAGLTALCRWAGERGLKPAAVTNAPRANAELIISILGLSDFFQLIVTGEDCERSKPFPDPYLRALHLLGASPDHTLVFEDSTVGVQAGVAAGMPVIAIADESREGKLLTVCASLV

SEQ ID NO: 28026 - DNA, 724 bp, Panicum virgatum
  misc_feature: Ceres CLONE 1881271
  misc_feature: Encodes the peptide sequence at SEQ ID NO. 28027
aggcatcacgcaccatccacaatatttcttgatgaaatagatgccattatcagccagcgtggtgaagctcgtagtgagcacgaagctagtcgtcgcttgaagactgaactacttattcagatggatggtttgacaaagacaaacgacttggtatttgtactagcagctacaaatctaccatgggaattggatgccgctatgctgcgccggcttgagaagcggattcttgtaccacttcctgaagctgaagcaaggcaggcaatgtttgaggaacttctgccagcaattacctcaaagctagaggtcccgtatgatgtactagttgagaagactgaaggttactccggttcagatattcgtcttgtgtgcaaagaagctgccatgcaaccactcagacgtctcatgtcggttcttgaagccagtgatgagttggtgccggaggaagaactgccggaggttggtcctctgaaacctgaagatatagaaattgctttaaggaacactaggccatcagcccatctccatgcacatcgctacgaaaagttcaaccaggactatgggagccaggttctatgttcagagcaagcttgattatcaggttgatgttccattcaaccatgggagtgtggagtggagctagttcatttgttgatgtggggtcacattgtgtcgaaatggttggactagtaactaggctccacggcagattgcaattgcccatcat

SEQ ID NO: 28027 - protein, 196 aa, Panicum virgatum
  misc_feature: Ceres CLONE 1881271
  misc_feature (1)..(132): Pfam Name: AAA Pfam Description: ATPase family associated with various cellular activities (AAA)
  misc_feature: SWISSPROT Homolog: EC 3.6.4.3 Microtubule-severing ATPase
RHHAPSTIFLDEIDAIISQRGEARSEHEASRRLKTELLIQMDGLTKTNDLVFVLAATNLPWELDAAMLRRLEKRILVPLPEAEARQAMFEELLPAITSKLEVPYDVLVEKTEGYSGSDIRLVCKEAAMQPLRRLMSVLEASDELVPEEELPEVGPLKPEDIEIALRNTRPSAHLHAHRYEKFNQDYGSQVLCSEQA

SEQ ID NO: 28028 - DNA, 693 bp, Panicum virgatum
  misc_feature: Ceres CLONE 1881285
  misc_feature: Encodes the peptide sequence at SEQ ID NO. 28029
gtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgccgccgtggccgccgcgctcgtggcgtccgccgccgccgccacagaggcccccgccccggcgcccgcctccgacgccgccgccgcggtgcccctcgccgcggcgtccctcgccgccgccgccttcggctacctcttctgctagatccgccgcccgttccccgtgggtcctgctgatatgatgattcgttctggcgtggcgtgagtcgagtccgtgtggggaggatgtcggtgggcgtgtgtatgtacgagttcggctgcggtgtgcgagcggtggttgcgtgcgtcgacgcgccgttctctatggcgccgatcatgtactcactccgtttctggttattgatgagatcatttatttg

SEQ ID NO: 28029 - protein, 144 aa, Panicum virgatum
  misc_feature: Ceres CLONE 1881285
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50578
  misc_feature: Useful for making plants with altered lignin content
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFVGGLAWATDNASLQQAFASYGDVLDSKVITDRETGRSRGFGFVTFSTEQSMLDAIEAMNGKELDGRNITVNQAQSRRRGRRARGVRRRRHRGPRPGARLRRRRRGAPRRGVPRRRRLRLPLLLDPPPVPRGSC

SEQ ID NO: 28030 - DNA, 581 bp, Panicum virgatum
  misc_feature: Ceres CLONE 1881292
  misc_feature: Encodes the peptide sequence at SEQ ID NO. 28031
atcctttctccccatgccacccactcaagaagcgtccgcgagaggatagagaagtcatggcagctgtccctctccctcgcgcgcgccgtgcccctcgccgtctccgcgggcgccggggccagaaggatccccgccgccagcctcgccttccctcccaagtccttcttcggcgcgccgctggccgccaccgccgcctccgccgcgtcgccgctcccgcgcaggcccgctacctccacctcgctcgaggtcgtcccggcggggaagaaggggcacaagatgaagacccaccaggcgtccgcgaagcggttcagggtgactgggaggggcaagatcgtgcgccggtgcgccgggaagctgcacctgctcggcaacaacaacaccaatcgcaaaaagatgctctccgagatggaccacgtacacaagagtgactacgacgatgtgacacgcgctctgccctacctcaaagtgaataggaaagtagactgagttcttcttggtcttctcaatccattctgtttcgttccaccaacctgtaattttgtgtattttccgctgtattacctttcgaatatgcaggctgt

SEQ ID NO: 28031 - protein, 161 aa, Panicum virgatum
  misc_feature: Ceres CLONE 1881292
  misc_feature (93)..(151): Pfam Name: Ribosomal_L35p Pfam Description: Ribosomal protein L35
ILSPHATHSRSVRERIEKSWQLSLSLARAVPLAVSAGAGARRIPAASLAFPPKSFFGAPLAATAASAASPLPRRPATSTSLEVVPAGKKGHKMKTHQASAKRFRVTGRGKIVRRCAGKLHLLGNNNTNRKKMLSEMDHVHKSDYDDVTRALPYLKVNRKVD

SEQ ID NO: 28032 - DNA, 723 bp, Panicum virgatum
  misc_feature: Ceres CLONE 1881333
  misc_feature: Encodes the peptide sequence at SEQ ID NO. 28033
ttcatcgagaactgcctcgccacggtcgaccggaagaagcagccatggctgatattcatcgctcatcgcgtccttgggtactcttccggtttcttctacggcatagacggggcattcgccgagccaacttcccggcaaagcctccagaagctctggcagaagtacagggtggacatggcgttctacggccatgtccacaactacgagaggacatgcccggtctatgaggaaaaatgcacgagctcggagaagtcccactactcgggcaccatgaccggcaccatccacgtcgtggtcgggagcggtggcagccacctgagcaacttcaccaccgaggttcctgcttggagcatctacagggagatggactacggcttcgtaaagctcacagcgttcaactactcgtcccttctcttcgagtacaagaggtccagcgatggcaaggtgtacgatagcttcactgtgaacagggagtacagggacgtgctggcgtgcgtcaaggacagctgccctccgacgatcccggcgacatgatgatatggagaggggtgggtctcttgtcagtgttgggttctgctgcatgtaacataccgtgaccaactattctttgggggagctggaggaagggacgcaacatccggccacaaacacagcatccatcttattactatatgtttattggcgcttcattttagatcttacatctggccatcaattctgtag

SEQ ID NO: 28033 - protein, 177 aa, Panicum virgatum
  misc_feature: Ceres CLONE 1881333
  misc_feature: SWISSPROT Homolog: EC 3.1.3.2 Acid phosphatase
FIENCLATVDRKKQPWLIFIAHRVLGYSSGFFYGIDGAFAEPTSRQSLQKLWQKYRVDMAFYGHVHNYERTCPVYEEKCTSSEKSHYSGTMTGTIHVVVGSGGSHLSNFTTEVPAWSIYREMDYGFVKLTAFNYSSLLFEYKRSSDGKVYDSFTVNREYRDVLACVKDSCPPTIPAT

SEQ ID NO: 28034 - DNA, 698 bp, Panicum virgatum
  misc_feature: Ceres CLONE 1881341
  misc_feature: Encodes the peptide sequence at SEQ ID NO. 28035
gcaacagcagcagcagcggaggagcggagctccagccatggcagagaagggcgtgaaggtgctgggcatgtgggcgagcccgatggtgatccgggtggagtgggcgctccggctgaagggcgtggagtacgagtacgtcgacgaggacctcgccaacaagagcgccgacctgctccgctacaacccggtgaccaagaaggtgcccgtcctcgtccacgacggcaagcctatcgccgagtccaccatcatcgtcgagtacatcgacgaggcctggaagggcggccaccctatcatgccggccgacccctacgagcgtgcccaggcgaggttctgggccaggtacgctgaagacaaggtacgcacgcgacctgcagccgcatgatctatcctaccactctgatcatcgagcagcagctgggtctaatgggagctgggcactggatgtgcctgtgtctactccatccagtgcaaccccgcgctgtaccagatcttcaccacgaccggcgaggcgcagcacgaggtggtgcgcgcggcccagcagtgcctcaagccgctggaggcggcgctgaaggggcggaggttcttcggcggcgacgccgtgggctacctcgacatcgtcgtcgggtggctcgcgcactggctgccggtcatcgaggaggtgtccggcgccagcgtcgtcaccgacgaggagctcccgc

SEQ ID NO: 28035 - protein, 114 aa, Panicum virgatum
  misc_feature: Ceres CLONE 1881341
  misc_feature (4)..(77): Pfam Name: GST_N Pfam Description: Glutathione S-transferase, N-terminal domain
  misc_feature: SWISSPROT Homolog: EC 2.5.1.18 Glutathione transferase
  misc_feature: Functional homolog of the protein sequence given in SEQ ID NO 51077
  misc_feature: Useful for making plants with modulated nitrogen use efficiency
  misc_feature: Functional homolog of the protein sequence given in SEQ ID NO 51078
  misc_feature: Useful for making plants with modulated biomass
  misc_feature: Functional homolog of the protein sequence given in SEQ ID NO 51079
  misc_feature: Useful for making plants with modulated drought sensitivity
MAEKGVKVLGMWASPMVIRVEWALRLKGVEYEYVDEDLANKSADLLRYNPVTKKVPVLVHDGKPIAESTIIVEYIDEAWKGGHPIMPADPYERAQARFWARYAEDKVRTRPAAA

SEQ ID NO: 28036 - DNA, 759 bp, Panicum virgatum
  misc_feature: Ceres CLONE 1881342
  misc_feature: Encodes the peptide sequence at SEQ ID NO. 28037
atctctaaacccccaaaccctcgttccccttcgccattatccgaacccaaaccaagcgccaagctccgaccacagagccgagccccaaatggccgcctcctcctccatgctgaccgccgcgttgctctccttctccgcgctcccggtctcgcgcctccgagccgcccctcccaccgccgcctccttcgcggcgctgcggcgcgcggcggccgcacccgtcgtcgtgcgcgcggcggccgcctcgtccaaggccacggatgcggcggaggcggccccgaagaagaaaagggcgaccggcatcacccagcccaagcccgtctcgccggcgctgcaggcaatcgtgggcgcaccggagatcccccgcaccgaggcactcaagcgcctctgggcctacatcaagcagcacaacctccaggatcctgcagacaagaaggtggtcgtctgtgatgagaagctgaaggtcctgtttgctgggcgggagcgcgttggattcctcgagatcgccaagcttctcaacccccactttgtgaagtgaggatcctcttccatggagactggagttaccctagatggtttctagcgatctagatttttagagagtgcgtcggttggcttttgttggccctgagtttgctcgacttagtaggatcatctagcccttcgctgacaatgttagtgtgcccctgatggtgccggttatctgaattgctggttaatgtcctgaacaccttcaactcgtatgcttgtagcttgtgtctc

SEQ ID NO: 28037 - protein, 148 aa, Panicum virgatum
  misc_feature: Ceres CLONE 1881342
  misc_feature (71)..(147): Pfam Name: SWIB Pfam Description: SWIB/MDM2 domain
MAASSSMLTAALLSFSALPVSRLRAAPPTAASFAALRRAAAAPVVVRAAAASSKATDAAEAAPKKKRATGITQPKPVSPALQAIVGAPEIPRTEALKRLWAYIKQHNLQDPADKKVVVCDEKLKVLFAGRERVGFLEIAKLLNPHFVK

SEQ ID NO: 28038 - DNA, 544 bp, Panicum virgatum
  misc_feature: Ceres CLONE 1881407
  misc_feature: Encodes the peptide sequence at SEQ ID NO. 28039
caaaatcatcagcaagaacccaagctccagtgtgccgggcaaagccgcagctctagctagctaagctagagcggatccaagcccgagccagcacccgcaccgcagatcaccgatcaccatgggctccctcggcggcggcgcgcagggcgacagcaggccgcacgccgtgtgcctgccgtacccggcgcagggccacatcaccccgatgctcaacgtggccaagctgctccacgcccggggcttccacgtcaccttcgtcaacaccgagtacaaccacgcccgcctcgtccggacccgcggcgccgccgccgtggccggcgtcccgggcttccgcttcgccaccatcccggacggcctgcccccctcggaggacgacgacgtcacgcaggacatcccctcgctctgcaagtccaccactgagacctgcctcggccccttccgccgcctcctcgcggagctcaacgacgaccccgcccacccgcccgtcacctgcgtcctctcccacgtcgtcacgggcttctccggccacccccccaaagaacac

SEQ ID NO: 28039 - protein, 141 aa, Panicum virgatum
  misc_feature: Ceres CLONE 1881407
  misc_feature: SWISSPROT Homolog: EC 2.4.1.121 Indole-3-acetate beta-glucosyltransferase
MGSLGGGAQGDSRPHAVCLPYPAQGHITPMLNVAKLLHARGFHVTFVNTEYNHARLVRTRGAAAVAGVPGFRFATIPDGLPPSEDDDVTQDIPSLCKSTTETCLGPFRRLLAELNDDPAHPPVTCVLSHVVTGFSGHPPKE

SEQ ID NO: 28040 - DNA, 2996 bp, Panicum virgatum
  misc_feature: Ceres CLONE 1881429
  misc_feature: Encodes the peptide sequence at SEQ ID NO. 28041
atctccccctgtgccttcaatgagcgcctcccccggcgcgcggcgctcgttggctcgtgctgtcgtgtgaggacggcggctgcgtttggctgccgaaccaccgaggcaaaggaatcgaacacgccgccgctgccgcaggcgagctccgctcggctcgtcgctcggcgctcacccaggacgctgactcgccgcaccgccgccggtcgcccctccacgagtccccgattccctttcctcggctcgctcagcccgcctctgcctctccctctcgctcagcacgccgcgcctgcaccgctgcgcgccgtcggccatcgcctcgcctggctcgcagtgccgccggtgccggccagccctagcgcggcgccccaaagccccagacccaagtggaggaagcgcctgcccccagcccccaaagcctcaatcgaatactcgtcaggagcacctggagtagtcatgacaggaaaatttgagcagaagtctcggaaagagaggaggaaagaggcgagatcagagaagcagaaactgcggtttctctcttgggttcagcaccagggtggcaaaaagaagaaactggcaatgccagcagtagagcctaacccagaagaggggacgaaaacaaagaaagaacctactactgtgaagaagaagagaaagagggaattagagggtaaacacaagcccaagtcgaactttcaggaatatcttgagatggagatgggtggagctgtgagcatggaggaggatctggaaatggagaggaggcttgcgaaaaagctcaaagtgaagaaagggaagttgggaggtccggatgatggtatggatgaactttttgcggaccttgggtttggtggagactttgggtcggatgatgaaacaaaagcgtgtgacagggcaaaagggaaaaagaaaaaggtcacagaggatgacatggagatggaggaactgggtgtcggggatgaagagaatgatcgaaaaaagaagaagaagaataagaagaaggtgatgaagaaggatgacatggagacagaggaactggataacagaggtgcagagaacaatgggaaaaagaagaagaagaagaagaagaagccaaagaaggatgatatggaggttgaacaaccagatgacgggggtgctgacatgggtgaagagaatgatggggcagttccggaatccgaggatggagaggctaatgtggttaaactgtccacagaatcaaaagggaagtatgtacctccaagtttgcgtgattcttccaattcagaatcagaagaaattgctcagatgcgtcggagagtaagaggacttctgaacaggctctcagagtcaaatgtggagtctattactcaggaaattgccacgctttttcgatctgttccacgaagtgttggctgtcagataattggtgatgaagttttggctagttgttcccggggacctcgtggcaatgaccaatatgctgctgtttttgccgcctttgttgcaggcatggcatgcttggttggtatcgatttcagtgccaagatccttgcatccattgctaagacgtttgaggatgagtactcaaaagaagatagcatatctttgagaaatctaaccttactcttctgctttctgtgcatatttggtgtcatctcaagtgatcttgtgtacgatcttctatcagttctgagcaagcgcttgacagagatggatgtctctacagtattgaccatcctacagtgctgtggaatgaagctgcggggtgatgatccaggtgctatgaaagattttgtccttagtattcagaactctgtgaatcagttgaaatcgcactctggtgttggagaagatggaaaaacagatgtattatacagcacaagaatgaaatttatgctcgataccatatgtgacattaagaacaataagaaaaggcctaaagatctttcagactacactcgaataaaaaagtggcttcaaaagcttaaggcagaagatgtcctgttgcgagggctaacatggagtagacttttggaccctgataagaaagggcaatggtggttgtctggggatgttccatccacagcaggcaatattgaagatgttgctgctgttataagcaaggacgttgcagagacgcaaaagcttcttcagcttgcagcagctcagcggatgaacactgacgtacgaagagcaatcttttgtattataatgagtgctgaagactatgtagatgctttcgagaagctcttaaggctgggcctttctgggaagcaggatcgagaaatcataagggtcattgttgactgttgtctgcaagaaaagatgttcaacaagtattacacagtccttgcttccaagctatgcagccatgagaaaaatcacaagttcagcttgcagtactgcgtctgggatcactttaaggagctagacaacatggagccaaatcgctccatgaaccttgcaaaactagttgcagagatgttgtcaaacttcaccctctcccttgcaactctgaaggttgtcaacctggcaaacccagtggagatgactcaagagaggattgcccattttcaattgctctttgagaccttactacagaaagatgatgcgctggtgtggaatgtcttcacccgtatcgctggtcttccagagcttgagatattgagagatggcattgtactgttcatcaagcagcatgtgattgctgaggacactgggaaagccttggctaacaaattcaagattgcaaagaaggcacttgataatgttgctggcgttctgatgtaaggtccacggggttccaagtctgtgctttccatgcctatttgcgccagtttttgcatctttcatgtcctttgttctcattttcgctttgttgcttcagagaaacaaagtacaactcctttttgtatctatactagaaattagagaatgatctcccaaggctgatgcaaacttaatttgatgattcagcagagaccttagtggtttgaaatgctttaagcaaaagtttt

SEQ ID NO: 28041 - protein, 771 aa, Panicum virgatum
  misc_feature: Ceres CLONE 1881429
  misc_feature (571)..(677): Pfam Name: MA3 Pfam Description: MA3 domain
  misc_feature (279)..(485): Pfam Name: MIF4G Pfam Description: MIF4G domain
MTGKFEQKSRKERRKEARSEKQKLRFLSWVQHQGGKKKKLAMPAVEPNPEEGTKTKKEPTTVKKKRKRELEGKHKPKSNFQEYLEMEMGGAVSMEEDLEMERRLAKKLKVKKGKLGGPDDGMDELFADLGFGGDFGSDDETKACDRAKGKKKKVTEDDMEMEELGVGDEENDRKKKKKNKKKVMKKDDMETEELDNRGAENNGKKKKKKKKKPKKDDMEVEQPDDGGADMGEENDGAVPESEDGEANVVKLSTESKGKYVPPSLRDSSNSESEEIAQMRRRVRGLLNRLSESNVESITQEIATLFRSVPRSVGCQIIGDEVLASCSRGPRGNDQYAAVFAAFVAGMACLVGIDFSAKILASIAKTFEDEYSKEDSISLRNLTLLFCFLCIFGVISSDLVYDLLSVLSKRLTEMDVSTVLTILQCCGMKLRGDDPGAMKDFVLSIQNSVNQLKSHSGVGEDGKTDVLYSTRMKFMLDTICDIKNNKKRPKDLSDYTRIKKWLQKLKAEDVLLRGLTWSRLLDPDKKGQWWLSGDVPSTAGNIEDVAAVISKDVAETQKLLQLAAAQRMNTDVRRAIFCIIMSAEDYVDAFEKLLRLGLSGKQDREIIRVIVDCCLQEKMFNKYYTVLASKLCSHEKNHKFSLQYCVWDHFKELDNMEPNRSMNLAKLVAEMLSNFTLSLATLKVVNLANPVEMTQERIAHFQLLFETLLQKDDALVWNVFTRIAGLPELEILRDGIVLFIKQHVIAEDTGKALANKFKIAKKALDNVAGVLM

SEQ ID NO: 28042 - DNA, 731 bp, Panicum virgatum
  misc_feature: Ceres CLONE 1881453
  misc_feature: Encodes the peptide sequence at SEQ ID NO. 28043
aaaacacccaccagcgaggcagcgagcagccgtatctccggtccacaatctatcctatcgatcgtcatggcggtttccctcccctccgtcctcctcgccgccgcctccctcctcgccgccgccgtgtacatccgcagctacgacacggttggcaccaccaccaccacgcacctccacttcttcatgcacgacgactacaccggcccgcgccccaccgccgcacgggtcgtgtccggccgctccctcctgccaacgtcgtccagcgacggcagcgacagcaacgacaacgccaccgccactgatcggagtgtgctgacgacgtcgccgcggcagttcggggacgtggtggtgctgaacaacgcgctgacggaggggccggacgggggcagcgcgcgcgtcggcaccgcgcaggggttcgccgtgcgcgtgtcggagggcggcatcgtgtcgcacctgaccctgcacatggtcctggacgcgggcgagcaccggggcagctccgtcacggcgaacggccggatcgacatggacgccgaggtgcgggagtcggtggtcatcggcggcaccggcaagttccggttcgcgcgcgggtacatgctcaccaggaactacgactacgacctcgcccgcggcggcatcgtcgagatcgatgtctatgtgcagcactagtgtagcagttggcaccggggaacattttcttgcacatggctagctctgattgatgctatgtg

SEQ ID NO: 28043 - protein, 200 aa, Panicum virgatum
  misc_feature: Ceres CLONE 1881453
  misc_feature (12)..(200): Pfam Name: Dirigent Pfam Description: Dirigent-like protein
MAVSLPSVLLAAASLLAAAVYIRSYDTVGTTTTTHLHFFMHDDYTGPRPTAARVVSGRSLLPTSSSDGSDSNDNATATDRSVLTTSPRQFGDVVVLNNALTEGPDGGSARVGTAQGFAVRVSEGGIVSHLTLHMVLDAGEHRGSSVTANGRIDMDAEVRESVVIGGTGKFRFARGYMLTRNYDYDLARGGIVEIDVYVQH

SEQ ID NO: 28044 - DNA, 1311 bp, Panicum virgatum
  misc_feature: Ceres CLONE 1881460
  misc_feature: Encodes the peptide sequence at SEQ ID NO. 28045
ctgaccgccgacctttctcgtcactcctctcagatcccgaacgacccttcttaggcggaggaaggcgggggatcacgatcgcgagccggggacggcggcgagcgggatggcggcggcgctggctccgggggtgtcccggaagctgaagaaggtgctggagacgcggacggacagcccggatctgctggcatcgctgggcgcgctctccaccttctacgtgcagaacaccccgcaggctcgccgcaacctcaagtcctccattgagcagcgctcgctctccatcaaccgccacttcctcgacgcctcgcttcccgcccagaaggcgctcgatcgcgtcgagggggaggtgcacgcgctgaacgactcctggaaaaagattgaggaagcattgagcagttgcagtgcaagtactggggatatcattagtacaacagagaggatgcaacaggaacttgaagttattactcaacggcaagaaattgtgtcatgtttcctgcgggattaccaactatcaaatgaagagataattgcactccgtgaggaagagatcgatgagaaattcttcaaggcattgctgcatgttcaagaaatacactcaaactgcaaagtcctgctgcgaacacaccaccagcgtgctggtttggagcttatggatatgatgtctgtgtaccaagagggtgcttatgaaaggttatgcaggtgggttcaagctgagtgtaagaagttaggtgatactgacaatcctgaagtaagtgaccttttgaaaaaggctgttcgctgcctgaaggaaagacctgttctattcaagtattgtgcagaggaggtggccaacatgagacaccatgccttattcaggcggtttataagtgctcttactagaggtggacctggagggctcccaagacctatagaagtgcatgcccatgatcctcttcgttatgtaggcgaaatgctgggttggctacatcaggccctggcatcagaaagagagcttatagtcgtcttgcttgatcctgatgcaatgactgacagtggtccaacttctcgacgtcagtctgtaagagatggtgattcctccagaggagagcatgatgcaacttttgtgcttgatagaatatttgaaggggcatgtcggccatttaacgttcgagttgagcaagttttgcagtcacaaccaagcctgatagtttctttcaaacttaacaataccttggaattctatggctacacgatagcagaacttctgggcgaagacactgcactgtgcaatacaatatggtctcttagagatgcagcgcagcagacattctt

SEQ ID NO: 28045 - protein, 401 aa, Panicum virgatum
  misc_feature: Ceres CLONE 1881460
  misc_feature (28)..(401): Pfam Name: COG6 Pfam Description: Conserved oligomeric complex COG6
MAAALAPGVSRKLKKVLETRTDSPDLLASLGALSTFYVQNTPQARRNLKSSIEQRSLSINRHFLDASLPAQKALDRVEGEVHALNDSWKKIEEALSSCSASTGDIISTTERMQQELEVITQRQEIVSCFLRDYQLSNEEIIALREEEIDEKFFKALLHVQEIHSNCKVLLRTHHQRAGLELMDMMSVYQEGAYERLCRWVQAECKKLGDTDNPEVSDLLKKAVRCLKERPVLFKYCAEEVANMRHHALFRRFISALTRGGPGGLPRPIEVHAHDPLRYVGEMLGWLHQALASERELIVVLLDPDAMTDSGPTSRRQSVRDGDSSRGEHDATFVLDRIFEGACRPFNVRVEQVLQSQPSLIVSFKLNNTLEFYGYTIAELLGEDTALCNTIWSLRDAAQQTF

SEQ ID NO: 28046 - DNA, 643 bp, Panicum virgatum
  misc_feature: Ceres CLONE 1881460-R
ctgcttgagctcattgatacctacaatagcatgatggttcctgcctctggaaaaagcccaaactttgatccagttatttcggcattactggatcctataattcagatgtgtgagcaagctgcagatgcgcaaaagtcaaaaggttcacttgctcggcgtggtagaacaagctctgatcctagtagaaatagcagagattcaatatcagttgatgctattctgtctaagaacttatctacatcgattctgagtgctgaatcttcgtccaaagtctacctcatcaactgcttatcagctattcaggaaccattgatgggccaggaggttgctacaagctatgtaaacaacctgcgttctatgattgaatcgcacattcgtgcccttgtagataaagaagttgacggcattcttaggaaatgtggactgtcaaataagatgccatacataaaggactatgataacaatgatgatgcaaggcctctggctgatgttgtcgagacgtctccgcaaatgcttctggaatgcttgaaggcattctatggcattgtgactggaacagaaggttccttgcctgaatttgagcaactgcaggttccaaggttacgttcagatgcctgctatggtttggcaagagttctagcag

SEQ ID NO: 28047 - DNA, 675 bp, Panicum virgatum
  misc_feature: Ceres CLONE 1881467
  misc_feature: Encodes the peptide sequence at SEQ ID NO. 28048
accactcctccccttccaaccccagcacccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgtggattctgagttttgaaaaccccccccctttttttgtgcactttgtaacgaatgccagttctgagttttgagaaccccccccccccttttttgtgcacttggtaacgaatgccagttcattt

SEQ ID NO: 28048 - protein, 147 aa, Panicum virgatum; identical to SEQ ID NO: 13747
  misc_feature: Ceres CLONE 1881467
  misc_feature (109)..(141): Pfam Name: L15 Pfam Description: Ribosomal protein L15

SEQ ID NO: 28049 - DNA, 716 bp, Panicum virgatum
  misc_feature: Ceres CLONE 1881507
  misc_feature: Encodes the peptide sequence at SEQ ID NO. 28050
gccaatcgcagaacgagttccacgtcatcaccatcaccgttcaccagccatgtcgaggccgtcggcgtcgttgctcctcctcctgtcggcggcgacgctcgtcgccacctgccgcgcggaccccgagccggtccaggacttctgcgtggccgcgcggcggggcgacggcgaggcttccccagcgttcccgggcggcctcccgtgcaagccggcgtcgacggtggtctccgacgacttcttcttcgcggcgcacgcgcgcgccgcgagcacggacaacccgatgggttccggcgtgacgccgggcaacgtggaggcgttcccggggctcaacacgctcggcctgtccctcaaccgcgtggacctcgcccccggcggcgtcaacccgctgcacagccacccgcgctccgccgagctcgtgcacgtcgaggacggggagatgctcgtcgggttcgtcggcacggaggggaagttctactccaaggtggtgcgcgccggggagagcttcgtgatcccgcgcgggatgatgcacttccagtacaacgtcggcgccggcgccgcccgggccatgacggtgttcaacagccagctgcccggcctcgtgctcgccgcgcagtccctgttcggggccgagccggagatacccgacgccgtcctggccaagagcttccaggtggacgccgagatcatcaagctgctcaagtccaagtttcggaaag

SEQ ID NO: 28050 - protein, 222 aa, Panicum virgatum
  misc_feature: Ceres CLONE 1881507
  misc_feature (67)..(214): Pfam Name: Cupin_1 Pfam Description: Cupin
  misc_feature (101)..(176): Pfam Name: Cupin_2 Pfam Description: Cupin domain
  misc_feature: SWISSPROT Homolog: EC 1.2.3.4 Oxalate oxidase
MSRPSASLLLLLSAATLVATCRADPEPVQDFCVAARRGDGEASPAFPGGLPCKPASTVVSDDFFFAAHARAASTDNPMGSGVTPGNVEAFPGLNTLGLSLNRVDLAPGGVNPLHSHPRSAELVHVEDGEMLVGFVGTEGKFYSKVVRAGESFVIPRGMMHFQYNVGAGAARAMTVFNSQLPGLVLAAQSLFGAEPEIPDAVLAKSFQVDAEIIKLLKSKFRK

SEQ ID NO: 28051 - DNA, 1976 bp, Panicum virgatum
  misc_feature: Ceres CLONE 1881530
  misc_feature: Encodes the peptide sequence at SEQ ID NO. 28052
agggagagggtggggaggagaggccgcccccaggccaactaccaagtgggggaggaccgggccggaggtggggggatttctcgggggaggagtgcccgggaggacctgattgggggctccgggccgccatctctgagcgcagatttggtgcctgcgatctgccatggattcgatttaggtttggggagatcgatcgggtcgccttctcgccacgagatctagattcgatttttgtgcctgttttatccgcgagtcgtagaagaagaggagcaaataaagcaacaggaggaagaatttctcggggtgggcaaagggagaaggcatgatgctggaagggcagtcctacctcgtctcgcgctccctgccgagctcctgcgagccggagacggagtgggcgtacctcgcggaccaagtcctcagcggcaagcgccccgctccggaagatgtcgaggaagctgacggcggcggcaagcgcagcaagccgccgtctccgcagccgcacacgccggacatcaccgagggccacggctccagccgccatgcctccggtggtggggagccgcagggcactgggagcaaccccattaattctatcggccgtgacctgaccatcaattgcctcctccggctatcccggtcggactacggctcggtggcctccctcagccgcgacttccgctccctggtccgcagtggggagatctaccgcctgcggcgccagaatggggtggcggaacattgggtctacttctcctgcaatgttcttgaatgggatgcatatgacccatatcgagatcgctggatccgagtgcccaagatgccgccagatgaatgcttcatgtgctctgacaaggaatcactagcagttggcactgagctgcttgtgtttgggatggcgcgtattgtgttcagatacagcatcctaaccaattcatggacgagggctgatgcaatgaactccccccgctgcctgtttgggtcaacaagtgttggggagaaggccttcgtagctggaggcactgattctttgggcaccatactgagctctgcagagatgtatgactctgaatcacatacctggacgcctctccccagcatgaatagggcaaggaagatgtgttctggggttttcatggatggcaagttctatgtaataggtggcgtagccaacaacaacaaagtactgacttgtggggaggagtatgacatgaagaggcggtcttggaggatcatcgagaacatgtctgaaggcctcaacggtgtgactggtgctcctccccttattgcagttgtcaacaatgagctctatgctgctgattatagtgagaaggaactcaagaagtatgacaagaagaacaataagtggattactcttggaaagctgcctgaacggtctgtctccatgaatgggtgggggcttgctttccgagcatgtggagacagattgattgtcatcggaggcccgaggacctatactggtggtactattgagctcaactcatgggtcccaaatgatcggccgcctgtgtggaatatgattgccagacgaccatctgggaacttcgtgtataactgcgccgtgatgggttgctgagtccactgaataaaagatgaatgaagtggatatttatgaaggatggtatgcacagaggcggcctgtccaattgcttcagcccttattcttcgtagcgatttctgccttctgcccagtttcagaattaactggacatcagctgattgtcagcggtctcatgtaacccttgagttctaatacttctgtttccgtgctaatccatttccacatttgcatttggatcaactgctcgtgatttcaaagatacgagattatgcaaaacaaatgtcatattaataatctagaaaaactttcagagagtttttatctattgatgagaggaacctgttaagaaatacttgattcgcctgcagttgcaacaaatgctaattctttttcatcc

SEQ ID NO: 28052 - protein, 423 aa, Panicum virgatum
  misc_feature: Ceres CLONE 1881530
  misc_feature (214)..(260): Pfam Name: Kelch_1 Pfam Description: Kelch motif
  misc_feature (262)..(308): Pfam Name: Kelch_1 Pfam Description: Kelch motif
  misc_feature (86)..(133): Pfam Name: F-box Pfam Description: F-box domain
MMLEGQSYLVSRSLPSSCEPETEWAYLADQVLSGKRPAPEDVEEADGGGKRSKPPSPQPHTPDITEGHGSSRHASGGGEPQGTGSNPINSIGRDLTINCLLRLSRSDYGSVASLSRDFRSLVRSGEIYRLRRQNGVAEHWVYFSCNVLEWDAYDPYRDRWIRVPKMPPDECFMCSDKESLAVGTELLVFGMARIVFRYSILTNSWTRADAMNSPRCLFGSTSVGEKAFVAGGTDSLGTILSSAEMYDSESHTWTPLPSMNRARKMCSGVFMDGKFYVIGGVANNNKVLTCGEEYDMKRRSWRIIENMSEGLNGVTGAPPLIAVVNNELYAADYSEKELKKYDKKNNKWITLGKLPERSVSMNGWGLAFRACGDRLIVIGGPRTYTGGTIELNSWVPNDRPPVWNMIARRPSGNFVYNCAVMGC

SEQ ID NO: 28053 - DNA, 564 bp, Panicum virgatum
  misc_feature: Ceres CLONE 1881590
  misc_feature: Encodes the peptide sequence at SEQ ID NO. 28054
actcgccaccaactctctcactttctcaggagcgctagggtttcctgcggcggcggcggcgggggaaggcggctatggggcactccaacgtgtggaactcgcaccccaagaactacgggcccggatcccgcgtctgccgggtctgcgccaaccctcacggactgatcaggaagtacgggctgatgtgctgcaggcagtgcttccgcagcaatgccaaggacatcggcttcatcaagtaccgctgaagtcagctgtgggctatgagatggaccatgagatagaagcggggtgataatttaaattccagtaatgtagatgttttgttcagaactctgcaagtgaagtctgttgccagtgtttttgatggagaacttggccatgtccgtaatgttcgaatcatgagttgcctgcatatgtgcagaatttgagctaccctgtttgatgaccgtcttatctgtgtaccgatgtgcatgaagttggattgttatatataacgtgccataaagacctattgcaatataggacatttatctaggtgcaaattgggacggatcatggtttgct

SEQ ID NO: 28054 - protein, 56 aa, Panicum virgatum; identical to SEQ ID NO: 9888
  misc_feature: Ceres CLONE 1881590
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 28055 - DNA, 1045 bp, Panicum virgatum
  misc_feature: Ceres CLONE 1881593
  misc_feature: Encodes the peptide sequence at SEQ ID NO. 28056
accgcttcgcggcgcgggcaccttggacttggaacgcggtgactagaaagcgctagctcgcgggcgcgagacactatcgattgaggacgcgaaccgtcggccgcgagcggccgacaccagagccctgcccaccaccaccccgcgcgcactgcagctagctacccacacacagctcgaaccatcccctcgtccgccggcgccatgtcctcggcggctccgctgctcggctcccgcccggccgacgacggccaccagcaggagcggcggcggtgctcgttgtggctcggccccgtggtggacacggaggaggcgtgggcgcagctgcgcttctcggggccgatgatcctcatgaacatgttctactacggcatcccgctggtgtccgtcatgttctccggccacctcggcgacgtagagctagccggcgccacgctcggcaactcctgggtcaccgtcaccggatacgccttcgtcatcggcctgagcggcggcctggagacgctgtgcgggcaggccttcggcgccgggctgtaccggcggctgggcctgtacctgcagtcgtcgctcatcatgtcggcggcggcgtctgcgctcgtctccgtgctgtgggtgttcacggagccggtgctgctgctcctgcggcaggagccccgggtgtcgcgcgccgcggccgggttcgtccgcgcccagatcccggggctcttcgccttcgcctccctgcagtgcctgctccggtacctgcagatgcagtccgtcgtcctgccgctcgtcgccttctccgccgcctccttcgcgctccacgtcgcgctggcgtacctgctcgtcgccgtgctcggcctcggcatcgccggcgcgtccgccgccgtctccgtcaccttctgggccgcctgcctcatgctgctcgcctacgtgctgcggtccgaggccttcagcgagacgtggacgggcttctccgccgaggcgttcggatacgtgctgcccaccgtgaagctcgccgcgccgtccgccgtcatggtctgctttgagtactgggcgtttgagctcc

SEQ ID NO: 28056 - protein, 281 aa, Panicum virgatum
  misc_feature: Ceres CLONE 1881593
  misc_feature (46)..(206): Pfam Name: MatE Pfam Description: MatE
MSSAAPLLGSRPADDGHQQERRRCSLWLGPVVDTEEAWAQLRFSGPMILMNMFYYGIPLVSVMFSGHLGDVELAGATLGNSWVTVTGYAFVIGLSGGLETLCGQAFGAGLYRRLGLYLQSSLIMSAAASALVSVLWVFTEPVLLLLRQEPRVSRAAAGFVRAQIPGLFAFASLQCLLRYLQMQSVVLPLVAFSAASFALHVALAYLLVAVLGLGIAGASAAVSVTFWAACLMLLAYVLRSEAFSETWTGFSAEAFGYVLPTVKLAAPSAVMVCFEYWAFEL

SEQ ID NO: 28057 - DNA, 258 bp, Panicum virgatum
  misc_feature: Ceres CLONE 1881593-R
ctggagaatttaagaccggtggaggaaaggttcagatccaatggttctttggaagaatggaaggggagccccacgggggtcccggggtctggccccccccctcggaccagggatcaaggaaagggaaagttcggttggtttcccaaccaataaggggggaagggatttttcaggatttttcgccaacggctataggttattaacccaaaggtattccgggaggggttgggcggaaaaagggagaagagctcacctctc

SEQ ID NO: 28058 - DNA, 572 bp, Panicum virgatum
  misc_feature: Ceres CLONE 1881632
  misc_feature: Encodes the peptide sequence at SEQ ID NO. 28059
gacgcttcgctccacgcctcttggcatttgactttgcttgacatgcagtagaaagctccaaaagccagccccactctacttgctttgatcccatccatgccaccaccggacccagaaagcaacgaagcggaagcgggggcgatggggttcgggtccgcccgcgccgcgaccgccgcggagcacctggtcggcgacgccgccctcctccgtcatgctcgcgcgaggcggcgagtccggtcagtttctggctcccgccgccgtccgccgggggagggggagagggcttcctcggcggcgccagccgttacctgacgctggacgaggggtggatgaacccaaccctcgaccacttcaaccccacggaccatcggcaattcaaacagcgttactatgaatttctcgactactaccgagctccaaatgggccaatcttcctaaaaatctgtggagaagcctcgtgcaatggaattgggaatgactacttagctgtgatggcaaagaaatttggtgctgcaattgtttctcctgagcatcgatactatggaaagagttctccttttgacagtctgacg

SEQ ID NO: 28059 - protein, 80 aa, Panicum virgatum
  misc_feature: Ceres CLONE 1881632
  misc_feature: SWISSPROT Homolog: EC 3.4.14.2 Dipeptidyl-peptidase II
MNPTLDHFNPTDHRQFKQRYYEFLDYYRAPNGPIFLKICGEASCNGIGNDYLAVMAKKFGAAIVSPEHRYYGKSSPFDSL

SEQ ID NO: 28060 - DNA, 2104 bp, Panicum virgatum
  misc_feature: Ceres CLONE 1881636
  misc_feature: Encodes the peptide sequence at SEQ ID NO. 28061
gtgtttgttccttcccctccgccgcccatttcaaacgaaactgaattccttccttccccttcgcctccgccatggcgtcgggctcctctcaccaccaaatcgaccagttcttcccggccacgaagcggaggtcctcgtcgcgcaaggacgacgcgccgcgacccgggccgcagcatgggagccccggcggcgccaaggggtccctggaggggtacctcgtccggtcgccttccacccgtgccacggtggcggcctcggcggccctcgcgggctcgccgaggggcggggacgcgggcgccaggcggagcctcacggccgctatggacgtcgatgtcgcctcctcccctccggcgccggcggttgatggggccgatttggagctcaggagattcacgacggacttcctttcccattgctgcagtgctatcccacctttgagggatgattctgagtatcgtgagcagttggagaagaagcagaagcggagtgcgagtcagtcgatcttggttccttgtgacaatgcctctgccaagaagcagtgcattgctcattgcagtggcttggaggctctaaaggaatcagatgatagtgtggccttcaagaagcaatgcatcaatcaccatggtggctcggaggctgtggaggaatcagttgagggggtaaaggtgagttgtgtgggattttcagcattgcaaagatgtagctttaccccaaatactacacagaaaaaagttgggttttctttagcccctggggacaccccaaaatctgtatcaaggaattcccttacttcacctggggaagaattctggaatgcagcaattgaatttgctgatggaatatctgcccagacagacaaggtccgtggaaagcctaagtttgatgcagcagaggataagttatcttgtgcagtagcactatgctctaagactcttcctagagcaggaaaggatgagcatgactgtcttaatacagtaggcagcaatgatacacatcagatggagaagttgtcaaacaaagttgaatttctggcagcaaagagtcagcatgtaaacagctctcctttgcctgtgaagcacctggacttctgtcatgaggatgacatccaagtttcaggtttgaaaaaatgtgaagaaaaaggcagaaatgaagctgataatgtacaaacaaaccatgttgaattgaaagatggtggccttcagagaaaagaaaatataaggaagggttcaatagatcttgtaaatgcaatgaagacaagtgctcttgatttgcatacggattctgcagccatgttccgatgtcatggtgtattcaagtcaacaaccgaagggaatgttcactcaactcgagagggtgacaaagattctcatcaaaataaatcacttgccgcatattcaaatggttgtctgcctaagaaagacaccaaaagtaaatttgtttctcaagaagtggaagctagcacacctactagctctgttcctctgaaggaccactcaaagctatcaagttggctccctccagagctttgtgctgtatacatgaaaaaaggcatttcggagctgtatccttggcaggttgagtgcttacttgtggaaggtgtcttggagaaaaggaatcttgtgtattgtgcatccacgagtgctggtaaaagctttgttgctgaagttctgatgttgaggaggatactgtcaagtgggaatatggcaattcttgtccttccctatgtgtcgatatgtgctgaaaaggctcaacatcttgaacaacttcttgagccactgggtaggcatgtccgtagcttctatggaaaccaggggggaggatcgcttcctaaagatacagcagttgctgtgtgtaccatagagaaggcaaattctttggtaaataagttgttggaggatggccgtctctctgaacttggtgtaattgtaatagatgaacttcatatggtaaggttatctaaagccaaattgctactcagaaaatactctctttgcttttctactttttttacttacatggttatttgtactcaatcttttttgcaatgtaatcccattgtcttgggaactgccacttcgcaatataagtttgtggtgacattgac

SEQ ID NO: 28061 - protein, 677 aa, Panicum virgatum
  misc_feature: Ceres CLONE 1881636
  misc_feature (500)..(651): Pfam Name: DEAD Pfam Description: DEAD/DEAH box helicase
MASGSSHHQIDQFFPATKRRSSSRKDDAPRPGPQHGSPGGAKGSLEGYLVRSPSTRATVAASAALAGSPRGGDAGARRSLTAAMDVDVASSPPAPAVDGADLELRRFTTDFLSHCCSAIPPLRDDSEYREQLEKKQKRSASQSILVPCDNASAKKQCIAHCSGLEALKESDDSVAFKKQCINHHGGSEAVEESVEGVKVSCVGFSALQRCSFTPNTTQKKVGFSLAPGDTPKSVSRNSLTSPGEEFWNAAIEFADGISAQTDKVRGKPKFDAAEDKLSCAVALCSKTLPRAGKDEHDCLNTVGSNDTHQMEKLSNKVEFLAAKSQHVNSSPLPVKHLDFCHEDDIQVSGLKKCEEKGRNEADNVQTNHVELKDGGLQRKENIRKGSIDLVNAMKTSALDLHTDSAAMFRCHGVFKSTTEGNVHSTREGDKDSHQNKSLAAYSNGCLPKKDTKSKFVSQEVEASTPTSSVPLKDHSKLSSWLPPELCAVYMKKGISELYPWQVECLLVEGVLEKRNLVYCASTSAGKSFVAEVLMLRRILSSGNMAILVLPYVSICAEKAQHLEQLLEPLGRHVRSFYGNQGGGSLPKDTAVAVCTIEKANSLVNKLLEDGRLSELGVIVIDELHMVRLSKAKLLLRKYSLCFSTFFTYMVICTQSFLQCNPIVLGTATSQYKFVVTL

SEQ ID NO: 28062 - DNA, 703 bp, Panicum virgatum
  misc_feature: Ceres CLONE 1881646-R
  misc_feature: Encodes the peptide sequence at SEQ ID NO. 28063
cactcagcatgcgactgcactacgcgccgctcattgagttgcctggtggaacgctgctgaagggtgccacgctggtggcgatcagaccaagcgaagatgccctgagagagggtcaaggggttggggctgctggttctgttggtacatgttggatttcagaggcctttgaggagccatatcggactgccgcaaaggtgcttctcaagagaagcccatattgccttgaaatgaactcattctaaccaccagggattcaattcaagagagttatacccttcttgcaggatggtgggatgctttttggatgaatataggagtatttataattcagtgcaggaaccggacaaagacgctccccatctgttgattctgattccagtgtagtggtaactttgcttacctgtaagtatatatatacatgtctgtgttgggttactacaggcgaaatggtatgccattcgtgtggaatctacagcaatgtactaagaagagaagcaatggaatgttcctcacttgagcttggtgcatggtgctcctaggccaagctgacattacgctttcctcaaggaagcccccaaagatttcgttattatcagcaccttttttttggcttaaatcttgtggggtcatgcttttggcactgtatcaattatagacaggaatacagtccttttcaaagaagttagccctgctgtccgtttct

SEQ ID NO: 28063 - protein, 79 aa, Panicum virgatum
  misc_feature: Ceres CLONE 1881646-R
  misc_feature: Functional homolog of the protein sequence given in SEQ ID NO 50588
  misc_feature: Useful for making plants with modulated low light sensitivity
  misc_feature: Useful for making plants with modulated nitrogen use efficiency
LSMRLHYAPLIELPGGTLLKGATLVAIRPSEDALREGQGVGAAGSVGTCWISEAFEEPYRTAAKVLLKRSPYCLEMNSF

SEQ ID NO: 28064 - DNA, 965 bp, Panicum virgatum
  misc_feature: Ceres CLONE 1881646
caccgtccccgatccccgtgacccccctctggcctctctcctcgcactagcagcagcagtccagccgcgagccgtgccgggcgcccgtgcgcgccgactaccagcgagcaatccgccgcgggggagtccaatcgaggcctcctctccggatcccgatctgcggggccgcgtgggtgcgtcaggggatggaggaggggcggcaggagcaggaggcggcggaggaggtggaggggcgcccctgcggcgagggcgtggaccacttcgaccgcctccacgacgcggtgctgctcgacgtcctcaaccgcatcggcgacgtcaaggcgctgggccgctgcgccctcgtctcgcgccgcttccacgccctcgtcccgctcgtcgactccgtcttcgtccgcgtcgactgcgtcatccccgacgacccgccgccctccgcgtccgcgggccccggctccccgcagcagcagcaccaccaccaggcgccggcgcccgccccggccgggcgcggccgcggcgcgctctcgcacttcgcgcgcgtcctgctcggcggcatcgccaggcccatccacgcgctcggccagattctctcccccgccgcggccgccgtctccaggcgcgccgagccgcagccggcctcgccgcccgcgcccgcgcccgctgccgacgtctcccaccactcgccctccgaggtgctccgctccttcaaggagctgcgccgcctccacatcgagctgcccacgggcgagctcggcatcgacgacggcgtgctcctcaaatagaaggccgatttcgggtcaaccctcggcagctgcgtcatcctcggcgcctcgtcggtctcgtccaagccaacgtcgccgtccgcgcagcccgaaaccgctgccgatgacagcacggccacctcgcccgattccaacagggagactgaagagctggggagcgtacctgagtcgctctataccaatggaggc

SEQ ID NO: 28065 - DNA, 696 bp, Panicum virgatum
  misc_feature: Ceres CLONE 1881650
  misc_feature: Encodes the peptide sequence at SEQ ID NO. 28066
acatcgcataaacaagaagctacaggatggtgctctgggtcttcggctacgggtccctgatctggaaccccggcttcgacttcgacgacaagatccttggcttcatcaagggctacaagcgcaccttcaaccttgcatgcattgaccatagaggcacactagagcacccggcgaggacctgcacgcttgaaaccgacgaggccatctgctggggtatcgcatattgcgtcaagggtggtatagacaaagagcggaaagcaatgcagtacttggagagaagggagtgtgagtatgaccagaagatatctgttgacttcttcaaggaaggagattctctgaagccagctgtgacaaacgtgctagtttttgtatccacacctgatccaatcggcaacaagtactatcttggtcctgcccctttgaaggatatggcaagacaaattgctacagccaatggccccaatggctataatagggattacctgttctccatggagaaggcattggccagcataagccatgaagatgatgcgataattgagcttgctaatgaggtgaggatggtgctgaacagagcgaaggaggcgaagatcactggctccgacagaaccctgaaatctcatgttccgctggtgcacctgtctgctcttcccgaaggcactgttgtggactcgagatagcaagaaccttgaagcc

SEQ ID NO: 28066 - protein, 217 aa, Panicum virgatum
  misc_feature: Ceres CLONE 1881650
  misc_feature (3)..(180): Pfam Name: ChaC Pfam Description: ChaC-like protein
MVLWVFGYGSLIWNPGFDFDDKILGFIKGYKRTFNLACIDHRGTLEHPARTCTLETDEAICWGIAYCVKGGIDKERKAMQYLERRECEYDQKISVDFFKEGDSLKPAVTNVLVFVSTPDPIGNKYYLGPAPLKDMARQIATANGPNGYNRDYLFSMEKALASISHEDDAIIELANEVRMVLNRAKEAKITGSDRTLKSHVPLVHLSALPEGTVVDSR

SEQ ID NO: 28067 - DNA, 510 bp, Panicum virgatum
  misc_feature: Ceres CLONE 1881686
  misc_feature: Encodes the peptide sequence at SEQ ID NO. 28068
gttcaacacattgctcttgctggcacatcacattggcgagcgagcgagcgaggcgaatcaaccgccggtgaacccgttccgccgcccccgtcccctccggcgcggtcctccccgaggggcgagcgaggatgttctggcacggggtcgcggaccggctgacggggaagaacaaggaggcgtggaacgagcggaagatccgcggcacggcggtgctggtcaacatcctcggctgggacgagggcgtcgccctgcggctcgtcagcgccaccgccgccgaccccagcaatggaggccgggggaaggtggggaaggcggcgcacctggaggaggcggtgctgtcggtcaagtccagggcggacggggagacggtgttcccggtgaacttcgagtgggacgaatcgcagggcatcccgggcgccgtcctcgtcaggaacctgcagcacgccgagttcttcctcaagagggtcaccctcgagggcgtccccggcaagggcaccgtcgtcttcgtcg

SEQ ID NO: 28068 - protein, 127 aa, Panicum virgatum
  misc_feature: Ceres CLONE 1881686
  misc_feature (39)..(127): Pfam Name: PLAT Pfam Description: PLAT/LH2 domain
  misc_feature: SWISSPROT Homolog: EC 1.13.11.12 Lipoxygenase
  misc_feature: Functional homolog of the protein sequence given in SEQ ID NO 50887
  misc_feature: Useful for making plants with altered lignin content
MFWHGVADRLTGKNKEAWNERKIRGTAVLVNILGWDEGVALRLVSATAADPSNGGRGKVGKAAHLEEAVLSVKSRADGETVFPVNFEWDESQGIPGAVLVRNLQHAEFFLKRVTLEGVPGKGTVVFV

SEQ ID NO: 28069 - DNA, 577 bp, Panicum virgatum
  misc_feature: Ceres CLONE 1881696
  misc_feature: Encodes the peptide sequence at SEQ ID NO. 28070
attctttccctcctcttctctctcttctccaccggcggctgtgcgagcgagcgggcggagcgagccgaacagcggtggcgcggagcgccagcgcccgtggtggaggaggttcggcaccgacgagcaagcgtgcctcccgtgcgggcgtaacccgcgggatccgcggcggcgatggcgagggggccatgtccggcctgcggccggccttccggcagcgcacggctcacggagggagccggcttctcgccgttgcagcggggacggcagagcccctcggggccaaaacccgggcgcgcctgccactgatgcgctgaccgtggcggcgccgaggcaccacgaccacagcggccccttagagtatgccttcaccatgaaggtcactgagaagcgcgatgtttatagtttcggtgtagttttgttggaactactgaccgggcaatcactaattcagcttctagagaaaggaagagatcttgtgaatttggttctgaagctaatcgatcatagacttgcagagttttgctggacacatgtaagacattcttatggcataatggcagaggtcaccatgtaatcc

SEQ ID NO: 28070 - protein, 190 aa, Panicum virgatum
  misc_feature: Ceres CLONE 1881696
  misc_feature: SWISSPROT Homolog: EC 2.7.11.1 Non-specific serine/threonine protein kinase
FFPSSSLSSPPAAVRASGRSEPNSGGAERQRPWWRRFGTDEQACLPCGRNPRDPRRRWRGGHVRPAAGLPAAHGSRREPASRRCSGDGRAPRGQNPGAPATDALTVAAPRHHDHSGPLEYAFTMKVTEKRDVYSFGVVLLELLTGQSLIQLLEKGRDLVNLVLKLIDHRLAEFCWTHVRHSYGIMAEVTM

SEQ ID NO: 28071 - DNA, 1285 bp, Panicum virgatum
  misc_feature: Ceres CLONE 1881705
  misc_feature: Encodes the peptide sequence at SEQ ID NO. 28072
agagcagagcaggagcagcaaagcccctgccccaccacccgcgcccgctgcagcggcgacgtcgccgccaagcaaaagcaacccggaggcgcgcgagccccacgccgcccgccctcctcctcgtcgattctctctcttctcggctgcatatccccaacagcacagcacagcacagcacagcacaggcatccaaccaaccaatagcccccgcgtgcgaggaagcgatttcgtctcgcgccgcatggaccgcatcgtcggcggcaagttcaggctcggacggaagatcggctgcggctccttcggcgagatctacctcgccacgcacatcgacacctacgagatcgtcgccgtcaagattgagagcagcaagacgaagcacccccagttgttttacgaggcaaagctctacagcactctccaaggaggaagtggcattgcaaatgttaagtggtgtggtgtagatggagaagaaaatgttctcgtcattgacctgctgggaccaagtttggaggacctgtttgtctattgcggcaggaaattcacactcaagactgtcctaatgctggctgatcagatgattacaagaattgagtttatgcattccaaagggtacttacacagagacataaaacctgacaactttctgatgggtcttggtcggaaagcaaatcaggtatacataattgattttgggcttgccaaaagataccgtgattctacgacgaaccgtcatattccttacagagaaaataagaacttgactggcacagcacgctatgcaagttgcaacacccaccttggaattgaacaaagccgcagggatgatttggaatctcttggctatgtccttttgtattttctccgaggaagccttccttggcagggactaaaagctgcaacaaagacacagaagtatgacaagatatgtgagaaaaagatatcaactcctatcgaggtcttgtgcaaatcctgtccggtcgaatttgcatcttacttccattactgccattcattgacatttgatcagcgaccggactatgcatttgtgaagcgactttttcgtgacttgtttacccgccaaggttatgaatttgattatgtctttgactggacagttttgaaatacaaacaaggccaaaaacaaaagcgaagtcctggggcgccagctcgaccaattcaagaagatgtacagaaacaagctggtgtaaatggtgtttttcgtagtgaagcccgggagcatgtagagacaagccatccaacatggcaagctgcagagtctcaaggg

SEQ ID NO: 28072 - protein, 347 aa, Panicum virgatum
  misc_feature: Ceres CLONE 1881705
  misc_feature (9)..(273): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 32 in US patent 7179962
MDRIVGGKFRLGRKIGCGSFGEIYLATHIDTYEIVAVKIESSKTKHPQLFYEAKLYSTLQGGSGIANVKWCGVDGEENVLVIDLLGPSLEDLFVYCGRKFTLKTVLMLADQMITRIEFMHSKGYLHRDIKPDNFLMGLGRKANQVYIIDFGLAKRYRDSTTNRHIPYRENKNLTGTARYASCNTHLGIEQSRRDDLESLGYVLLYFLRGSLPWQGLKAATKTQKYDKICEKKISTPIEVLCKSCPVEFASYFHYCHSLTFDQRPDYAFVKRLFRDLFTRQGYEFDYVFDWTVLKYKQGQKQKRSPGAPARPIQEDVQKQAGVNGVFRSEAREHVETSHPTWQAAESQ

SEQ ID NO: 28073 - DNA, 706 bp, Panicum virgatum
  misc_feature: Ceres CLONE 1881705-R
tgatgtgtgatgtcatcagtttgatgtggaatcgttcaagtggccaaattttttcaaaaaaaaaaaaggtatgaagggaggtgtgctgtagtttcttatcagtcttgctctggcaatgtttctgacactgcccttctagtgaaggctttggataacatgacttttgttaaaacgtctagtttgatggaatatatttttatcagaaccaataactgatgtttgatctttggagggacttcctgtcattttgtttgtccttctctttcgaggtcaaagctttggtgatcctttcctactccatggtccaacaaactccacatttgcaccaagtttgcttgcagaaaacttgactgttgataatgaattttctggttctacaggtttccatgtcaccgttgtactggccaagtccagccatgagagttgtcatgacaatgttacgtgcctggttgtcttggttgtagttttgtatcatctatcccgacaaccaaagtatggagtaaagttccctctagtgctatgtaacatattccatgtccagtagttttattgttatgatgtgtgttccatataattttcagtgtatatttgtgattggtagtgattgcaaagttgaaaacgaactcatgcattgtaagcaagataaatttaagaacacacatctggggacttcagttccattgtaatttatcaagtgcttttcttg

SEQ ID NO: 28074 - DNA, 567 bp, Panicum virgatum
  misc_feature: Ceres CLONE 1881710
  misc_feature: Encodes the peptide sequence at SEQ ID NO. 28075
atgccagctcccctctctcctctcacactgctccactccctcaccgacaatagaccactgaaccggatccatagcagagcgtgttgcgccggcctagctcttgggtcgtccagtctccgttctttctttctttctccgaccggtagctgatctcctgtgttaatcccgaccggagctgcctgcgatgggcatcgtctacctcgtctccgtgttctgcaccctgccgaggacttgccggcccctcatgaacaggaagaagttccagacgggggacatgaacatgcggatcgactgcgaggggtgcgagcgcaaggtgagcaaggcgctggagggcatggagggcgtgagctccgtggaggtggcgccgcggcagcacccggtgacggtggccgggtacctgcacgccggcaaggtgatgcggcgagttggcgccgccgaccggcgaactgaggtcgccgtggcccgacgtgtgcaaatatccggggccgcacgcctagtctattggttgctaggaggagagaggttcttctgtgtagttgcacgctatcccctgccattcctgcgtcg

SEQ ID NO: 28075 - protein, 127 aa, Panicum virgatum
  misc_feature: Ceres CLONE 1881710
  misc_feature (30)..(92): Pfam Name: HMA Pfam Description: Heavy-metal-associated domain
MGIVYLVSVFCTLPRTCRPLMNRKKFQTGDMNMRIDCEGCERKVSKALEGMEGVSSVEVAPRQHPVTVAGYLHAGKVMRRVGAADRRTEVAVARRVQISGAARLVYWLLGGERFFCVVARYPLPFLR

SEQ ID NO: 28076 - DNA, 653 bp, Panicum virgatum
  misc_feature: Ceres CLONE 1881727
  misc_feature: Encodes the peptide sequence at SEQ ID NO. 28077
atcggcgcaggaaccgccatcgaaagccttggcccttaagcttagccccccaccgacccacctcaccgccgggattccgaatttttcttacctcgaaaggggaaaatcctggtcttttcttttctctctcgggggagttggcggcggcggcggcggcggcggcggggatcgcgatgggcgccgcgagggaggagggcggcgaggcgtaccggtcgtggtacctgagccgggaggagatcgagcgcgactcgccgtcgcggcgggacggcgtcagcgcggccaaggaggcggagctccgggccacctactgctccttcatccgcgatgtctgcatcaggcttcaattgccgcagattacaatcgccacggcgatcctgctctgccaccgcttctacctccgtcaatcccatgctaagaacgagtggcagactgttgcaactgtttgcatatttcttgcttcaaagattgaagacacaccttgctcgttaaaaagtgtcgtcattgtggcatatgaaacaatgtatcggaaaaacactgatgctgctaagagaatccaccaggaggaagttcttgctaagcagaaatccctgattttggttggggagacactattgctttccaccattaggtttgatttcaatatacgtcatcct

SEQ ID NO: 28077 - protein, 159 aa, Panicum virgatum
  misc_feature: Ceres CLONE 1881727
  misc_feature (13)..(156): Pfam Name: Cyclin_N Pfam Description: Cyclin, N-terminal domain
MGAAREEGGEAYRSWYLSREEIERDSPSRRDGVSAAKEAELRATYCSFIRDVCIRLQLPQITIATAILLCHRFYLRQSHAKNEWQTVATVCIFLASKIEDTPCSLKSVVIVAYETMYRKNTDAAKRIHQEEVLAKQKSLILVGETLLLSTIRFDFNIRH

SEQ ID NO: 28078 - DNA, 2190 bp, Panicum virgatum
  misc_feature: Ceres CLONE 1881729
  misc_feature: Encodes the peptide sequence at SEQ ID NO. 28079
acctcaccgcacccgcgtcaaccaaccaaaccctagaaggctctcgctcgccccccccccccgtccccaatccctcgccgccccccctcgatccccgccgcctgctggccaaaaccctacgcctctccctcgccgccgggtaaaagcagtgtaattacttgtctaaaatgccgtctgcatccaagtccaagtcgaaagacagatcagctgcaaaagttacaaaagagcaacctaaggttgctggaaagccaatggggaatggtacgcttgcaagttcttacaacaacctctctggaaagtttcatgttctggaaccatcggcgtctttgttgggtagccaaggtattgataaattcaggaatacagatgaaatagatgagcattctcgtagctcccatggtacaggggacttcgattgtgcctccaataatggaagctgttctggtgagtcagaagatccaaaggagaaagcaaccagtactacgtctcgagtggactctgttctgggatgtgatattgataaacgtgagaagatcagacagaagaatgagaagaagcatcaacggcagaaggagaggcgtgcccaggaattacatgagcgttgcaagggataccttatgtctagaaagttggaggcactcgcgcagaagcttgtcgcgatgggtttctcagcagatcaagcaacgatggcccttatacagaatgagggttgcgttgaggagtctgttacctggctctgcaactttgatggcagtgaggaaactaagcaacaacttgcagctgatcaacagtctggggtcaacttgaagattgatatagctgacgagcttgcaaaaattgcgagcttggaggcgaaatataagtgtacaaagcaagaggttgaaagggcagttgtttcctgtgagggtgatctagaaaaggctgaggaggtcttgaagacacataagcaagaatcaactgcagcaccatctaagcctgaaggttctggcgattcaggtggcttgcctaacaagcagcaggtcgtacttgcgcagaaccctgcaaggcctcaaacaaatggattttcttcagtaggagttcagcaaatgaggagagagaaggacttaaactataagcttctgatgaatggtagtggtccaaaggaacctgcaattaaaggctttcagccactggctgcatcaatgaagctagagatgggccgccaacaacttgtacaacctgagaagaggtgtcttagtgccaactcagttccatcagttccttatgtggcatcatctccattgcctgttgcagtaccgcaactgaagtcagacatgcggcatgtggcaggaggcaatgaggtgaaaagtgtgatgcccaatggaagcttgcgagagtcagtagttgtaatgcagcgtcctcaatccgcaggttccaagcagagcctaccatccaccagccatagtatgtttgcatcagagccatcttcaaggaagtggtacttaaatggtgcatcaggtgttgagatgatgttgaatggtggcttggggcatgaactaaggaatatgagtttggacaatgttagttctgccaggccgtttggacatacaaaccatcaacaaagtttcgtttccaatcctatagagctggctgccaatggttggggtggcacctggagttctggaggtacatcatcctcccgttctgtggcgtcatcactcggggcatttagagggtggaactcatctgaatcctcctctacattgtctcattctgattggagaaccaatgggccggcaccttatgactacacctcagtagactggagtgtcgacacaacgttgttgaacccagcggcaaagagcgagcggctgtcagacacatggtcaaccatgttcatgggcggcagatccggaagggcagctgggaacctcagcggtgcaggcatcgctgggttgcatgacagtaaccatccaatggatcctgctccatcacctcgtccatatgagtggccttctttctgcaggggaggatcttcctagttccccctaccctgtaggtaagaggccattgaataaaaaaagtaaaagttgtcatttgtttcttttcttgttttggtcctcagttgcagttggttgaaaaagttttactttgtgtatcgaaccgtgcttgtgtatcttgactgttggccgagataagtcatcttcctgc

SEQ ID NO: 28079 - protein, 617 aa, Panicum virgatum
  misc_feature: Ceres CLONE 1881729
  misc_feature (154)..(190): Pfam Name: UBA Pfam Description: UBA/TS-N domain
MPSASKSKSKDRSAAKVTKEQPKVAGKPMGNGTLASSYNNLSGKFHVLEPSASLLGSQGIDKFRNTDEIDEHSRSSHGTGDFDCASNNGSCSGESEDPKEKATSTTSRVDSVLGCDIDKREKIRQKNEKKHQRQKERRAQELHERCKGYLMSRKLEALAQKLVAMGFSADQATMALIQNEGCVEESVTWLCNFDGSEETKQQLAADQQSGVNLKIDIADELAKIASLEAKYKCTKQEVERAVVSCEGDLEKAEEVLKTHKQESTAAPSKPEGSGDSGGLPNKQQVVLAQNPARPQTNGFSSVGVQQMRREKDLNYKLLMNGSGPKEPAIKGFQPLAASMKLEMGRQQLVQPEKRCLSANSVPSVPYVASSPLPVAVPQLKSDMRHVAGGNEVKSVMPNGSLRESVVVMQRPQSAGSKQSLPSTSHSMFASEPSSRKWYLNGASGVEMMLNGGLGHELRNMSLDNVSSARPFGHTNHQQSFVSNPIELAANGWGGTWSSGGTSSSRSVASSLGAFRGWNSSESSSTLSHSDWRTNGPAPYDYTSVDWSVDTTLLNPAAKSERLSDTWSTMFMGGRSGRAAGNLSGAGIAGLHDSNHPMDPAPSPRPYEWPSFCRGGSS

SEQ ID NO: 28080 - DNA, 661 bp, Panicum virgatum
  misc_feature: Ceres CLONE 1881758
  misc_feature: Encodes the peptide sequence at SEQ ID NO. 28081
gtgtttttggcttcccgtgacatccgcggcgacgcgcctgcgcttccggtcagcacacgggggcacccatggcggcgcgggggaagaagctcatcaacgatcccaacgatgtggtgacgcagttcattgagggcttggccgagacgtaccccgggctacagtacctggacgggttccccgagatcaaggtggttctccgctccgatgtcgtggtcgggacgtacgataaggttgctgttatttgcggaggtggaagtggtcatgaaccagcccatggtggatttgttggtcaaggaatgctgactgctgctgtttctggagatgttttcacttctccacctgtcaactctattttggctgctatccgagctgtaacaggtcctaagggctgtcttttagtagtaacgaattacacgggcgaccggcttaattttggcctagcagctgaggaagcaaaatctgaaggctacaaagtggagatggttatcgttggagatgattgtgctctcccaccgactcaaggcatagctggcaggagaggcattgcagggacaattcttgtgaataaagtcaaaggtggtagactatgtcattctgaaaaataaacttctacctcagaccgtaatgttcatgtgggaatgatatgtacattctaaactag

SEQ ID NO: 28081 - protein, 178 aa, Panicum virgatum
  misc_feature: Ceres CLONE 1881758
  misc_feature (22)..(178): Pfam Name: Dak1 Pfam Description: Dak1 domain
  misc_feature: SWISSPROT Homolog: EC 2.7.1.29 Glycerone kinase
MAARGKKLINDPNDVVTQFIEGLAETYPGLQYLDGFPEIKVVLRSDVVVGTYDKVAVICGGGSGHEPAHGGFVGQGMLTAAVSGDVFTSPPVNSILAAIRAVTGPKGCLLVVTNYTGDRLNFGLAAEEAKSEGYKVEMVIVGDDCALPPTQGIAGRRGIAGTILVNKVKGGRLCHSEK

SEQ ID NO: 28082 - DNA, 692 bp, Panicum virgatum
  misc_feature: Ceres CLONE 1881775
  misc_feature: Encodes the peptide sequence at SEQ ID NO. 28083
gatcaagaggcagactttcctctcagcctatcgatccgccacctagctagctctcctagctgaaatggcggtggagatcctcgagtcctgcatggtgacgcccggcgaggcggcgacgcccaagcatggcgtgtggctctccaacctcgacctcctcgtggccaggagccacacgcccaccgtctacgtctaccggcccagccccggcccggccttcttctcgccggacgtcctcaaggccgccctgtccaaggcgctcgtccccttctaccccctcgccggccggctcgctcgggacggcgctggccgcccggagatccactgcaccggcgacggcgcgctcttcgtcaccgcgcgcgccgacgctacgctccaagatctcggcggcttcgtcccgtcggacgagctgcgccggatgcttgtcccctcggtcgacggcggcgccgaccgcgccggcattctggccatgttccaggtgacgttctttaagtgcggcggcgtgtgcgtcggcgcggcgatccaccacacggcggcggacggcctcacggcgctggacttcgtgaacacctgggccgccatcgcgcgaggcgtcggcgaggcggcgccgcgcccgtggctggaccgcacgctcctccgcgcccgctcccctcccgccgtgcgggtcgagcacgccgagtactcccggcgcggcg

SEQ ID NO: 28083 - protein, 209 aa, Panicum virgatum
  misc_feature: Ceres CLONE 1881775
  misc_feature (1)..(207): Pfam Name: Transferase Pfam Description: Transferase family
  misc_feature: SWISSPROT Homolog: EC 2.3.1.144 Anthranilate N-benzoyltransferase
  misc_feature: Functional homolog of the protein sequence given in SEQ ID NO 50936
  misc_feature: Useful for making plants with altered carbohydrate content
  misc_feature: Functional homolog of the protein sequence given in SEQ ID NO 50937
  misc_feature: Useful for making plants with altered cell wall content and/or composition
  misc_feature: Useful for making plants with altered lignin content
MAVEILESCMVTPGEAATPKHGVWLSNLDLLVARSHTPTVYVYRPSPGPAFFSPDVLKAALSKALVPFYPLAGRLARDGAGRPEIHCTGDGALFVTARADATLQDLGGFVPSDELRRMLVPSVDGGADRAGILAMFQVTFFKCGGVCVGAAIHHTAADGLTALDFVNTWAAIARGVGEAAPRPWLDRTLLRARSPPAVRVEHAEYSRRG

SEQ ID NO: 28084 - DNA, 720 bp, Panicum virgatum
  misc_feature: Ceres CLONE 1881781
  misc_feature: Encodes the peptide sequence at SEQ ID NO. 28085
cccgatcctcctcggctcatcccctccctgagtccctgttccccttctccttctctcctcccctccttgctagggttcttgctaggttaaatcccacgccaggttaaaaaaaaaggttaaatcccacgctcctgtgctagatccgctaggagccggctgaagcggttccgttccgcccttgctctccgaaatccaactcctcctcccccgtccgggaagcgaaggccgcagtccctctcctccctcctcccctgctgtcctcggtgtccggcgcacaccacggccggcgcagggatgcagaaccccgccacgcccaccccggcggcggccccgtccaagggcaagtcggcggcgcagaatcctagcgagcaccacgccgcgacgaccgccccgtcggggacgccgtccaagggcaagtcggcggcggctcaggccgcggccgcgggccagggctcctcctcgcatcaccactccgctgccggcgccgacgcgtccgcccccaccctcaagcgcaagcgcggcgtcttccagaaagacctgcagcacatgatgtatggatttggggacgatcctaatccacttccagaaactgttgctcttgtggaggacattgttgtggaatatgtcactgacctggtgcacaaggcacagaatgttgcatcaaagagggggaagctcctgacagaggattttctttaccttatacgcaaggatttacgg

SEQ ID NO: 28085 - protein, 141 aa, Panicum virgatum
  misc_feature: Ceres CLONE 1881781
  misc_feature (76)..(141): Pfam Name: TFIID-18kDa Pfam Description: Transcription initiation factor IID, 18kD subunit
MQNPATPTPAAAPSKGKSAAQNPSEHHAATTAPSGTPSKGKSAAAQAAAAGQGSSSHHHSAAGADASAPTLKRKRGVFQKDLQHMMYGFGDDPNPLPETVALVEDIVVEYVTDLVHKAQNVASKRGKLLTEDFLYLIRKDL

SEQ ID NO: 28086 - DNA, 2142 bp, Panicum virgatum
  misc_feature: Ceres CLONE 1881803
  misc_feature: Encodes the peptide sequence at SEQ ID NO. 28087
gggtgcgaggaggcgcccgcaataaatcgaggcgcggcgccgctgccacttgcttgctccttcatcatcggctcgtccccgtgcgggttgggtgggtcggggacgttgctgctgcggagcggcgctctcaagtctcaactcgacggcggggttttggactgctcgttcgctttgtctctcgtgaagtgcgtgattaagtgcatctgaacctacgtcaggcgtgtaaacgcacctggatgcaatggagggcggtgtcaatgttgcagataaggcagagttcaaggagtgcctgcggctgacatggacacaaccttatatcctccagcttgtcttgtctgctggcatcggtggtctccttttcggatatgatacaggtgtcatatctggagcacttctgtacattcgagatgatttcgctgcggtggaaaagagcactgtattaagggaaacaattgttagtatggctgttgctggagctatagttggagctgcattgggtggttggatgaatgataagtttggaaggaggccttccatcataattgcggatgccctgttcttcggtggtgccttgatcatggcattttccccaacaccaacagtaatcatcgttgggagggtctttgttgggcttggagttggaatggcttccatgacagctcctctctacatctccgaagcctcccctgctagaatcagaggtgctcttgtaagcacaaatggtcttctcatcaccggaggccagttcttggcgtacctcattaatctagcctttactaaggtgccgggaacctggagatggatgcttggcattgcagggcttcctgccttggtccagttcatactaatgctgatgctgccagaatcaccaaggtggctttacaggaagggtaggaaagaggaagcttcagaaatcttgcggaagatttaccctgcgaatgaggtcgagcaagagattgacgccatgcgccaatccgtcgaggaagaggtgctccctgaaggttccatcggcgagcatggcctgattggcaagctgaggaaggcgctgggcagcaaggtggtccgccgggggctaatggccggcgtcatcgtccaggtcgcgcagcagttcgtgggcatcaacaccgtcatgtactacagccccacgatcgtgcagttggccggcttcgcctccaacaacacggccatggcgctgtccctcatcacctcgggcctgaacgccgtcggctcggtcgtgagcatgttcttcgtggacagggccggccggaggcgcctgatgctcatcagcctggtcggcatcgtcgtgtggctcgccgtgctcggcggcacgttcctgagcgccgcgcaccacgccccgcccgtcagcaacctcgagacccagctgctcgcgaaccagacccagacctgccccgagttcaaccccgacgtcccctggagctgcgtcaactgcctcaaggccgcctctgcttgcggcttctgcgctcaccagggagacaagctgcttccgggagcttgcttggcgctgaacgacgcgtcgcggcggacgtgccgtgcggaccagcgggagttctacacggaggggtgcccgaacaacttcgggtggctggcgctgatcggcctgggcgcctacatcgtctcctactcccccggcatgggcacggtgccgtggatcgtcaactcggagatctacccgctgcggttcaggggcatctgcggcggcatcgcggccgtcgccaactgggtctccaacctcatcgtcacgcagaccttcctgtccctgacaaaggcgctcgggacgtcggccaccttcttcctcttctgcggcatctccttcctggcgctcgtcgtcgtcttcttcaccgtgccggagaccaagggcctgcagttcgaggaggtggagaggatgcttgagcgcaaggactacaagccatggaagaggtaccaaggcgtcagcgacgtcgagccggcaaaaaacagcgaaatcggcctcactgcaccttgaattcgcatgagagcttcgtttgtctagaaagtagcaataattcgtatctaatctcttttagaattccaagaaggaaaagatgagtagtcaaaactccagttttatggaaatgtgaatgtgatatatgcttgattgctgct

SEQ ID NO: 28087 - protein, 586 aa, Panicum virgatum
  misc_feature: Ceres CLONE 1881803
  misc_feature (29)..(556): Pfam Name: Sugar_tr Pfam Description: Sugar (and other) transporter
MEGGVNVADKAEFKECLRLTWTQPYILQLVLSAGIGGLLFGYDTGVISGALLYIRDDFAAVEKSTVLRETIVSMAVAGAIVGAALGGWMNDKFGRRPSIIIADALFFGGALIMAFSPTPTVIIVGRVFVGLGVGMASMTAPLYISEASPARIRGALVSTNGLLITGGQFLAYLINLAFTKVPGTWRWMLGIAGLPALVQFILMLMLPESPRWLYRKGRKEEASEILRKIYPANEVEQEIDAMRQSVEEEVLPEGSIGEHGLIGKLRKALGSKVVRRGLMAGVIVQVAQQFVGINTVMYYSPTIVQLAGFASNNTAMALSLITSGLNAVGSVVSMFFVDRAGRRRLMLISLVGIVVWLAVLGGTFLSAAHHAPPVSNLETQLLANQTQTCPEFNPDVPWSCVNCLKAASACGFCAHQGDKLLPGACLALNDASRRTCRADQREFYTEGCPNNFGWLALIGLGAYIVSYSPGMGTVPWIVNSEIYPLRFRGICGGIAAVANWVSNLIVTQTFLSLTKALGTSATFFLFCGISFLALVVVFFTVPETKGLQFEEVERMLERKDYKPWKRYQGVSDVEPAKNSEIGLTAP

SEQ ID NO: 28088 - DNA, 736 bp, Panicum virgatum
  misc_feature: Ceres CLONE 1881810
  misc_feature: Encodes the peptide sequence at SEQ ID NO. 28089
acacagacacaacacgccggaaaccaagtagacagaagccacttcctcctcctccctgcgatcacccatcatggatggagagactgtagagaccctttccatcaaggttggaccatggggtgggagcagaggggttccatttgacatcatagaggaacccaagcgtctcgtgagcgtgacggctcgggtcggcacattcgtcagttcatttggtttcagctatgttgatccggcaggccggaagcacactgttggtccagttggcggtaacggtgggaagcttgttacgatccagtttgaaccaacggagtatgtgaaggaattctctggatccgttggtctcacaaaaggaacatggattgtgacatacctcaggattgaaacgaacctgaaatcatacgagctgtatgacgaagggacggacctctttcagtccctgccaggtttcctcggcatcctcatgccagagaagcaaattcccttcagcgtccctgtgccagagaacactagcattgtgggattcttcggccgtgcagggggcgataatcttgatgccattggcgtctacgtgaaaatgaaatcagctaacacaaacacagaacaagaaacaggaatcaacctggatgattattccccagaggaaccaatcttcatggttgccgaggctgttcccatcaagattggagcatggggtggggatggagggacagagttcgatgtcacggagccacccagc

SEQ ID NO: 28089 - protein, 221 aa, Panicum virgatum
  misc_feature: Ceres CLONE 1881810
  misc_feature (21)..(169): Pfam Name: Jacalin Pfam Description: Jacalin-like lectin domain
MDGETVETLSIKVGPWGGSRGVPFDIIEEPKRLVSVTARVGTFVSSFGFSYVDPAGRKHTVGPVGGNGGKLVTIQFEPTEYVKEFSGSVGLTKGTWIVTYLRIETNLKSYELYDEGTDLFQSLPGFLGILMPEKQIPFSVPVPENTSIVGFFGRAGGDNLDAIGVYVKMKSANTNTEQETGINLDDYSPEEPIFMVAEAVPIKIGAWGGDGGTEFDVTEPP

SEQ ID NO: 28090 - DNA, 638 bp, Panicum virgatum
  misc_feature: Ceres CLONE 1881845
  misc_feature: Encodes the peptide sequence at SEQ ID NO. 28091
accgagccgacggagtcagtctcgctcgctccgccggccgccgccatggagccgtcggcttcgagcttggcggcgcgcagcgacctgcgctcggcgctgcccttcctccccgttgtactccgcggcagcgcgctcttttggccgcccgcggcgcaggagtcgctcagggcgctagcgctcggccccgacgtcagccgcgtcgcctcgggggacgtcctcgccgacgcgctcaccgacctccgcctcgcgctcgccctgcccgcgctgtccccgcgcgccgccgatggcctagccctcttcttcgacgacgacctctcgcgggcccaggcgcggggctggttcgctgaggtggtccccaacctcgctcgcctcctcctccgcctcccagcgctgcttgaggatcactacgacaaggccgccgacggcgcctcggggctccggatcctggcgtcgcaggacgcgggcattgtgcacctcagccaggagcttgtcgcagcgctgctcacctgcgcgctcttctgcctcttccccacggtcggtagggccggggcgcgccttccaaacatcaatttcgacggcctattcgcagcgctggttcacaatgcaaggcaaagcccggagcagaaagtgaggtgcct

SEQ ID NO: 28091 - protein, 197 aa, Panicum virgatum
  misc_feature: Ceres CLONE 1881845
  misc_feature: SWISSPROT Homolog: EC 3.2.1.143 Poly(ADP-ribose) glycohydrolase
MEPSASSLAARSDLRSALPFLPVVLRGSALFWPPAAQESLRALALGPDVSRVASGDVLADALTDLRLALALPALSPRAADGLALFFDDDLSRAQARGWFAEVVPNLARLLLRLPALLEDHYDKAADGASGLRILASQDAGIVHLSQELVAALLTCALFCLFPTVGRAGARLPNINFDGLFAALVHNARQSPEQKVRC

SEQ ID NO: 28092 - DNA, 818 bp, Panicum virgatum
  misc_feature: Ceres CLONE 1881848
  misc_feature: Encodes the peptide sequence at SEQ ID NO. 28093
tctgctcctgcctgcaaggctgcagccgagccccgtcgatcgcccgccccccaaccacagcgagaggagaaaggaagagtagatcatgcagggcggcggcggcgtgagctgcgcggtggccggcgaggcgccgacaccggggccccggcgccggctgggcctgaccatcgaccccgcgggcgacgtggaggcccccgcggagcgcgtcgggcggctggtccgcgagagccctgtggtgatcttcgcccggcgcgggtgctgcatgtgccacgtgatgcggcggctgctggaggccgtgggcgcgcacgcgacggtgatcgaggtggaggaggccgccgaggaggccgcggcgtcggcggccgccgcggccgccgtgccggctctgttcgtgggcggcgcgcccgtgggcgggctcgacgggctcatggggctccacctcagcggcctcctggtcccgcgcctccgcgaggtcggcgcgctctgcggctagggcccccgggccggccggccggggccgcgcgccgcgcgccggccgccggccgacgacccccacccccgccggagccgcggcgggcgggtcgcttcgctttgctcgggcctccctctgtagatacacgggtacgctacgttacgtaatttaggagcaagtcgaggggggcggagcaaaatggacagtgacgttagtaagacgtcgtcgcgtgctgtacactttgctacggcctacggggctggcgcctggcggcgagagggctggctaaagctgagggctcctgtgagaaatgtctgggtctaaatgtaattaatacgtttttccttct

SEQ ID NO: 28093 - protein, 134 aa, Panicum virgatum
  misc_feature: Ceres CLONE 1881848
  misc_feature (50)..(107): Pfam Name: Glutaredoxin Pfam Description: Glutaredoxin
MQGGGGVSCAVAGEAPTPGPRRRLGLTIDPAGDVEAPAERVGRLVRESPVVIFARRGCCMCHVMRRLLEAVGAHATVIEVEEAAEEAAASAAAAAAVPALFVGGAPVGGLDGLMGLHLSGLLVPRLREVGALCG

SEQ ID NO: 28094 - DNA, 916 bp, Panicum virgatum
  misc_feature: Ceres CLONE 1881879
  misc_feature: Encodes the peptide sequence at SEQ ID NO. 28095
accaagtaccaccttcttcttcctcctcctcccttgtcctggtcccgggtcccggccaacaaacagcaagagggaaaagtagtgacgagccaaggaaccaatggaggactactactacttccccagctccgggcagaccgccggctacgtcgaggcgggattccccagccacgccgtgcctcgcaacccgagctcgccgtcgccgaggccccgccgcgcgtcccgcgacgccggcgagctccggcaccacttcctcgacgcctgcttccggtgccggcggcatctcggtgggaacaaggacatcttcatgtacaggggcgatactccgttctgcagcgaggattgccggcagcagcagatcgaggccgacgaggcgagggagagggggcccaagcggcccgccgccgcgaagagggagcggcagcggcagagcagcagcccgcagaggatccccctctccctctgggcgcggtagatcgatcgatcgagcttcgagttcgagccggcggcatccaaccgaaccactactactacgacacccgggcgcctgaactgattggcgcatgtcgaatcgtcgatgcctcgagttcgtggcacgcatgtggcctccagctagctcgtcgggtgccaacgaacaaggcgcgacgagaaggtgcctctgcagttgagccagaggggggcgcggcttgccggctttgtccctgttgtctcggagaaatgacaggtcgtcccttggcccagtttttgtgtggattaccgaattattagcgcaggtttttgttccgttgctcggcgcgatcaagcgcgaccaactggggtttgtgtgtgtttttgtgtgcgattgccatgtactactccaacatcctgtacgaactatgatgaacaaataccatcaagcgcgagatgtggcttttcc

SEQ ID NO: 28095 - protein, 124 aa, Panicum virgatum
  misc_feature: Ceres CLONE 1881879
  misc_feature: Functional homolog of the protein sequence given in SEQ ID NO 50551
  misc_feature: Useful for making plants with modulated nitrogen use efficiency
MEDYYYFPSSGQTAGYVEAGFPSHAVPRNPSSPSPRPRRASRDAGELRHHFLDACFRCRRHLGGNKDIFMYRGDTPFCSEDCRQQQIEADEARERGPKRPAAAKRERQRQSSSPQRIPLSLWAR

SEQ ID NO: 28096 - DNA, 1002 bp, Panicum virgatum
  misc_feature: Ceres CLONE 1881892
  misc_feature: Encodes the peptide sequence at SEQ ID NO. 28097
gatcgacccccccgcatttacactgctccgcgggcacagtgaaccagacagccagcgacacgagcgacgagccaccaggtctccgagcgacgacggcgagcgccgccaccgcgccctgcagcggccacacctcgagctaagaaacgaagcagccatggcgacgcgtcgcctcccgtcgtccctcccgctgctgcttctccttgcggcgggatccctcgcagcggcggtggcggcggcaagcgcgcttggcgaatcccccgagacggacacggacatggtgccgcgcttcggccggatcctgcagcagctgcctcagcctcagcccatgccgcagccagacccgaacccacagccgcagcccggggtgaacccgccagtgccacagcccctgccgcaaccaaatccaaacccgccgcaaccgctgccgcagccacagcccgtgccgcagccgaacccgcagcccgggctgaacccaccccagccactgccgcagccgcagcccgggccacagccagacccaacagccccacagccgcagcccttgccgcagccggacccgaccctgccgccccagctcttgccggggccgcagccgcagccggaccctgccctgcagcagccgcagccagggacgacgacgcagccggctccgaacggccagaatccgcaggcgcagccggaccaggtgctcccgagcggcggggggtccaggatgctggtgaacctgcacaacttgatgtccatacttcttccaagtcttgcctatctgttaatgtaaactctgtacaatatatacgtttttctttcttcctttattcatttgttacccacgcctgtgtgtaaatatgtatagtcacgagatatgtatagttgtatttttcttatttttgcatcgttgtgcgagtgtgtagtagtgattacattgcatagatttttgcgagtgtgtggtaatgtgtatatatatacaatatgctccctacgttctaaattataagtcatttt

SEQ ID NO: 28097 - protein, 207 aa, Panicum virgatum
  misc_feature: Ceres CLONE 1881892
  misc_feature: Functional homolog of the protein sequence given in SEQ ID NO 50619
  misc_feature: Useful for making plants with altered lignin content
MATRRLPSSLPLLLLLAAGSLAAAVAAASALGESPETDTDMVPRFGRILQQLPQPQPMPQPDPNPQPQPGVNPPVPQPLPQPNPNPPQPLPQPQPVPQPNPQPGLNPPQPLPQPQPGPQPDPTAPQPQPLPQPDPTLPPQLLPGPQPQPDPALQQPQPGTTTQPAPNGQNPQAQPDQVLPSGGGSRMLVNLHNLMSILLPSLAYLLM

SEQ ID NO: 28098 - DNA, 677 bp, Panicum virgatum
  misc_feature: Ceres CLONE 1881907
  misc_feature: Encodes the peptide sequence at SEQ ID NO. 28099
aaaccatccgccccaccggacaccaccacaccaacgggctcgctcgctcgctccagcctccgccccctcgccgcacacctccgcaaaaacccacctgattccgtgtaaaccctcaccgcgatcctcggcaattcagcggccgcgatgcagggtctcgccccgcccacctctgtttccatacaccgaccggggtccagggcggcccgggcccccagctcggtgaggttcgctccgcgcgcggtcagctccgccgagtgcctgccgccggcgacgttcaagcccgccattgccgcgccgaggccctccgcgcccgcgcaggcctcgccgccgcggacggcggggaggaagaaggagctcaatttcttccagcgcgccgcggcggcggcgctcgacgcgtttgaggaggggttcgtggcgggcgtcctcgagcgcccccacggcctgccccggacggccgacccggccgtgcagatcgccggcaacttcgcgcccgtcggggagaggccccccgcccgcgagctcccggtctccggccgcatcccgccctttatcaacggcgtgtacgcgcgcaacggcgccaacccctgcttcgaccccgtcgccgggcaccacctcttcgacggcgacggcatggtgcacgcgctgcggatacggaacggcgtcgccgagtcctacgc

SEQ ID NO: 28099 - protein, 177 aa, Panicum virgatum
  misc_feature: Ceres CLONE 1881907
  misc_feature: SWISSPROT Homolog: EC 1.13.11.51 9-cis-epoxycarotenoid dioxygenase
  misc_feature: Functional homolog of the protein sequence given in SEQ ID NO 50881
  misc_feature: Useful for making plants with modulated water use efficiency
  misc_feature: The sequence is a functional homolog of SEQ ID NO 6 in US patent 7049487
  misc_feature: Functional homolog of the protein sequence given in SEQ ID NO 50875
  misc_feature: Useful for making plants with modulated drought sensitivity
MQGLAPPTSVSIHRPGSRAARAPSSVRFAPRAVSSAECLPPATFKPAIAAPRPSAPAQASPPRTAGRKKELNFFQRAAAAALDAFEEGFVAGVLERPHGLPRTADPAVQIAGNFAPVGERPPARELPVSGRIPPFINGVYARNGANPCFDPVAGHHLFDGDGMVHALRIRNGVAESY

SEQ ID NO: 28100 - DNA, 1924 bp, Panicum virgatum
  misc_feature: Ceres CLONE 1881919
  misc_feature: Encodes the peptide sequence at SEQ ID NO. 28101
cgttcctctcattccccttccacctctctctctctctctctctctctctctcttcgcactgccctctctctcttacgcgcgcgtgacacctccacgggcgcgcgagagcagccgccaccgactgatcaccggcgggggcgggggcgggggcgatctgatgctggcgcggcggtgatggctgcgccatccgctggcgcagggggcggcgcgggggagggctcctcctcctcggccgccgcggctgccgcagccgcgacgatcggggcccacggggtcgaccaagttgcagaagcgatgtggcagatgaacttaggagaagctatggaactggggccgtacccagagcgtgttgatgagccagattgtagttattacatgaggactggcatgtgcaggtttgggatgacctgtaaatttaaccatccagcagataggaagctggccgttgctgctgcaagaatgaagggagaatatcctcaaagaaatggtcagcctgaatgtcaatactatctgaagaccggcacatgcaagtttggagcaacttgcaagtttcaccacccccgagaaaaggctgcaatggcaactcgagtgcagttgaatgaattgggctacccattccgcccgagtgaaaaggaatgtgcctattatttaagaacagggcagtgcaagtttggaagcacatgtaaatttcaccatccacaaccatctaccatgatggttgcagtacgtggttctggttattcacctggacagtctgcaacttctcctggccagcatgcgtaccaaggggctgtaacaagctggcccttgtcaagatctgcatctttcattgcaagtccaaggtggccaggtcattcaagctatgcgcaagtgcttgttcctccaggtcttgttcaggtcccagggtggaatccttacactgcgcagattggttcatcatcctcagaggaccaacaacggacacctggatctgcccaatactatactggctcacgccaaaggggaacacctggcattggagatcaaggaatgttttcatcataccaagctggttcagttcctgttggactttatgcagtacagagggaaaatgtgtttccagaaagacctgaccaacctgaatgtcagttctatatgaagactggtgcctgtaagtttggtgctgtatgcaagttccatcatcccagggagcgaataattcctactcccaattgtgcactgagttcattgggcctacccctgcgtccgggagaacccatttgcagtttctattctcgctatggcatgtgcaagttcggtccaaattgcaaattcgatcattcaataggaacagtcatgtatggccatgcttcatcaccatctagtgaggtcccaacttctcgactaatgctggcacatgtaccatctcatccagaagtatcacctgacaatggctcgggaatgtcgcggaggattacccgttcagattcccagcaaatatcctcgggtgaaaggagcactgagagagaggcgtcctaagccatcctcggttccatgttcatgctgcctcccattcttgactggagtaattatctgcaacaacatttgaggagctgtacaggtcttttgcgcttttacctcaccttcgagctttacataccggagcttgcttcaacatgtattgcattcaggcaggaaaaagttccttgcctgttcgggatgccaatttgtccaatggaaataggaacaaaccttaccttatttaaaacatatgtatggaaccaactcacctctggacattcgaaccgactcgagtgatgtgccgtgacggtgttgttgtagctatagaggtgcattgaaatggacaagcttttgcgaaacttgactagggatgcgcaagcataacctctttggttaattatctcgcttttctcaagcatttccg

SEQ ID NO: 28101 - protein, 447 aa, Panicum virgatum
  misc_feature: Ceres CLONE 1881919
  misc_feature (312)..(338): Pfam Name: zf-CCCH Pfam Description: Zinc finger C-x8-C-x5-C-x3-H type (and similar)
  misc_feature (104)..(130): Pfam Name: zf-CCCH Pfam Description: Zinc finger C-x8-C-x5-C-x3-H type (and similar)
  misc_feature (358)..(384): Pfam Name: zf-CCCH Pfam Description: Zinc finger C-x8-C-x5-C-x3-H type (and similar)
  misc_feature (150)..(176): Pfam Name: zf-CCCH Pfam Description: Zinc finger C-x8-C-x5-C-x3-H type (and similar)
  misc_feature (59)..(85): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
MAAPSAGAGGGAGEGSSSSAAAAAAAATIGAHGVDQVAEAMWQMNLGEAMELGPYPERVDEPDCSYYMRTGMCRFGMTCKFNHPADRKLAVAAARMKGEYPQRNGQPECQYYLKTGTCKFGATCKFHHPREKAAMATRVQLNELGYPFRPSEKECAYYLRTGQCKFGSTCKFHHPQPSTMMVAVRGSGYSPGQSATSPGQHAYQGAVTSWPLSRSASFIASPRWPGHSSYAQVLVPPGLVQVPGWNPYTAQIGSSSSEDQQRTPGSAQYYTGSRQRGTPGIGDQGMFSSYQAGSVPVGLYAVQRENVFPERPDQPECQFYMKTGACKFGAVCKFHHPRERIIPTPNCALSSLGLPLRPGEPICSFYSRYGMCKFGPNCKFDHSIGTVMYGHASSPSSEVPTSRLMLAHVPSHPEVSPDNGSGMSRRITRSDSQQISSGERSTEREAS

SEQ ID NO: 28102 - DNA, 1050 bp, Panicum virgatum
  misc_feature: Ceres CLONE 1881930
  misc_feature: Encodes the peptide sequence at SEQ ID NO. 28103
agcccccaacaccaagaaagagaagctcccggctccaaatcagacttacctgcgccttccggcctcctaccctccccggcgaggcttttatttccacacccaagattagcatccagctgaaccccaaatcattcagtctccatggaagccgatggcgccgctgccaggcttcggatcatcaacgacgcgatggaggaggtgcgccgcagaagcctccgcgagaggggctggaccatcgagcaggcgatggaggacatgcgcagcgggaagtgggagcggcgtcgcagggtctaccgccgccagcaggccaacgcccggctcgccgaggttgacccatgggatctcccgccgcaattcaccatgccgaaggagccggggagctcgagcctgcggacacattctgggtactggaaagagaaagaagatgagttcatcgcgatccgctccgagggaggaggacaaggctcgtcctcggcttccagtagctcgccgtgctacgaaggggttaggaggaccctggagttttacgagcacaacgacaccaagacggactgggtcatccacgagtacagcgacctccacgacaacaagattctcctggacgatatcgtctttcgtaaggtattcaacaaaaaacacacagatcggatcaccccttgtttagaggatgttgacatagccctggaagtttacgacgaatccttccccaagtacaccggccaacaacaatcaccgccggagcttgaaataatttggaaattgacgttcttagagtccattggatggttcaaggagcgtgaagaagcaggatctgagtgtggggagtttccaaccccgtctgctgctccaggtggagaatcatcagacgatgtttggccgcacttcaccagaataaacaccaaacatcccgatgagatgtacgcagtgtgccaccactgtgacagggtgctcaaggctccttccaagaatggcacatctcatctcagaaggcaccgtaagactaagacatgtacatgcaacaacaatccatcatccactgccgaagaccta

SEQ ID NO: 28103 - protein, 302 aa, Panicum virgatum
  misc_feature: Ceres CLONE 1881930
  misc_feature (242)..(291): Pfam Name: zf-BED Pfam Description: BED zinc finger
  misc_feature (42)..(147): Pfam Name: NAM Pfam Description: No apical meristem (NAM) protein
MEADGAAARLRIINDAMEEVRRRSLRERGWTIEQAMEDMRSGKWERRRRVYRRQQANARLAEVDPWDLPPQFTMPKEPGSSSLRTHSGYWKEKEDEFIAIRSEGGGQGSSSASSSSPCYEGVRRTLEFYEHNDTKTDWVIHEYSDLHDNKILLDDIVFRKVFNKKHTDRITPCLEDVDIALEVYDESFPKYTGQQQSPPELEIIWKLTFLESIGWFKEREEAGSECGEFPTPSAAPGGESSDDVWPHFTRINTKHPDEMYAVCHHCDRVLKAPSKNGTSHLRRHRKTKTCTCNNNPSSTAED

SEQ ID NO: 28104 - DNA, 736 bp, Panicum virgatum
  misc_feature: Ceres CLONE 1881930-R
  misc_feature: Encodes the peptide sequence at SEQ ID NO. 28105
ttgaaaaagatgtggaatggggacgatgacgataaagagtgctacattgatgagcgtgaagaagaggtgaaggcgtgcatgagcgccttgctccatgactgcttgctcggtgcggttcctcaaggtggtcaatcaggggttagaaagcgcaagagaactggtggtacggagggtggatcaaaagtttggctgtacttcactaagatttacaccacagatcctaagcaggtgtatgcagtgtgccactgttgtgacaggtgttacaagggtcactcgaagaatggcacctctcacctcaaaaggcacaacgagacatgctcaagcaagcactggaaagtgtaggggaagatgaagctcagagaacaggagaagagagaatgtgccgaagctaggaacgaaaaggatgaccataagctgtctttctttagtaaaaattgtagtgtcagtaaggcaagtcgtcgagttctatcggaggtctttttatatttaggtacaatgatacctgggccacctaatctatgatttggatattggaggagtaaatcttctgaatgtgaaaggtggaggtgggttttatagtaagatgtatttgatggggatctggagcttgcactttctttggaaccctacactattattactctgcttttcagtgttcgggctgttggaggcagatccttgatggaactggaatgtgatgttaggttattaacctgttgcagactgttcctcgctc

SEQ ID NO: 28105 - protein, 113 aa, Panicum virgatum
  misc_feature: Ceres CLONE 1881930-R
  misc_feature (60)..(107): Pfam Name: zf-BED Pfam Description: BED zinc finger
LKKMWNGDDDDKECYIDEREEEVKACMSALLHDCLLGAVPQGGQSGVRKRKRTGGTEGGSKVWLYFTKIYTTDPKQVYAVCHCCDRCYKGHSKNGTSHLKRHNETCSSKHWKV

SEQ ID NO: 28106 - DNA, 657 bp, Panicum virgatum
  misc_feature: Ceres CLONE 1881948
  misc_feature: Encodes the peptide sequence at SEQ ID NO. 28107
atcaggattcagggcgtcgcttccactcgtcgtaacggcacgacacgagcaaaggaggcagcaaagcggagacggcctttgcgcgagtgcgctctcttttaatttcttagctctagctagctagcacggtgggatgccgacgaggcggcgcggggggttccggctcggccggaagctgctcagcgtctggcgctgggcgctctgccaccgccggcgcggccgcggccgcgggtacctccgcctgcggccgtgccagggaggcggtggcagcgacggcggcaggtcgcccctgctggcggccgccacggtgtgcgccgccaggaagcaccagcagcagttggtggcgggggcgcgcgacgacgagtacgcctcctcgccgcggatgctgacgtgggggcggtcgctggcgcggcggatgaggctcctgcggcggggcggcggcgggagggaggaccggctgctggaggacgcggcggcggaggccaccacgcccaaggggcaggtggcggtgtacgtgggcggcgccgagcccgggggcgagtcgatgcggtacgtggtccccgtggtgtacttcaaccacccgctgttcggggagctgctgcgcgaggccgaggaggagttcggcttcgagcaccccggcgggatcaccatcccgtg

SEQ ID NO: 28107 - protein, 174 aa, Panicum virgatum
  misc_feature: Ceres CLONE 1881948
  misc_feature (77)..(174): Pfam Name: Auxin_inducible Pfam Description: Auxin responsive protein
MPTRRRGGFRLGRKLLSVWRWALCHRRRGRGRGYLRLRPCQGGGGSDGGRSPLLAAATVCAARKHQQQLVAGARDDEYASSPRMLTWGRSLARRMRLLRRGGGGREDRLLEDAAAEATTPKGQVAVYVGGAEPGGESMRYVVPVVYFNHPLFGELLREAEEEFGFEHPGGITIP

SEQ ID NO: 28108 - DNA, 700 bp, Panicum virgatum
  misc_feature: Ceres CLONE 1881949
  misc_feature: Encodes the peptide sequence at SEQ ID NO. 28109
gtccattccaagttctcgttttgaaaccaaaccacctcccaccacccagctgccgtttctaaaaaatcccctgcgtttcaagatcccggtcgccacaatgcctgccctcgccaagcccgcctcgcgccccgccaagaccgtcgcggcgccaaagccaaagcccgccgccgccaagcccaaggtcggggccggcgcccccccctcccacccgccctatttcaaaatgatcaaggaggcaatctcggcgctcaaggaaaggaccggttcgagctcgcacgccatcgccaagtacatggaggacaagcacggcccgtcactgccggccaattacaaaaaaatgttctccatccagttccgcgggttcgccgccaagggcaagctcgtcaaggtcaaggcctcctacaagctctccaacgccgccaaaaaggaggcccccaaggccaagcccgcacccgccaaaaccgtcgcggccaagccggccaaggccgccgcaaaaccaaaaaaaaccgccgccgccgcaaaaccaaaaaaaaccgcggccgccgccgccggaaccaagcgcaaggcgccggagaaggtcggggcaaagccaagaaagtccccggcggcgaaggccaaggctaagcccaggactgtcaagtcccccgcctccaagaaggcccggaaggtcgccgcatgagatggttccttaggtcgtagt

SEQ ID NO: 28109 - protein, 193 aa, Panicum virgatum
  misc_feature: Ceres CLONE 1881949
  misc_feature (36)..(106): Pfam Name: Linker_histone Pfam Description: linker histone H1 and H5 family
MPALAKPASRPAKTVAAPKPKPAAAKPKVGAGAPPSHPPYFKMIKEAISALKERTGSSSHAIAKYMEDKHGPSLPANYKKMFSIQFRGFAAKGKLVKVKASYKLSNAAKKEAPKAKPAPAKTVAAKPAKAAAKPKKTAAAAKPKKTAAAAAGTKRKAPEKVGAKPRKSPAAKAKAKPRTVKSPASKKARKVAA

SEQ ID NO: 28110 - DNA, 702 bp, Panicum virgatum
  misc_feature: Ceres CLONE 1881963
  misc_feature: Encodes the peptide sequence at SEQ ID NO. 28111
attggcgcctgcttctgtgtcctgctgacccgaggcatcgaccatcgatcaccactcacttttcccagcagcagcactgcccatcatatatagcctcctccatcccggtcccggcctctcttcgatctctagctatatagcatgcatattacacacaatagctagctatctatagctagtctctcacacaacacaacacaacacaacacaacacaacacaacacaacacaacacaacaccgcgcctcaagcagagagccgcagcagcagcatataatgctggatgccatggacgcggcgagcatcatagggtacttcaagggcaagagcatcctcgtcaccggcgcaactgggtttcttggaaagatccttgtggagaagataatgcgcgtgcagcctgatgtccacaagatctaccttcttgtgcgagcgatcgatgagccatctgcaaagcaacgcgtccagcaagaggtgatagacgcggagctgtttgacctcctgagagagaaacatggcaagggcttccagcagttcgtggaggagaaggtggttgcattggccggagacatcatctacgagaacctgggcctggagacacccatgctggaggcgcttgccaaggagatcgacgtcatcgtcaacattgcagcaaccaccaacttctacggaaggtatgatgttttcttggatgtgaacgtgatgg

SEQ ID NO: 28111 - protein, 142 aa, Panicum virgatum
  misc_feature: Ceres CLONE 1881963
  misc_feature (21)..(142): Pfam Name: NAD_binding_4 Pfam Description: Male sterility protein
  misc_feature: SWISSPROT Homolog: EC 1.2.1.31 L-aminoadipate-semialdehyde dehydrogenase
MLDAMDAASIIGYFKGKSILVTGATGFLGKILVEKIMRVQPDVHKIYLLVRAIDEPSAKQRVQQEVIDAELFDLLREKHGKGFQQFVEEKVVALAGDIIYENLGLETPMLEALAKEIDVIVNIAATTNFYGRYDVFLDVNVM

SEQ ID NO: 28112 - DNA, 677 bp, Panicum virgatum
  misc_feature: Ceres CLONE 1881975-R
  misc_feature: Encodes the peptide sequence at SEQ ID NO. 28113
ccagatctggccatagacccccttggaatattacgccctccaagcaagttgaaccatcagcttcctctggtcagtgcatattcttcttttgcaagaatggtaggtgttggctacgatttagagcaccagcggagaaggatggacccagcaacaaatgaaccgctcttcacaaattgcacaagagatttcactgggactgtcgattacatattttacacagcggattcattgacagtggagtcgttattggaacttctggatgaggaaagcttaagaaaagacacagctctcccttcacctgagtggtcatcagatcacattgcgctcttggccgagttccggtgcaagcctagaatcagacggtgatatgctaggtctttaacaaaaggttaacttcagcatccttggtggtggaacagtcttccatggtggaagttgtggcttggcggaacgcaggccctcggggaagcaagcagtcttaggaagcggcctcaggattgggaaggaggcttgtaactttgattttaccccccttacatttctctcagctcatgatatttaagctgcccctgtgtaccattactttctatagaagaaaatacttgagagaaacatttaacagccacagcttgtaagcctttttttcctcctttttttcttaaactttgatctccttc

SEQ ID NO: 28113 - protein, 121 aa, Panicum virgatum
  misc_feature: Ceres CLONE 1881975-R
  misc_feature: SWISSPROT Homolog: EC 3.1.13.4 Poly(A)-specific ribonuclease
PDLAIDPLGILRPPSKLNHQLPLVSAYSSFARMVGVGYDLEHQRRRMDPATNEPLFTNCTRDFTGTVDYIFYTADSLTVESLLELLDEESLRKDTALPSPEWSSDHIALLAEFRCKPRIRR

SEQ ID NO: 28114 - DNA, 1159 bp, Panicum virgatum
  misc_feature: Ceres CLONE 1881975
acgaaaccccccaaaattccaacgcgaaccccacgaaaccgaaaccccaaagtccacgcgcgacgcgagcaggcagccaggaagagagagaaaacagatagggcgaagagcgagacggaaggagggagggagaaacagggagcaaaacccaaacccaaacaatcatttccaggccccgcctcgcgtctccagaacgttccggaaccttcgagggaccttccgcaggggcaggcgccgagcgcgggtgtttggatcgggggaggcaacgctggcggcgcccggcggcggcaggtgatggcggatccgcctggcggtgggggatctagggcttgcgtctgcagggggagacaggtcgaggcggcggcggcggcggggctggggctcgggagaagagagcaggggagggagggaggatgctgagcgtggttcgggtgcacctgccgtcggagatcccgatcgtgggctgcgaaatcacgccctatgtgctgctgcggcggcctgacggtgcagtctccaccgacgacgtgcccgaaaccgcgcccaccgatggccagttcatgcggtacagatggtatcgcatacagagcgatcggaaaattcctatctgcagtgtacatccaatggaacaagcaacaattcagtgcctcggttgtctcaagtcaaaaatacctgttactaagagctaccactgttcagctaaatgcttctctgatgcatggcagcaccacaaggttttgcatgagcgagctagtagtgctttaaatgaaaatggagctgaagaagaggagttatttggtagatttggctgtggtggttctggagttctaagtactgctgggtctggttcattgtcaaattttggacagagccctagtgttagtaatgggcctgtgcctttgtatccctcgggcactgataagaactctggagagacttggtttgaagttggacgttcgcggacatatacaccgtcagctgatgatattgggcatgcactaaaatttgagtgtgtagctgtggattcagaaagaaggtctccagtggggcctccgacttcaattatgacatcacgtgtaatccctgcaccaactcccaccccacgtcgccttatccaagtgaacggagatgttttaggtcacttggattttgacagccaaac

SEQ ID NO: 28115 - DNA, 1690 bp, Panicum virgatum
  misc_feature: Ceres CLONE 1881981
  misc_feature: Encodes the peptide sequence at SEQ ID NO. 28116
aagtctttgcgccacgacgaggttgatcggtgcttttgattctgctccttgtcgctgcagaggtcagagagagaagcagaggaggaggaggaggaggagcggcggcaatggcggtgaccgcgcggcggctccgcgcagtcgtggcgtgcgtcgtcctggcggtggcggcggcgttggcgccgcggccggcggcgggcatcctcgacccgaacgacttcctggcgctgcagacggtgcggcggtcgctggacgacatgccggggtcggcgttcttcgacggctgggacttcaccgccgacccctgcgggttccccggcgtgttctgcgacggggaccgggtggcgtcgctcgcgctcggggacccgcgggccgggtcgccggggctgatggggcgcctcgacccggcgctgggcaggctgtccgcgctcaccgagctctcgctcgtgccggggcgcgtcgagggccagctcccggcgtcgctcgcgtcctgctccaacctccgcttcctggccgtcagcaagaacctcctctcgggccagataccggacggcttcggcgcgctgtccaacctccggacgctcgacctcagcttcaaccagatctccggcgccatcccgccgtccatcgccgcgctgccgtcgatcaccaacctcatcctctgccacaaccagctcaccggcggcgtgccgtcgttccaggactcgtccacgctgctccggctggacctcaagcacaacgcgctcgccggcggcgtgcccgccctcccggccgggctgcagtacctctcgctgtccgcgaacaggctgagcggcacggtggagcaggtgctgccccggctgacccggctcaacttcctagacctcagcatgaaccagctggagggcccgatcccgccggcggtgttcgcgttgccgctctccgtgctgcagctgcagcgcaacttcttcgcggggcccgtgcagccggcgggcgacgtgacgatcccggtggtgaacctgagctacaaccggttttggggccaggtgtcgccgctgctggccggcgtcgggcagctgtacctgaacaacaaccggttcaccggcgaggtcccgtcgcggctggtgcaggagctggtgggctccggcgggctgcaggtgctctacctgcagcacaacttcctgacgggcatcgagatatcgccgtcgtcgtcgctcccctccaccgtctcgctctgcctcatgtacaactgcatggtgccgccggtgtacgcgccgtgcccgatcaaggccgggtcgcagaacacgcggccagcggaccagtgcccggagtggaggggatgagcgccgagctccaggctgatcgtgcctcagcaatgccaatgccggatcgcctcgaattatcggtcggaaactgaagaactgatgaagaacagtggatggagattgcaaagcggtggtctctgattctttgattaatttgtccagttgttacttgtgttcttaattctttttttttctggattgggcggatagttacagacaagtgcctcaataatcgggtgttacaggtgtagtaagtttttgtttaggtgtactccgatgtgcattgtgtcttcccccttctgctgtatagtgagctagctactgtcacactggctcctgatgctgttggatcagacgatggatggtgatgagagccggtgacgctattt

SEQ ID NO: 28116 - protein, 403 aa, Panicum virgatum
  misc_feature: Ceres CLONE 1881981
  misc_feature (33)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MAVTARRLRAVVACVVLAVAAALAPRPAAGILDPNDFLALQTVRRSLDDMPGSAFFDGWDFTADPCGFPGVFCDGDRVASLALGDPRAGSPGLMGRLDPALGRLSALTELSLVPGRVEGQLPASLASCSNLRFLAVSKNLLSGQIPDGFGALSNLRTLDLSFNQISGAIPPSIAALPSITNLILCHNQLTGGVPSFQDSSTLLRLDLKHNALAGGVPALPAGLQYLSLSANRLSGTVEQVLPRLTRLNFLDLSMNQLEGPIPPAVFALPLSVLQLQRNFFAGPVQPAGDVTIPVVNLSYNRFWGQVSPLLAGVGQLYLNNNRFTGEVPSRLVQELVGSGGLQVLYLQHNFLTGIEISPSSSLPSTVSLCLMYNCMVPPVYAPCPIKAGSQNTRPADQCPEWRG

SEQ ID NO: 28117 - DNA, 711 bp, Panicum virgatum
  misc_feature: Ceres CLONE 1881982
  misc_feature: Encodes the peptide sequence at SEQ ID NO. 28118
atgccttcgcggcccccttcccctgccactagcccactactactagttgccttgctcgcttcccacccctctcctctctctcaccccagcctcgcttccgcctcccctccccctcttcccttccctttccttccccactcccacttcccaaccctggatccaaatcccaagctatcccagaaccgaaaccgaggcgcgcaagcaattattagctggctagctaggagcgtacagtagctccgagatcatgaagcgcgagtaccaagacgccggcgggagcggcggcgacatgggctcctccaaggacaagatgatggcggcggcggcgggggagcaggatgaggaggtggacgagttgctggccgcgctcgggtacaaggtgcgctcgtccgacatggcggacgtcgcgcagaagctggagcagctcgagatggccatgggaatgggctgcgtgggcggcgccgccacagccgtcgatgacgggtttgtctcgcacctcgccacggacacagtgcactacaacccctccgacctgtcgtcctgggtcgagagcatgctgtccgagctcaacgcgccgccgccgccgctccccacagcgccgccggctccgcggctcgcgtccacctcgtccaccgtcacgggtggcgccgccgccggtggagggtactttgatctcccgcccgccgtcgactcgtccagcagcacgtacgc

SEQ ID NO: 28118 - protein, 154 aa, Panicum virgatum
  misc_feature: Ceres CLONE 1881982
  misc_feature: The sequence is a functional homolog of SEQ ID NO 1 in US patent 7268272
MKREYQDAGGSGGDMGSSKDKMMAAAAGEQDEEVDELLAALGYKVRSSDMADVAQKLEQLEMAMGMGCVGGAATAVDDGFVSHLATDTVHYNPSDLSSWVESMLSELNAPPPPLPTAPPAPRLASTSSTVTGGAAAGGGYFDLPPAVDSSSSTY

SEQ ID NO: 28119 - DNA, 641 bp, Panicum virgatum
  misc_feature: Ceres CLONE 1882005
  misc_feature: Encodes the peptide sequence at SEQ ID NO. 28120
gtgcctctgaactgaagccacgctctgctgcatcatcctgtccgtgtccccggccaccggcggcggaggagcagagcagcaagcaagcggcggcgaggcggccatggaggaggagcagcttcaggcgctgctccgcgacctcgacgcgctcaagcagcgccccgacgacccggcctccatcgatcggatgcgggagcgggtagtggcgatgatgaacccggccgccggcgccgcttcgcgatccaagatcaaggacatgagcgcggaggtggtggacagcaacccctacagcaggctaatggcgctgcagcggatgggggtcgtggagaattatgagcgcatcagggactactcggtcgccatcgttggcataggtggtgttggtagtgttgctgcagagatgctcacaaggtgtggaatcggacgtctcttgttgtatgactatgacacagtcgagttggctaacatgaataggttgttctttcgtccagaacaggttggaatgacaaaaacagatgctgctgtacagacgctttctggaataaaccctgatgttgtgttggaaagctactcactgaatattactacagtcaaaggatttgaaacatttttggcaagcctaaaagccaggagctctcatg

SEQ ID NO: 28120 - protein, 179 aa, Panicum virgatum
  misc_feature: Ceres CLONE 1882005
  misc_feature (81)..(179): Pfam Name: ThiF Pfam Description: ThiF family
  misc_feature: Functional homolog of the protein sequence given in SEQ ID NO 51270
  misc_feature: Useful for making plants with modulated oxidative stress sensitivity
MEEEQLQALLRDLDALKQRPDDPASIDRMRERVVAMMNPAAGAASRSKIKDMSAEVVDSNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFETFLASLKARSSH

SEQ ID NO: 28121 - DNA, 1975 bp, Panicum virgatum
  misc_feature: Ceres CLONE 1882011
  misc_feature: Encodes the peptide sequence at SEQ ID NO. 28122
ggcgccagacgcccagacctggccaccccgattccccggaccacccaccctcccgctccctccaatcgcggcgtccccactccccccgcgcgggcctcctaaccctagtcctcgtcccgccccccatggcggcctgagctgccgccgtacggatcgcgcgggagatgcagggcggtgtcgcggctgctgccgctgctgcggcggcggccgcggctacggtgaccacggcggtggcgcctccagtggccccggccccggcccctgcggccgcgacggcgcacgccgcggtgggcaacggcggggcgcccgccgcgccgccgccgcccttcctcatgaagacctacgagatggtcgacgacccggccacggacgacgtcgtgtcctggggccccgggaacaacagcttcatcgtctggaacacgcccgagttcgccagggacctcctgcccaagtacttcaagcacagcaacttctcctccttcgtcaggcagctcaacacatatgggtttagaaaggttgatccagacagatgggaatttgcaaatgagggttttctgagaggacaaaaacatctattgaagactatcaacagaaggaaaccatcgttgcaggggaacagccagccgcagcagccccaattgcagaacgctcctttgccagcctgtgtagaggtcggtaaatttgggctggaggaagagatagaacggctgaaaagggataagaatgttcttatgcaagagcttgtcaggctgagacagcaacagcagacaactgaccatcagctgcagactttggggaagcgtcttcaagggatggagtcacggcagcaacagatgatgtctttcctggccaaagcaatgcaaagtcctggtttcttagcacagtttgtacagcaaaatgagaacagcaggaggagaacagtagccgtgaacaagaagaggaggctacccaagcaagatgatggcctagactctgaaaatgcttctgcttcattggacggtcaaattgtcaagtatcagcctatgatcaacgaagctgccaaagcaatgctgaggaagatcctaaagctagatgcttcacatagatttgaatctgtgggcaattcagataattttctactggagaattatatgccagccgctcaaggttttgacagctcttcatcgaccagaaattctggtgtcacccttgcagaggttccagctaattcaggtttgccatatgcggctgcaagctctgggctttcagctatttgttcatctttagtggctcctgaaatacagtgtccagttgttatggacaacacctcatccaaccaagttcccaacatgagtgttgtgcctcctgtttcaaagcctatagcgccaggtagtgatatcactattccggaattcccagatctggctgacatagtacctgatgactctgatattcctggaggacccttcgggatgcctggccctgagtttcccctggcggaagagggtgatgacagtgtccccatcgagactgatgagattttgtacaacgatgagactcggaagctgccagccattgtggattccttctgggagcagttcctggttggcagccctctatctgttgataacgatgaagttgattcaggtgtactagatacaagggagacaccacaggagaatggatggaacaaagtggagcacgtggctaaccttacggaacagatgggccttctatcaccaaatcacagggggtgagatgtattatcctaaggtaggctggtaataagctttgacagcgttgcctacccttttgttaatgtttaagattgtccttattgctgaaatgatatgctgatatatcaaccactcaacctatatgcggggggattcaatgttccatccatgaatgatcttggtacgccccaggaattcacctgcttgtatctaggtttggcaggcttgagaacagaacaatggtaacttgtcaaatctgc

SEQ ID NO: 28122 - protein, 523 aa, Panicum virgatum
  misc_feature: Ceres CLONE 1882011
  misc_feature (53)..(228): Pfam Name: HSF_DNA-bind Pfam Description: HSF-type DNA-binding
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 142 in the 10/666,642 US patent application
  misc_feature: Functional homolog of the protein sequence given in SEQ ID NO 51271
  misc_feature: Useful for making plants with modulated heat sensitivity
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1418 in the 10/666,642 US patent application
  misc_feature: Functional homolog of the protein sequence given in SEQ ID NO 50697
  misc_feature: Useful for making plants with modulated biomass
  misc_feature: The sequence is a functional homolog of SEQ ID NO 1686 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1685 in the 10/412,699 US patent application
  misc_feature: The sequence is a functional homolog of SEQ ID NO 1688 in the 10/412,699 US patent application
  misc_feature: Functional homolog of the protein sequence given in SEQ ID NO 50452
  misc_feature: Useful for making plants with altered carbohydrate content
MQGGVAAAAAAAAAAAATVTTAVAPPVAPAPAPAAATAHAAVGNGGAPAAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPLPACVEVGKFGLEEEIERLKRDKNVLMQELVRLRQQQQTTDHQLQTLGKRLQGMESRQQQMMSFLAKAMQSPGFLAQFVQQNENSRRRTVAVNKKRRLPKQDDGLDSENASASLDGQIVKYQPMINEAAKAMLRKILKLDASHRFESVGNSDNFLLENYMPAAQGFDSSSSTRNSGVTLAEVPANSGLPYAAASSGLSAICSSLVAPEIQCPVVMDNTSSNQVPNMSVVPPVSKPIAPGSDITIPEFPDLADIVPDDSDIPGGPFGMPGPEFPLAEEGDDSVPIETDEILYNDETRKLPAIVDSFWEQFLVGSPLSVDNDEVDSGVLDTRETPQENGWNKVEHVANLTEQMGLLSPNHRG

SEQ ID NO: 28123 - DNA, 158 bp, Panicum virgatum
  misc_feature: Ceres CLONE 1882016
  misc_feature: Encodes the peptide sequence at SEQ ID NO. 28124
atccatccagaacccaaatccatcaagcaactacgcctgccaccaccaccggaagcacggccacgacgcgctgctccgcatgctcgcgggcttcgcgctcgcctcctgcctcctggtggtggccccggggcagccccttcttctccggcaccatggaa

SEQ ID NO: 28124 - protein, 52 aa, Panicum virgatum
  misc_feature: Ceres CLONE 1882016
  misc_feature: Functional homolog of the protein sequence given in SEQ ID NO 50484
  misc_feature: Useful for making plants with altered carbohydrate content
SIQNPNPSSNYACHHHRKHGHDALLRMLAGFALASCLLVVAPGQPLLLRHHG

SEQ ID NO: 28125 - DNA, 1475 bp, Panicum virgatum
  misc_feature: Ceres CLONE 1882028
  misc_feature: Encodes the peptide sequence at SEQ ID NO. 28126
aaaaactcccgccgaaacgcgcccccttcgtccccagctttacccccaaatccaaacccacccgccccgccgccgccacaattcccgcgcccactcctcccctactctctacctcttccggcctcgcgctccgtctccgaagcggcagccagcgatggacgtcaacgaggaggccatggcggcgcacaagcgcgccttcctcgacttcctcgaccaagacgtggggaagggggtgtacatgcaggccgtgcgcgacatggtccagaacaagcgccaccgcctcatcatcggcatggacgacctccgaaatcacaacctcgacctcacccgcagggtgatacggagcccaggggagtacatgcagccggcgtcggacgcggtgtcggaggtggccaggaatctggatcccaagttcttgaaggaaggggagcgcgtgatggtgggcttctcggggcccttcggcttccacagggtcacgcccagggatctcatgtcctctttcatcgggaccatggtctgcgtcgagggcatcgtcaccaaatgctctctggtaaggccaaaagttgttaagagtgttcacttctgccctgtgactggagagtttctctcgcgggaatacagggacatcacttcttttgtaggcttgcctactggctcagtttatccaacaagggatgacaacggtaacttgttggtcactgagtatggaatgtgtgaatacaaggatcaccagacattgtccatgcaagaggtgccagaaaattctgcacctggacagctcccaagaactgtcgatgttattgtggaagatgatcttgtagattgttgcaaaccaggtgatcgtgtctcaattgttggtgtatacaaggctcttccagggaaaagcaagggaagtgttagtggtgtgttcagaactgtccttatcgctaataatgtgtcgcttcttaacaaagaggcaaatgcacctgtctatactcgagaagatctgaagcggatgaaagaaatatcaaggagaaatgacacctttgacctgctgggaaactcacttgctccatccatatatggtcacctttggataaagaaggcggtagtactattgatgctcggtggtgttgagaagaatctgaaaaatggaactcacttaagaggagatataaacatgatgatggtgggagatccttctgttgcgaagtcccagctcctaagagctgtcatgaacattgcccctttggctatctcaacaactggtaggggttcatctggtgttggtttgactgctgcagtgacttctgatcaagagactggggagagaaggcttgaggctggtgccatggttcttgctgatcgtggtgttgtctgcattgatgagtttgatcaaatgaatgatcaagatcgagttgctattcatgaagttatggagcagcaaactgtaaccattgcaaaggcaggaattcatgcctcactgaatgcaagat

SEQ ID NO: 28126 - protein, 440 aa, Panicum virgatum
  misc_feature: Ceres CLONE 1882028
  misc_feature (277)..(440): Pfam Name: MCM Pfam Description: MCM2/3/5 family
MDVNEEAMAAHKRAFLDFLDQDVGKGVYMQAVRDMVQNKRHRLIIGMDDLRNHNLDLTRRVIRSPGEYMQPASDAVSEVARNLDPKFLKEGERVMVGFSGPFGFHRVTPRDLMSSFIGTMVCVEGIVTKCSLVRPKVVKSVHFCPVTGEFLSREYRDITSFVGLPTGSVYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDQMNDQDRVAIHEVMEQQTVTIAKAGIHASLNAR

SEQ ID NO: 28127 - DNA, 752 bp, Panicum virgatum
  misc_feature: Ceres CLONE 1882028-R
atgaggcatctgaccatattgctacttcatatgctgagctcagggatggtagcgcaaatgcaaagtctggtggtggtacacttccaatcacggcaaggacattggaaaccataattcgtctgtctactgctcatgccaagatgaagttgagacatgaggttctgaaatctgatgttgaggctgcattgcaagttctaaattttgcaatataccataaggaattgactgagatggaagagcgtgaacaaagggaaatggagatgaaacagcaagccgatcatgatgcaggtgcaaatgatggcactgcagatgggaatggaagctctggaaacaatccaatggatgtggatgtaggaaacacatcaaatgatcaggatattcctgcagagagaattgaagcatttgaagcaattctaggtcagcatgtgttggcaaaccatgtagatcaaatgtcaattgatgacatcgagcagacagttaatagagagtcagctgcaccttacaccagacgtcaagtagaatttatcttggagaggatgcaagatgcaaacaggataatgatacgtgatggcatagttcggatcatataaccaagattgtttaacagtgaactcaatgatcaagctgtgtcatggtgacctaatcgtgtaaaacttatccagattgtctggatccagctgatgctctgcatctgtaaccagctattagttgaagtatttgtttcttaatattaatcaccaaggattgagatc

SEQ ID NO: 28128 - DNA, 225 bp, Panicum virgatum
  misc_feature: Ceres CLONE 1882044
  misc_feature: Encodes the peptide sequence at SEQ ID NO. 28129
tcttctgccctgctactagctgcatccaggcgcctatagctgctagttatcaacaaagaacaatcaaccatggcgtctagcaggcctctcatcagcagcagcacgtcgatgaccatgggcattgctgcgctcgtcttcatctcggcggccgcttccggcgccatggctgctgggctgcagatggatttctaccgcagcacctggccgcagggggaacccagatgc

SEQ ID NO: 28129 - protein, 51 aa, Panicum virgatum
  misc_feature: Ceres CLONE 1882044
  misc_feature: Functional homolog of the protein sequence given in SEQ ID NO 51272
  misc_feature: Useful for making plants with altered carbohydrate content
MASSRPLISSSTSMTMGIAALVFISAAASGAMAAGLQMDFYRSTWPQGEPR

SEQ ID NO: 28130 - DNA, 957 bp, Panicum virgatum
  misc_feature: Ceres CLONE 1882045
  misc_feature: Encodes the peptide sequence at SEQ ID NO. 28131
agccaacacctcacggaccacccccgcactcctcctgcacgctgcacaccacctcacctcgcgccggcgaggagcgagggaggacactggacacggcgctccggcgctcgctggtacaccaataatcgagcgcgcagagaggacagaggccggcacacaggacgacacgcccgataaacaactagcgccgaacggccgcagccaaactgacacaacgcctcgctcacgcctccgatagagaaccagccaccatgagcaccgacgcggccgccgccgccgccgtcccggccgccgtggcgccggcgaagcgcgcgcccatcaacaagtacgcctgcgcctgcgccctgctcgcctccatgaactccgtcctcctcggctatgacatctcggtgatgagcggcgcgcagctgttcatgaaggaggacctcaagatcacggacacgcagatcgagatcctggccggcgtcatcagcatctactcgctcttcggctcgctcgccgccggcctcaccgccgactggctcggccgccgctacaccatggtgctcgcggccgccatcttcttcacgggcgcgctcctcatgggcctcgccccggactacgcgctgctcatggtcggccgcttcgtcgccggcatcggcgtcggcttcgcgctcatgatcgcgcccgtctacaccgccgaggtcgcgcccacctcggcgcgcgggttcctcacctccttcccggaggtgttcaacaacttcggcatcctcctcggctacgtctccaacttcgccttcgcgcgcctccccgtccacctcagctggcgcgccatgttcctggtcggcgccgtgccgcccgtcttcctgggcgtcgccgtcctcgccatgccggagtcgccccggtggctcgtcatgcggggccgcatcgacgacgcgcgccgcgtcctgctgaagacctccgactcgcccgccgagg

SEQ ID NO: 28131 - protein, 235 aa, Panicum virgatum
  misc_feature: Ceres CLONE 1882045
  misc_feature (30)..(235): Pfam Name: Sugar_tr Pfam Description: Sugar (and other) transporter
MSTDAAAAAAVPAAVAPAKRAPINKYACACALLASMNSVLLGYDISVMSGAQLFMKEDLKITDTQIEILAGVISIYSLFGSLAAGLTADWLGRRYTMVLAAAIFFTGALLMGLAPDYALLMVGRFVAGIGVGFALMIAPVYTAEVAPTSARGFLTSFPEVFNNFGILLGYVSNFAFARLPVHLSWRAMFLVGAVPPVFLGVAVLAMPESPRWLVMRGRIDDARRVLLKTSDSPAE

SEQ ID NO: 28132 - DNA, 656 bp, Panicum virgatum
  misc_feature: Ceres CLONE 1882045-R
caccatcgcggggagcttctacctctacgcctgcgtcgcggcggccgggtgggtgttcatgtacttgttcctgccggagacgatgggcaagagcctggaggacaccgtgaagctcttcggcaaggacgcggacgacgaggacgccgccgccgtggccgcacgccccgagcgcaagaagtcatccaccgagttcagtgctcagtaaagcgcccctgcatgcaccacgtgcccgtacacacatgtcgtccccagtgtggccggagctttcccgtaaagcttcgatgagtactccagtatttaagtacttttttttttgtctttgctgtgtacagttcgtgtaaaaatactatcaacaagagaagaattcgaggttaaggcaggcgacctagagtgagcttttgctgattgaggacttacgttccgaacatcatgtttttttgccaagttgtgtagatgcatatatacgtggaatagatacagctcatgatatgaacctttgctgtcagagttgtatcttgatttgttttggtttcagtaatttagtgtaaagagtcatcatcgggagttattgttaaaatgctaggtcaggcttgcttggataatgctggtgagttaaaagggatcaattcaagcaggagctagcaagcttggagttt

SEQ ID NO: 28133 - DNA, 1266 bp, Panicum virgatum
  misc_feature: Ceres CLONE 1882058
  misc_feature: Encodes the peptide sequence at SEQ ID NO. 28134
gtcccgagctgtcctcgtcgctgcgtactttggataactggacttcttccctcccgcgaccgtttcccaaccctccctcccgcgagctgcctcgctcattaactcacccctcctctcgagtccctttgccgcaactgtttacactgtcgacgctgcaccaacagaaatcttttccctttcaatatgtagagagagacgcagagggaaggtgtgaaaggttgggacagagagaaggtgagagatactccatgcgcaaaccgcgccagtagacagcagcagagaggagagagacaaggcggtgctgccgcaggtatacatacgggctggagagcaaggggagtagtgcagagagagggtcgcacagcagcagttcttcctcacagtgagagtctcaggttgcagctgtaagtagaaggttctggaagcttctagcaggagcgaggcgccatgggcaacgtgtgcttctgcggcaccacctccacctcccccgatcagcctgaggaagcatctgccaaagcgccgccaccgggagctgccaccaagaggccggcgacgcctccgagcagccaggggaccagccaagagccgagcccgagcccgagggcgcagccgaagccgaggcccaaggctaagcccaagcccaacccgtacgaatgggcgccgccgcgcggcggggcgacggcggcgcgcgtgctggacggcgtggtgccgcaccacccgcgcctgcgcgtgacggacaagtaccacctgggccgggagctggggcgcggcgagttcggcgtcacgcggctcgccacggaccgcgcgacgcgggagcggctggcgtgcaagtccatcccgaagcggcgcctccgcacggcggtggacgtggcggacgtccggcgggaggtggccatcatggcgtcgctgcccgaccacccggcgctggtgcgcctccgggcggcctacgaggacgccgaggccgtgcacctggtgatggagctctgcgacggcggggagctgttcgaccggatcgtggcgcgcgggaggtacacggagcgcgccgcggcggcggcggcgaggacggtggcggaggtggtgcgggcgtgccacgcgcacggggtgatgcaccgggacctcaagcctgagaacttcctgtacgccggcaagagcgaggacgcgcagctcaaggccatcgacttcggcctctccgtcttcttcaaaccaggcgagcagttcacggagatcgtgggcagcccgtactacatggcgccggaggtgctccgg

SEQ ID NO: 28134 - protein, 272 aa, Panicum virgatum
  misc_feature: Ceres CLONE 1882058
  misc_feature (99)..(272): Pfam Name: Pkinase Pfam Description: Protein kinase domain
  misc_feature: SWISSPROT Homolog: EC 2.7.11.1 Non-specific serine/threonine protein kinase
MGNVCFCGTTSTSPDQPEEASAKAPPPGAATKRPATPPSSQGTSQEPSPSPRAQPKPRPKAKPKPNPYEWAPPRGGATAARVLDGVVPHHPRLRVTDKYHLGRELGRGEFGVTRLATDRATRERLACKSIPKRRLRTAVDVADVRREVAIMASLPDHPALVRLRAAYEDAEAVHLVMELCDGGELFDRIVARGRYTERAAAAAARTVAEVVRACHAHGVMHRDLKPENFLYAGKSEDAQLKAIDFGLSVFFKPGEQFTEIVGSPYYMAPEVL

SEQ ID NO: 28135 - DNA, 498 bp, Panicum virgatum
  misc_feature: Ceres CLONE 1882058-R
  misc_feature: Encodes the peptide sequence at SEQ ID NO. 28136
tcgacaaggacagcagcggctacatcgagcgcgccgagctggccgacgctctcgccgatgagagcggccacaccgacgaggccgcgctcaacaacgtcctccgggaagtcgacaccgacaaggacgggcggatcagcttcgacgagttcgtggcgatgatgaaggccgggacggactggaggaaggcgtcgcggcagtactcgcgggagcggttcaagacgctgagcaacagcctcatgaaggacggctcgctcggcatggcgcgctgagggaggtcgacgacgacgctcggaaatcgatgcgatgcttggtttttttggatgcatacagcatcaatttgcttgatggttacatatatggctgcctgtctgtatatttgttgaaggatatctgaatctttggtagggttaagctggaggttttcagatggttgtgtatgaacttttgtgctggctgtaattacgtagtagtaccgtgcaaaggaatcgtaggcacccc

SEQ ID NO: 28136 - protein, 88 aa, Panicum virgatum
  misc_feature: Ceres CLONE 1882058-R
  misc_feature (28)..(56): Pfam Name: efhand Pfam Description: EF hand
  misc_feature: SWISSPROT Homolog: EC 2.7.11.1 Non-specific serine/threonine protein kinase
DKDSSGYIERAELADALADESGHTDEAALNNVLREVDTDKDGRISFDEFVAMMKAGTDWRKASRQYSRERFKTLSNSLMKDGSLGMAR

SEQ ID NO: 28137 - DNA, 609 bp, Panicum virgatum
  misc_feature: Ceres CLONE 1882070
  misc_feature: Encodes the peptide sequence at SEQ ID NO. 28138
accgcatcgaccgggacggtctctccaaacgctggctactagcctcctctcatcctgatctcccagccctccctccctccaagcagtctctccgatccttgcgcccgcagccagccatgaggccgggcggcggcggaggagacccgcagggcggcgacggggcgacgcagcggaccgcggcggccgggcaggccatggtggagctgcaggccaacgcgtcggcggcggcgggcggcgccgccatggtggtggggctcagcccgctcagcgagacgctgtggcgggacagcaaggcgctcccgccgggcgccggccccgccgcgctcatcgcggacgtgtcggccaggctcacgtggaaggacctctgcgtcaccgtggcgctgggccccggcaagacgcagacggtgctggacgagctcaccggctacgccgagcccggctcgctcaccgctctcatggggccctcggggtccggcaagtccacgctcctcgacgccctcgcgggccgcctcgccaccaacgccttcctctccggcaacgtgctcctcaacggccgcaaggccaagctctccttcggcgccgcggtacatgctgactgatctgcccatt

SEQ ID NO: 28138 - protein, 160 aa, Panicum virgatum
  misc_feature: Ceres CLONE 1882070
  misc_feature: SWISSPROT Homolog: EC 3.6.3.28 Phosphonate-transporting ATPase
MRPGGGGGDPQGGDGATQRTAAAGQAMVELQANASAAAGGAAMVVGLSPLSETLWRDSKALPPGAGPAALIADVSARLTWKDLCVTVALGPGKTQTVLDELTGYAEPGSLTALMGPSGSGKSTLLDALAGRLATNAFLSGNVLLNGRKAKLSFGAAVHAD

SEQ ID NO: 28139 - DNA, 1224 bp, Panicum virgatum
  misc_feature: Ceres CLONE 1882084
  misc_feature: Encodes the peptide sequence at SEQ ID NO. 28140
gcgatctccgcgcaggcagctagcccggcaggcaggccctcacccaccgcccctcctctcggcctccgtgctccctcgccgaacccaccccgggctcaaccgcagccgaagcaacgctgggcgctccctcccctccctcctcggctcctccccagatccggcgctgccgccacgctccgctccgctgccctgcctgcccccctcctcacctgcgcgatctgatgcgcccccacgcggtcgccagcggcgatgcggtggaagcttaactcgtcggtgtacaagcgcgtgccgtccagggaggccgccatggagcccgacgtcgagacgccgatgagggcgacgacggacgctgtcgcgggcccgtcgtggcgcatgtcgctgccgcacgtctgcgtcgccacgctcacctcgttcctcttcggataccactccggggtggtcaacgagcccctggagagcatctctgccgacctcggcttctccggcaacacactcgctgaaggactcgtggtgagcatctgcttgggcggagcctttattgggtgcttgttcagcggctccgtcgctgatgggatcgggcgccgccgggcgttccagctcagtgcactgcccatgatcattggtgctgccataagtgctctcaccaatagtttggagggtatgcttctaggaagatttttggttggaacagggatgggcttgggcccaccagtagcttcattatacataacggagatttctcctcctacagtgaggggtacatatggcagctttgttcagattgcgacctgtcttggaatcattgtagcactcctaattggtacacctgttaaagatattgatagatggtggagagtatgtttctgggttgcagctataccagcaactttacaagctcttgctatggagttctgtgccgagagcccccagtggctatataagtgtggaagaacaattgaagcagagatgcaattcgaaaagcttctaggcccccttcatgtaaattcagtcatggcagaactttctagatctgaaagagatgatggagaaagtgtaaagtactcagaattgttttatggtcgccacttcaatgttgtttttattggcgcggtgctctttgctttacaacagttatctggcataaattctgtgttctatttctcctcaactgtgttcagaggtgtggggatgcctgctaaccttgccaacataagcatggggatt

SEQ ID NO: 28140 - protein, 324 aa, Panicum virgatum
  misc_feature: Ceres CLONE 1882084
  misc_feature (46)..(324): Pfam Name: Sugar_tr Pfam Description: Sugar (and other) transporter
MRWKLNSSVYKRVPSREAAMEPDVETPMRATTDAVAGPSWRMSLPHVCVATLTSFLFGYHSGVVNEPLESISADLGFSGNTLAEGLVVSICLGGAFIGCLFSGSVADGIGRRRAFQLSALPMIIGAAISALTNSLEGMLLGRFLVGTGMGLGPPVASLYITEISPPTVRGTYGSFVQIATCLGIIVALLIGTPVKDIDRWWRVCFWVAAIPATLQALAMEFCAESPQWLYKCGRTIEAEMQFEKLLGPLHVNSVMAELSRSERDDGESVKYSELFYGRHFNVVFIGAVLFALQQLSGINSVFYFSSTVFRGVGMPANLANISMG

SEQ ID NO: 28141 - DNA, 695 bp, Panicum virgatum
  misc_feature: Ceres CLONE 1882084-R
cattaggagcaggcccagttcctggacttcttttgcctgagattttccccaataaaattcgagcgaaggctgtggctctctgcatgtctgtgcattggattgtaaacttctttgttagtctgctgttcttgcgtcttctggagcaacttggtccacaggttctgtacacaatattttcatcagtctgtgtgatagcttcaatatttgtgcggcgccatgtccttgaaacaaagggaaagacattgcaagagatagaagtttcactcctacaagcacaataaaggttctatctgggtggtacagattcggcgttgattggagtctgacatgacactgcttgctgaataccaaccagctgctctggtatcctgctcgctgattcctgaatcaagtcgtctcttgagaatggcgatgccctacaatggtcccagggaagttacagacatgcgcctgcgactgctagggcatcccagtttctacgtggacatgtactgaggttgtgcctgtatagcctgccctagttataggataccatgtattttctttttctatttatacaaatacgtgttgatgtaccagtgagaagatactacagctgggctgttgatgagcacagttagaacgaggaacatctcatgatttgcattatacgttcggacgaataattaagaacaccgcacggcatgcgttgttgg

SEQ ID NO: 28142 - DNA, 2844 bp, Panicum virgatum
  misc_feature: Ceres CLONE 1882085
  misc_feature: Encodes the peptide sequence at SEQ ID NO. 28143
ccctccgtcttactggttttcttcctccccgccccggtggccgccgatttgggggaagcccggccgtttcgccacccaaaaacccggctcgcgcccggatggaggcgcgggacggggagggcgcggcggcgggggccggggaggaggaggaggtggtgcagatcggcgcgcagaagcacgacccggcgtggaagcactgccttatggtgcgcgccgacggccgggtgcgcctcaagtgcgcctactgcggcaagcacttcctcggcggcggcatccaccgcttcaaggagcacctggcccgccgccccgggaacgcctgctgctgccccatggtgccccgcgacgtccaggacaccatgctccgcagcctcgacgccgtcgccgccaagaagatgcagcgcaagctcgccaacgccctcccgcccggcgacatgaggcgcttcgcccccgccgacgccgccaccggggggaccgacagccccgtccacatgatcccgctcaacgaggtgctcgacttcgaacccgagccgctcgaacaacagaggactcccgttccggagaccatgaggggcagtgccagcaataagaagaggaagatgatgactaacgcctccactccacagctggcgcttactccccagactcagcagcagcagcatgttccgcctactcctcagaccaatccacttcatcaggttgtgatggaactcgacacagttacgccagcatcaggacatttcggacacgctggcttggacaaggagcaggtttccgtggcagttgggaggttcttgtatgatgccggtgtgccattggaagcagtgaattcagtctacttccagcccatgctcgaggccattgcattagcaggagcgaggcctgaggcgccctcataccatggctttcgtggtcacattcttaaaaagtcactggatgatgtgatggctaggttggagttcttcaaggggtcatggaccaggaccggctgctcagtgctggctgatgagtgggtcactgataaaggcagaaccttgataaacttttcggtatattgcccggaaggtactatgttcctcaaatcggtggatgcaaccagcattgtcgcatcttcagatgcactgtacgagttactgaaaagtattgttgaggaagttggcgagaaaaaggttgtccaagtaatcacaaacaactccgaggtccatgcagctgcaggaaaaaagctaggcgaaacatttcccacattattctggtctccatgctctttccagtgcatcgatggcatgctggaagatttcagcaaggtaggggcaatcggtgagataataagtagtgcaaaagtcatcacggggtttgtctacaacagctcatttgcgttgaatctaatgaagaagtatttgcaaggcaaggatctgctagttcctgcggatactcgtgctgccatgaactttgtcacactgaagaacatgtacagtttgaaggaggctttgcaagccatagtcaactcagatgagtggatacactttgtgctgccaaacaaaggagggatcgaagcaaccaatcttgttaacaacttgcaattttggtcctcttgtgctgccgttgttcacatcaccgaaccactcgtgcatctccttaagctagtcggtagtatcaagaggcctgctatggggtacatttatgctggattgtagcaggccaaagcagcaatcaagaaagagctagtgagtaagaacgactacatggcttattggaatattatcgactggagatgggacaaccaaacaccacggccacttcattcagctggtttcttcctgaatccactattttttgatggaattcgaggtgatgtatcaaatgtaatcttctcagggatgctagactgcatagaaaggctggtttctgatgtgaaaatccaagataaaatccagcgagagctcaacatgtaccggaatgagactgcaggggattttcgtaggcaaatggccgtccgttctagacgaactttacctcctgctgaatggtggtatacatatggaggagcttgcccaaatttaacacgtctaggggtccgtattctcagtcagacctgcagtgcgagaggatgtgatcggggtcacattcattttgaacaagttcatgatgaaagaatgaatagttttgagcgtcagcgaatgcgtgatctcacctttgttcaatacaacctacggctgcagcaaaggcaacaacgcaaggtgaaaacatttgatcctgtctcagtggaccatatagacatagttgatgactgggttctggatagacctgcactgttctctggcctagctgagcagccaaactggatggagattaatcaatcagtcacacgaatcacagcaagggaaccaaatgaagatgaatttgagtccttcattgaaggagttgatgacgaaatgatccaaggtgctgcccaggggatcgaggaagatgacgatgatcctgcttgtggctgacgctatagatgaactagccagctaacctgtaagctaaaatctggcattgcctgttctgattctccatgtaggaccgtatgtcacttgctctgtattttgtttcttcagatatctttcctatgttttcccaagtccactgttctaaacgcatacagccattatagagtttggggttctcgtgccacaaccttttcccaggttaagcaagttaatgtcttttagatccttagcgaaggtgacgctttgggttctgattcttcacagaaatgagtttaccatattattagttcttttgagttttattaactgttgatctgaagagatacctacaatcgattgtggcttatcaactgtc

SEQ ID NO: 28143 - protein, 530 aa, Panicum virgatum
  misc_feature: Ceres CLONE 1882085
  misc_feature (28)..(84): Pfam Name: zf-C2HC_plant Pfam Description: Protein of unknown function, DUF1544
MEARDGEGAAAGAGEEEEVVQIGAQKHDPAWKHCLMVRADGRVRLKCAYCGKHFLGGGIHRFKEHLARRPGNACCCPMVPRDVQDTMLRSLDAVAAKKMQRKLANALPPGDMRRFAPADAATGGTDSPVHMIPLNEVLDFEPEPLEQQRTPVPETMRGSASNKKRKMMTNASTPQLALTPQTQQQQHVPPTPQTNPLHQVVMELDTVTPASGHFGHAGLDKEQVSVAVGRFLYDAGVPLEAVNSVYFQPMLEAIALAGARPEAPSYHGFRGHILKKSLDDVMARLEFFKGSWTRTGCSVLADEWVTDKGRTLINFSVYCPEGTMFLKSVDATSIVASSDALYELLKSIVEEVGEKKVVQVITNNSEVHAAAGKKLGETFPTLFWSPCSFQCIDGMLEDFSKVGAIGEIISSAKVITGFVYNSSFALNLMKKYLQGKDLLVPADTRAAMNFVTLKNMYSLKEALQAIVNSDEWIHFVLPNKGGIEATNLVNNLQFWSSCAAVVHITEPLVHLLKLVGSIKRPAMGYIYAGL

SEQ ID NO: 28144 - DNA, 1360 bp, Panicum virgatum
  misc_feature: Ceres CLONE 1882093
  misc_feature: Encodes the peptide sequence at SEQ ID NO. 28145
gccacccgcattcccctctcttcgcagctcggctcgtctccgaagagggaggaggaagccagctgccacggcacccgctcccgcgctacccgccgccgccaccatgctctccgcgcaggccgccgccgccgtcacttcaccggcttccctgtggaagcgagtaggagggagcgagggcgggagccgcagctgcgacggatgcaggacctacagggagtccttgcggaggcgggccgcggcggtgcgggtgcgcgctacagggccggggcaggtggaggccgtcgcgatgggctccgccgcggagaccgagaaggagcagcaggagaaggaggtggccgcggccggcggcggggtcgaggacccctacggcgaggacagggccaccgaggagctgcccgtcacgccctgggcctactccgtcgcgagcggttacacccttttgagggatccacatcacaacaaaggtctttccttcactgagaaggagagggatgcacactacttgcgtggccttctgcctccggcagttgtgtctcaggaactccaaattaagaagatcatgcacaacctgcggcagtaccagctccctttacagcgctatatggccatgatggaccttcaggagagaaatgagcggcttttctacaagcttttaattgataatgtggaggagctgctccctgtagtttacacaccaactgttggtgaggcctgccagaagtatggttgcatctttagacaaccacagggcctgtatgtcaccctgagggacaaggggaaggtcctggaggttctaaggaactggccccagaggaacattcaagttattgttgttactgatggtgagcgaatcttgggacttggagatttgggttctcagggaatgggaattcctgtaggcaaacttgctctctacactgcccttggaggagttcgcccatcagcttgtttgcctatcacaattgatgttggcacgaacaacgaggaactgcttaatgatgagttctatattggactccggcagaaacgtgcaactggcaaggagtatcatgaacttatggaagaattcatgagtgctgtgaaacaaatctatggtgagaaagttctcattcagtttgaggactttgccaatcataatgcttttgatttacttgcaaaatatagcaagagccatcttgttttcaatgatgatatccagggcacagcatcggtggtccttgcaggtttgttagcggcacttaaggtggttggtgggaccctagcagagcacacatatttgttccttggcgctggggaggctggaactggcatagcagaactcattgctctcgagatttcaagacagacaaaagctccgatt

SEQ ID NO: 28145 - protein, 418 aa, Panicum virgatum
  misc_feature: Ceres CLONE 1882093
  misc_feature (173)..(362): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MLSAQAAAAVTSPASLWKRVGGSEGGSRSCDGCRTYRESLRRRAAAVRVRATGPGQVEAVAMGSAAETEKEQQEKEVAAAGGGVEDPYGEDRATEELPVTPWAYSVASGYTLLRDPHHNKGLSFTEKERDAHYLRGLLPPAVVSQELQIKKIMHNLRQYQLPLQRYMAMMDLQERNERLFYKLLIDNVEELLPVVYTPTVGEACQKYGCIFRQPQGLYVTLRDKGKVLEVLRNWPQRNIQVIVVTDGERILGLGDLGSQGMGIPVGKLALYTALGGVRPSACLPITIDVGTNNEELLNDEFYIGLRQKRATGKEYHELMEEFMSAVKQIYGEKVLIQFEDFANHNAFDLLAKYSKSHLVFNDDIQGTASVVLAGLLAALKVVGGTLAEHTYLFLGAGEAGTGIAELIALEISRQTKAP

SEQ ID NO: 28146 - DNA, 571 bp, Panicum virgatum
  misc_feature: Ceres CLONE 1882093-R
  misc_feature: Encodes the peptide sequence at SEQ ID NO. 28147
cagggccgtgctgtatttgccagtggtagtccatttgcccctgtggagtacaatgggcaaacttttgtacctgggcagtcaaacaatgcttacattttccctgggtttggccttggtctggttatctctggagccatccgtgtccacgaggacatgcttcttgctgcctcggaagcactagctgatcaggccactcaggagaattttgacaagggatcaatcttcccacctttcaccaacatcagaaagatctccgctcgcatcgctgctgcggtggctgaaaaagcctatgagctcggtttggcgacccgtctacctcctcccagagatctggtgaaatatgcagagagctgcatgtacacacctgtctaccgcaactaccggtagtgatgcggggttcaattttgcagtaataaaaacctatcaatgcagggtactgcaatgttgttgttccgccggatgtgtatgttgttcgctgtcaccgcagctaccacccttgtttactcgttgctggtgctgctgggagacactgtacctgtctatgcatatatgatatggtgtaacattatcg

SEQ ID NO: 28147 - protein, 128 aa, Panicum virgatum
  misc_feature: Ceres CLONE 1882093-R
  misc_feature (1)..(97): Pfam Name: Malic_M Pfam Description: Malic enzyme, NAD binding domain
  misc_feature: SWISSPROT Homolog: EC 1.1.1.40 Malate dehydrogenase (oxaloacetate-decarboxylating) (NADP(+))
QGRAVFASGSPFAPVEYNGQTFVPGQSNNAYIFPGFGLGLVISGAIRVHEDMLLAASEALADQATQENFDKGSIFPPFTNIRKISARIAAAVAEKAYELGLATRLPPPRDLVKYAESCMYTPVYRNYR

SEQ ID NO: 28148 - DNA, 676 bp, Panicum virgatum
  misc_feature: Ceres CLONE 1882098
  misc_feature: Encodes the peptide sequence at SEQ ID NO. 28149
atccccccccccccccccgcgcagccaagccagagccgtccggagtccacgaggacagcgtcgtcctccactcctcctcctccgccgccgccgccgccgccgccggccgcagcagaacagaggagccggcgcgcgctccgtccgggcggagcgcacgagcgcgggtccagggagcgaggggggatcggggcggcggctctcggcttccctgctgcgcgggatggcgggccgcaacgatgtcgggatcctcgccatggacatctacttcccgcccacctgcgtgcagcaggaggcgcttgaggcccatgacggcgtgagcaaagggaagtacaccatcggccttgggcaagattgcatggccttttgcagcgaggtggaggatgtcatctcaatgagtttgaccgttgtccattccctcctaaaaaagtacaacattgatccaaagcttattggtcgcttggaggttggaagtgagacggttatagacaaaagtaaatccatcaaaacttgggtgatgcaaatttttgagaaaagtggcaatactgacattgaaggagttgactccagcaatgcttgttatggtggaactgctgccctgctgaattgcgtgaattgggttgaaagtaactcctgggatggacgctatggtcttgtcgtttgcacagacagcgcggtt

SEQ ID NO: 28149 - protein, 151 aa, Panicum virgatum
  misc_feature: Ceres CLONE 1882098
  misc_feature (5)..(151): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MAGRNDVGILAMDIYFPPTCVQQEALEAHDGVSKGKYTIGLGQDCMAFCSEVEDVISMSLTVVHSLLKKYNIDPKLIGRLEVGSETVIDKSKSIKTWVMQIFEKSGNTDIEGVDSSNACYGGTAALLNCVNWVESNSWDGRYGLVVCTDSA

SEQ ID NO: 28150 - DNA, 714 bp, Panicum virgatum
  misc_feature: Ceres CLONE 1882099
  misc_feature: Encodes the peptide sequence at SEQ ID NO. 28151
cccgtcccgagtccgtcggcctcaacgactagttgagcgctccgccgccggggctccggcgaggggaggaggcttattggcgcaactgtaagctacgctgcagcagccgccgcgggtgctcgggaggggccgcgggcgggagtctgcgattctggacgccccgccgcggcgagatccgagggcgcgcggcttctgtacgggggttttgaggtctcgttggagctgctgctgtgaggttgggaggaggggcggccatggcggggtccaggttcggctcgttcaagtcggagaagggcgactcggccgcctccgcggcggcggccgcggatggggcggcgcagaggagggacccgtacgaggtgctcggggtgggccgcaccgccaccgaccaggagatcaagagcgccttccgacgcatggcgctcaagtaccatccggacaagaatggggatgaccctgtcgcatctgataggttccaagaagtcacattctcctacaacatcctatcggatcctgataagaggcggcagtacgatacatcaggatttgaggcaattgaaaacgatagtcaggagttggagctggacttatcgagtctcaatactgtaaacactgtgtttgcagctctttttagtaagcttggtgtgccaattaaaacaactgtttcagcaacagttttggaggaggcattgaatagctctgttatggtttctc

SEQ ID NO: 28151 - protein, 153 aa, Panicum virgatum
  misc_feature: Ceres CLONE 1882099
  misc_feature (32)..(94): Pfam Name: DnaJ Pfam Description: DnaJ domain
MAGSRFGSFKSEKGDSAASAAAAADGAAQRRDPYEVLGVGRTATDQEIKSAFRRMALKYHPDKNGDDPVASDRFQEVTFSYNILSDPDKRRQYDTSGFEAIENDSQELELDLSSLNTVNTVFAALFSKLGVPIKTTVSATVLEEALNSSVMVS

SEQ ID NO: 28152 - DNA, 699 bp, Panicum virgatum
  misc_feature: Ceres CLONE 1882105
  misc_feature: Encodes the peptide sequence at SEQ ID NO. 28153
gaaaagcttgggttgagagcgctcgcgcgaaaccagccgaaagggctcgagaagcagcagccagattcccaagccactctccccccccccccccactctgggggtctctgaattttcctccctcgcggggattttccccgggattcattccttgcgcggggggggacgggggggctcacgaggggaaaaaaaagatccgattttcccctgtggagatctcttccgatttccactatcttgagaagcctgcgcgcgggcgggcagcctcgccgcgggagtttttttggggtttttcctcggccagaattatccattccctggagataaagggggagatcggggggggctaaacttttcatcttctccgcggggggggcgggggaattttttcttctccccgtcagtcgctgccgtatcgccggcggggcggcatggggctcggcttgggggggcacctggggcgcctgggggtgctgggctccacctcccaccacgcctcgggggggtgcatcaacctgtgcgtggggctgttctgcgcctgcgtcgtcctcggccacctcttcgaggagaaaaggtgggggaacgagaccatctccgcgctcatcatcggggtgtgcgccggggtgtggatactgttgacaacaaaggggaaaagatctcacatcctcgtcttcagcgaggacatcttctccatctacc

SEQ ID NO: 28153 - protein, 89 aa, Panicum virgatum
  misc_feature: Ceres CLONE 1882105
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 2 in US patent 7250560
  misc_feature: The sequence is a functional homolog of SEQ ID NO 4 in US patent 7250560
MGLGLGGHLGRLGVLGSTSHHASGGCINLCVGLFCACVVLGHLFEEKRWGNETISALIIGVCAGVWILLTTKGKRSHILVFSEDIFSIY

SEQ ID NO: 28154 - DNA, 368 bp, Panicum virgatum
  misc_feature: Ceres CLONE 1882107
  misc_feature: Encodes the peptide sequence at SEQ ID NO. 28155
gatagggagggagacactgacgagacgggcgagagactcggcggctggggtgggacgggaaccagccggtgtgaagagattgttatcacaggagagcagctctatctcaggaccgacctgccggccggcttgcctccgccccgccccagggaaacgtgtggccggaggcctccctctcgaacaaaaatcaaaaagaaaaaaagcaaatctacttctgctcccccgatgagcgcttctcggttcatcaagtgcgtcaccgtgggggacggcgccgtcggcaagacctgcatgcttatctcctacacctccaacactttccccaccgattatgttccaactgtgttccacaacctctgtgccaatgttgt

SEQ ID NO: 28155 - protein, 47 aa, Panicum virgatum
  misc_feature: Ceres CLONE 1882107
  misc_feature: Functional homolog of the protein sequence given in SEQ ID NO 50617
  misc_feature: Useful for making plants with modulated nitrogen use efficiency
MSASRFIKCVTVGDGAVGKTCMLISYTSNTFPTDYVPTVFHNLCANV

SEQ ID NO: 28156 - DNA, 705 bp, Panicum virgatum
  misc_feature: Ceres CLONE 1882143
  misc_feature: Encodes the peptide sequence at SEQ ID NO. 28157
gacgcggggacgcggacgcccggcccgagcgcacgcgcgaatcgccgtggacctcgccgggggcggcgacgagctaggatctcggcgatctagtcgccggaggcggcccccatggctcgccggtcgtcgtcctcgtcgtcgggggcgtggcggtacctcaaccccgcgtactacctcaagcggcccaagcgcctcgcgctcctcttcttcgtcttcgtcgcggccaccttcgccttctgggaccgccagtcgctcgtccgcgagtacgagtctgagatttccagattagaagatgatattaatcggttgcatgaccagctaagaaaggctggagtccatgtggatgaaaatccaagtaacgccagaaaagatcttgtagaaatcgatcctgtgaataatgaaaggagggaaaaagttaaggaggcaatgctccatgcttggaattcctatgtaaagtatgcctggggaatggatgagcttcagccacaatcaaagaatggcatcaatagctttggtggccttggagcaacccttgtggactcacttgatacactgtatatcatgggcctgaaagatgaatttcagaaagctagagactgggtggccgagtcattagactttgacaaggattatgatgcaagtgtttttgaaacgaccataagggtcgttggaggtctacttagtgcgtacgatctgtctggtgat

SEQ ID NO: 28157 - protein, 197 aa, Panicum virgatum
  misc_feature: Ceres CLONE 1882143
  misc_feature: SWISSPROT Homolog: EC 3.2.1.113 Mannosyl-oligosaccharide 1,2-alpha-mannosidase
MARRSSSSSSGAWRYLNPAYYLKRPKRLALLFFVFVAATFAFWDRQSLVREYESEISRLEDDINRLHDQLRKAGVHVDENPSNARKDLVEIDPVNNERREKVKEAMLHAWNSYVKYAWGMDELQPQSKNGINSFGGLGATLVDSLDTLYIMGLKDEFQKARDWVAESLDFDKDYDASVFETTIRVVGGLLSAYDLSG

SEQ ID NO: 28158 - DNA, 1052 bp, Panicum virgatum
  misc_feature: Ceres CLONE 1882149
  misc_feature: Encodes the peptide sequence at SEQ ID NO. 28159
ctctctctctctctttctactatcttctttcctcttctttgatcaccagggcggaccaccgctgatatagctccttcatccctaccctccatggcctcggcttgattcaagaagtatatgatcgccgcctgatcccaagaagtagtggatcattggctaggagtttttggagtccgtcctccattccatttgatcgctgtggtaggtgcaagcccgtgacctttttccattgcttgatctcctccaatgctgcaaaggaacctgccgaatctctccctccggataagcccgccagccgcctcgtcggccgctgcttgtgacgcaccggcgctggcgaagactccgtcgccagaaccaagcatggcgccgccgtacgctgaaggaagcggcgaggtagggttcttcgcaaaccctagccccggcgcggagcccccggggctcagcctggggctcggcacgccggcgctcggcggcgacgcggctggccgccgagaccacctcgagccgcagggatgcgcgttcaagcgcgcggccaccagcagggcctccctgccggcaggcggatcgaagcggagctcccgggcgccgcggatgcgctggaccaccgcgctccacgcgcgcttcgtgcacgccgttgagctcctcggcggccatgagagagcgactccgaagtcggtgctggagctgatgaacgtcaaggatctgacgctggcgcatgtcaagagccaccttcaggtgacaaacgaacggcctctaggtagcttggccgcaatggaagaaggacaggacacacatgatactttcaccgtgcatcgcgcatacgcgacacaacaaactaaccaggtcagcatgataactaataatctgttttaatttcctgcccttgatttgcagatgtataggacagtgaagagctcggacagatcgttacacatcgccacaggcgaggcgttgccgctgcagaggacggcgacagggatggaagcggcggcggcggcggcaggaggaggaggtggtggtgctgccgctggaggtgggtgggtagtggtacc

SEQ ID NO: 28159 - protein, 170 aa, Panicum virgatum
  misc_feature: Ceres CLONE 1882149
  misc_feature (77)..(128): Pfam Name: Myb_DNA-binding Pfam Description: Myb-like DNA-binding domain
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MAPPYAEGSGEVGFFANPSPGAEPPGLSLGLGTPALGGDAAGRRDHLEPQGCAFKRAATSRASLPAGGSKRSSRAPRMRWTTALHARFVHAVELLGGHERATPKSVLELMNVKDLTLAHVKSHLQVTNERPLGSLAAMEEGQDTHDTFTVHRAYATQQTNQVSMITNNLF

SEQ ID NO: 28160 - DNA, 533 bp, Panicum virgatum
  misc_feature: Ceres CLONE 1882149-R
attcccccgaggactgaccacgcaccaggagtgctggagaaaggtgctgcgattgttgttgactcagtgcacgggtgtcagagacataatttctcaccaccagtgcttcatgatactcagcattatcaggaagcacaagaagaggcgaaccgtcacctggttatggggctgcacggaggtgccgaagcggtcgctacaaactgctcgagccccgcgagctcttcttctccgtcccttgcaagcgtggagctggtggcagacgacatgtacgcaccgaacctggagatctccctcgggaggccggattggggcatggagcgtccggaagaacttagcctgaaatacctgtgacacaggaacaagggacttcccttttggttccgctcagctaacaaccgaccattgatggatcaacaaaccactggatcagtctgttcatcaagtaattaagcgcatggatttggtatttggcatggaatgaaatctataaaaagttgcgagtgcatggtttaatttgaactcttttggaagcg

SEQ ID NO: 28161 - DNA, 2295 bp, Panicum virgatum
  misc_feature: Ceres CLONE 1882152
  misc_feature: Encodes the peptide sequence at SEQ ID NO. 28162
gtgcgtctctttcacagcagtcggctccggatctgaggagggtctctctcacactcaagagcctggacggaccatggcaggaggaagatccagctcgatgccggaaagagattgatcccaggagcggcatctccatcggacaggaaacagaatagcactataggagagaactttctagtgctccggatccatggtcaagggcacccacgggggcaaagtgaaggatggtgcaggagctgctgcctccagcagtgatgtggcggcagaggcatccaccagcacggctgctatggctgaaacctcaagaacagcagcggcacggcgacaacctccaagcggtgtggtgaggagagggcgtcaatctccgtcggctttgtctgtcgctgtgtttctatcgaagaaggggaaacttgtgcgaaaaaaggcaggggcaggcccgtcgagctctcggagagttcccaacgtaagtggacttaataggctggggagcgtgttagctgatccatgtgtacaaccatacagatttacactagcaaagttgagagagatcacacatgatttctctgatgagcaactacttggcgaaggcgctttcggcaaggtgtataagggagtcctacaaaacggggatacaattgctgtgaagaggctgaaattgacaacagaagtaactcaggataagcaatacgagaatgaagcccgccatctgatgaagcttaaacacccaaatatagtgcaacttgtaggctactgttctgaaacaaagaagaaacttgtgcgacacaataggatatacatttccgctcagaagtttgaaaggttgctttgtttggagtacctgcctaaaggaaaccttcgtgggcatctttcagatgaatcttctggacttgactggagcacccgctacaaaattattgagggaatttgctatggtttacattatcttcatgaggggtggcaagttacccctataattcacatggacctgaaacctgaaaacataatgcttgatggtaatttggtgccaaaaattgctgatttcggtttgtccaggctcttcggtgaagagcaaactcgaacatgcactagcaattgtaagggaacacggggttacatggctccggaatacatagacaagggtataatcacaaaaaagttagacctattcagcttgggggtgataatcatagaaataatgacggggagcaaggactaccctcttgatgagaccgaaacatcatcccagcaatatattgagcttgtgcttaacaaatggagacatagacccagaaaagcaccagggtatacatctggagatattgattatgaacaaataaaatggtgcattcagattggtctactctgtgtgaaaaaagatgaggcgaaaaggccaacaatacaacaaattatcaagatgcttgatggaacagaaggtgcagaagcagaatgcatcgacgaaagaaaggagcagaaattcaggctagggaagcagccacacaaggagttcaacgatcactcagttaaggatgctgcggcgacggagatgcaacgaaacgcagcctcttcttcgggcatagtgggaagaatcatgaaggagtaagtttatttcataatatactagtactccacagtactgtatgcagaattcctctatgcacacactccatcctaattaactttctcagctaaaacaaatttaagtctttctctctcatatattggcccctctgctttcactttcccttttgtgaatcttagttccagccgtcgtcgtcacatgaaggaggctatcagaatgcaaatggaagtccagagaaggctacatgagcaactagaggagcaaaagccccgccggataaggcttgaagcctcggggaagtacctgcagtccatcctggagaaagcccaccaggctctcgcctcccgtgacgtacggacaacgcgcgacccctccttcccggtctgcattagcatgggtcgcttttaagatgacatcagcgatgatgcgagcacatttatttaaaactgcatatttagaatggctattgctctcttgtccggcatcaattttcaaattcgctttcaccattatattcgtcatgacgagctctacgaaacaagatcaatattgcatatgttttgtggttgttttatctatactaacatcttatgttgtatacctagtagcaacttgtgtacagatgggtgacaacttatttaagttaggtttcatagaatttatgtacacagatggcttgcaacttattcaactatatggtccgatctttgcatatt

SEQ ID NO: 28162 - protein, 469 aa, Panicum virgatum
  misc_feature: Ceres CLONE 1882152
  misc_feature (124)..(410): Pfam Name: Pkinase Pfam Description: Protein kinase domain
  misc_feature: SWISSPROT Homolog: EC 2.7.11.1 Non-specific serine/threonine protein kinase
MVKGTHGGKVKDGAGAAASSSDVAAEASTSTAAMAETSRTAAARRQPPSGVVRRGRQSPSALSVAVFLSKKGKLVRKKAGAGPSSSRRVPNVSGLNRLGSVLADPCVQPYRFTLAKLREITHDFSDEQLLGEGAFGKVYKGVLQNGDTIAVKRLKLTTEVTQDKQYENEARHLMKLKHPNIVQLVGYCSETKKKLVRHNRIYISAQKFERLLCLEYLPKGNLRGHLSDESSGLDWSTRYKIIEGICYGLHYLHEGWQVTPIIHMDLKPENIMLDGNLVPKIADFGLSRLFGEEQTRTCTSNCKGTRGYMAPEYIDKGIITKKLDLFSLGVIIIEIMTGSKDYPLDETETSSQQYIELVLNKWRHRPRKAPGYTSGDIDYEQIKWCIQIGLLCVKKDEAKRPTIQQIIKMLDGTEGAEAECIDERKEQKFRLGKQPHKEFNDHSVKDAAATEMQRNAASSSGIVGRIMKE

SEQ ID NO: 28163 - DNA, 2354 bp, Panicum virgatum
  misc_feature: Ceres CLONE 1882156
  misc_feature: Encodes the peptide sequence at SEQ ID NO. 28164
atctcttgccactgctcttcttccaccctcgccttttctcctacctgccccgcccgccgctcctccggttcccggcgacgcccgttgccgtctgcttctccccgagacggatcgacctctgcttcacccgaatcggcctacgcgcgcaggggatcgaggtcctgcgggctcctcagcgcgggggcgcctcgccgcctgagtcgagctcctcgctgccggacaaggcgcggggacggggatccaaggcaagggggccatgctggatggttgagaatgtcgtcgcagaaagccatgctgcagagcaccgcggaggccgccatacgctccatcggtctcggcttcgacgtcgtcagcgacatccgaatcaagtactgcaagcagcgcagctcccccgacccgtggctcatcgagctcgaccatgaggaggttcaggacatcgtgcttccaggcggcatcacggtttccggtgtcaccaagtcgattaagtgtgacaaaggggaacggatgaggttccgctccgacgtcctgtcattccagcagatgtcagagcaattcaaccaggagctatctttgtctgggaaaattccatctggcttgttcaataccatgtttgaatttactggcagctggcagaaagatgctgctaataccaagtcacttgcatttgatgggtggtatgtcacactatacagcgttgcactctcaaaagggcaaattgtactccgggatcatgttaaacaggctgttccgtcaacctgggaacctgccgccttggcaaggttcattaaaaaatttggcactcatatagttgttggtctaaagatgggcgggaaagatgtaatttatttgaaacaacagcattcatcaagcttgcaagctgctgatgttcaaaaacgattgaaggagatgtcagacagaagatttcttgatgcaaatgggcaatctgacatgagtttcaaggacaagtatgagaataataagaacgataccagagagcaacaactgagatttgtacagtccagtccattgaattcttactcgtcgaatgaggatctggtgatgatgcctaagcgaagaggtgggaaggataaagattttatttctcatagcgagtggcttaataccgtccaaacagagcctgatgttatctcaatgtcctttataccaattacttcactattgaatggagttcctggaagtggatttttgaaccatgccattaatctgtaccttcgacataaacccccaatcgaggaattgcatcagtttttagagttccagcttccaaggcagtgggcacctgtttacagtgatcttgctctgggtcctcagaggagaaggcaaagcagtacatctttaccagttaatataatcggtccaaagctttatgtttgtaccaacatggttgatgtgggtaaaagaccagttacaggactccgcttgttccttgaaggaaggaagaacaacaaattagctatacatctccagcatctctgctctcttccccagattattcagctagaagatgacccttacaatcaccaaactcaagaatatgaccgcaaatactacgaaccaattggaccatggaagcgtttctctcatgtctgtacagcaccagtggagtcagatgatttgtccattgtcacaggggcacagttggaagtggtcaaccatgggttcaagaaaatactgttccttcgcttgtgtttctccaaagcctgcaatgttgctctcgtcaagaactcggagtgggagaattctcccaacctggctcagaaatcaggtcttatctcaacactcattagcacacatttctcctcagtggctcaaaagcccccaccgcggccagccgatgtgaacatcaactcagcagtgttccctggcggtccacctgttccagtgcagaccccaaagctgctcaagtttgttgatccaacagagatgatgcgagggccgcaagactcaccaggctattgggtggttacaggagcaaagcttaaccttgagaggggtaagatatcattgcgagtgaaatactcactgttgacagctatgatgcctgatgacgagttttcacttgatgatgaatgctagcacctggaacaaaaagaaacctgtgtagctaacattgatgatataatcatacaaatgaaaggatctaagatttccatagcatttgtgcatcggattgaagttccagtggtatacactgtggtttttaaacatcatagcataaatgacttctctgtcctgaatgagtgagaaaatttgttgtatcatttctttgtggcgtgacatagttgtcagtgtagatgatagatcaaattattgtatatatgagatgggtcaag

SEQ ID NO: 28164 - protein, 607 aa, Panicum virgatum
  misc_feature: Ceres CLONE 1882156
  misc_feature (126)..(321): Pfam Name: MACPF Pfam Description: MAC/Perforin domain
MSSQKAMLQSTAEAAIRSIGLGFDVVSDIRIKYCKQRSSPDPWLIELDHEEVQDIVLPGGITVSGVTKSIKCDKGERMRFRSDVLSFQQMSEQFNQELSLSGKIPSGLFNTMFEFTGSWQKDAANTKSLAFDGWYVTLYSVALSKGQIVLRDHVKQAVPSTWEPAALARFIKKFGTHIVVGLKMGGKDVIYLKQQHSSSLQAADVQKRLKEMSDRRFLDANGQSDMSFKDKYENNKNDTREQQLRFVQSSPLNSYSSNEDLVMMPKRRGGKDKDFISHSEWLNTVQTEPDVISMSFIPITSLLNGVPGSGFLNHAINLYLRHKPPIEELHQFLEFQLPRQWAPVYSDLALGPQRRRQSSTSLPVNIIGPKLYVCTNMVDVGKRPVTGLRLFLEGRKNNKLAIHLQHLCSLPQIIQLEDDPYNHQTQEYDRKYYEPIGPWKRFSHVCTAPVESDDLSIVTGAQLEVVNHGFKKILFLRLCFSKACNVALVKNSEWENSPNLAQKSGLISTLISTHFSSVAQKPPPRPADVNINSAVFPGGPPVPVQTPKLLKFVDPTEMMRGPQDSPGYWVVTGAKLNLERGKISLRVKYSLLTAMMPDDEFSLDDEC

SEQ ID NO: 28165 - DNA, 2538 bp, Panicum virgatum
  misc_feature: Ceres CLONE 1882160
  misc_feature: Encodes the peptide sequence at SEQ ID NO. 28166
ttttcgtttttttgtttgttttttgtattttttcgccctgtctcgcacacgaacaggacgaacagcgccgccgtgttcttcgcaccgccgccgccccccgccgatcgaatccgcctcccgccgccggttctcccccgaatccttagtcctccgagcttctcaactacccggcctgcccgattcgccccctcgcgtcccgataccagtcgtcccccagctagggttttcgccgcggatttctagggttttgagcatggcctcgtcgatttggggctgtgacggacgctgagtgtagtcttgtctgcctgggggtgggaggagatgattaccgagaagccaagctggattcggcacgagggcctgcagatcttctccatcgacatccagcccggcggcctccgcttcgccaccggcggcggcgaccagaaggttcgaatatggagcatgacatctgtggacaaggacaatgccaacaatgattcaagccaaaggttgctagctacaatgcgtgaccattttggatcagtaaactgtgtgagatgggccaggcatggacgctatctggcttcaggatcagatgatcaggttatcctaattcatgagagaaaagctggttctggaacagctgagtttggtagtggagaacctgcagatctagaaaattggaaggttgttatgaccttaagagggcatactgcggacgtgtaggtagatcttaattggtcccctgatgattcaacgttggctagcggcagcttggataatactgttcatatatggaacatgaccaacggcatgtgcactgctgtcttgcgagggcattccagcttggtcaaaggggttacttgggatcctattggttcttttcttgcaagccaatcagatgataagactgttgtaatatggcgtacaagtgactggagtcttgctcacaagacagaaggccgttggacaaaatctcttggttcaacattttttaggcgactttcatggtcaccttgtggacactttattactacgactcacggcttccagaaacctaggcattcggcccctgtgcttgagagaggcgagtggtctgcaacttttgactttctagggcataatgcacctgttgtggtggttaagtttaataactcaatgttccgtaagaatttctcaaatgggcaagacacaaaggctttgccagctggatgggtcaatggagcatcaaagacatcaacaaaagaacagcaaccgtataacattattgctgttggaagtcaagacagaactgttactgtttggacgacagcaagtgcccggccattgtttgttgctaagcattttttctctcaaagtgtggttgatttatcttggagccctgatggttattcactttttgcatgctccttggatggatcggttgccaactttcactttgaagcaaaggagcttggatacaggttaagtgattctgaactagatgaattgaagaggagtagatatggtgatgtcagaggacggcaatcaaatctggttgaaagcccagcacagttactgcttgaagaagcatcagcaaagcaatcagctagcaaaaaagggacttccgttgttcagcaatttcaagcacccccaaaagttcctgcggatgtgcctaacccagctccagttgtgcaaagtcagaaagctcctgaagctttgcccgaagatgggaagaaaacatcaggttctgctgctggtgatgcaaataaagtttctcggttatctagtccagtgaagcagagagaataccggcgtcctgatggccggaaaaggataatcccagaggctgttggatttccttccaatcaggataacatacccaaccattctcagaatcaggttgtggatttttcatccttagatcagcgaatgaacggaataagaccatcttatggcagtagcggtaactgtaataactgtggagttaaggaccgctctggtgtgacagccagggtgaacattactgagagtcttgttattcaaaaagcttcaaccagtgcagggattgatggaaggctcagtgtagagcacactggcttggttgtcccaggctccttgacctgctctgtgctctctatccatgtatcaaataagaaagacaatgaggagtctttgctagtctgccttgaagcaaagcctgtagaacgcgctgcagctgatatgattggtgtcggtggtgccttttcaacaaaagaaactgagataaggtgtactagaggaacggaaactctttggtcggatcgtatctctggaaaggttactgtcttggcgggcaatgcaaatttctgggctgttggctgtgaagatggttgcctgcaggtttatacggaatgtggaagacgagcgatgcctgcgatgatgatgggatctgcagctgtttttatagattgtgacgactgctggaaattgcttcttgtcacaagaagaggtctaatttacatatgggacctctataacaggacctgcattttgcaggactctttggcttcattggttacatctccagatgagccg

SEQ ID NO: 28166 - protein, 128 aa, Panicum virgatum
  misc_feature: Ceres CLONE 1882160
  misc_feature (56)..(94): Pfam Name: WD40 Pfam Description: WD domain, G-beta repeat
MITEKPSWIRHEGLQIFSIDIQPGGLRFATGGGDQKVRIWSMTSVDKDNANNDSSQRLLATMRDHFGSVNCVRWARHGRYLASGSDDQVILIHERKAGSGTAEFGSGEPADLENWKVVMTLRGHTADV

SEQ ID NO: 28167 - DNA, 675 bp, Panicum virgatum
  misc_feature: Ceres CLONE 1882160-R
tccgatgggcatgtttagctctgcatcatctacggatcccaaaaaacccagagtgggatcctgatgttctcggaatgaagaagcacaaacttcttagggaagacatacttccttcgatggcatccaaccggaaagtccagcgattgctcaacgagttcgtggatcttctgtcagagtatgaagctgccgagactaaagctgacctaatggatgtcgcaccaacactgccaccagcaataacagaagccaaagctgaccagatggatgtcgcgccaacaccgcaaccggcaataacagaagccaaagctgaccagatggatgtcgcgccaacaccacaaccggcaataacagaagccaatgacaaagtgaccacctcgtaggcggccctggcatgctccagtccggttgctggagacttactgaccccccctcggtaagtatgataggatagtcttgttttgagaagtccttatatgaaccaatcaatttgttgtgcatgtagccggtacattgtttagcaagggaggcgacctcgggcgaacactgatttttgaaccccgttagctgtaacgctgagtgtaacagtagaaaaaggaagcgcgaggtcgcctggtgattgatgtgtaacagtaaaaatctgtacaaggcagggtaaactcatgtcctttctggttg

SEQ ID NO: 28168 - DNA, 1386 bp, Panicum virgatum
  misc_feature: Ceres CLONE 1882163
  misc_feature: Encodes the peptide sequence at SEQ ID NO. 28169
aggcgtgcagcacgcgatggcgcttccctggtggctggccaccacggcgtgcgcgccgccgtctggctccctcggcggctggctcccgttccttatcctctccccgtgcccgcagcgcgcgctcctcggcgccgtggacctcgtattcctcgctgcctccctcgtggtcgccgcccgccgcccacgcagcgtaaagtcgggggcggcggctgcacccgagcgcgagccgctcctgcaggaacggaagccttcgccgccgctcctccgccacgctctcgtgctcgcgctcgcggcctcggccgtgttcgcggcggcgtccgtcgtcctcctcgcgctcgcgctcgcgctcctgccgggcacgtcgtggcgcgccgtcaagctcgccttcctcgccgtccacgccgtcgcgcacggcgtggccgcgtggaccgcggcctctgcggtgagacgggcaggaggagatgctccggccgccgccgcgcctccggcacatctccgcgtgttctggctcgccaccgccgtcggcgccgcgctcttttccgcctcggcggcggtccgcagcgccgacgggtcgctggtcttcccagacgacgtcctcgccttcgcaggtttgctcgtctcgctgcctctggcgtacgtggcggtcaccggcttcaccggccgtgacgccggcgcgggagatggtgaatcggaccgcaacggcgcggaggcgctcgccgcgccgtacgctgcagcgtcgttcctgtcgcacgcggcgttcagctggatcaacccgctaatctccaaggggtacgaagccaagactctcgccgccgatgacgttcccggggtctctgccggccaccgcgccgaggcgtcgtacgctctcttcatgtccaactggccggcgcaggggtcgcggcatccggtggccgtcgcgctgtggctgtccttctggccgcagttcgtgctcaccgccgcgctgggcctcgcgaacatcgcggccatgtacgtcggcccgtcgctcatcgaccggttcgtcgagttcatccgccgcggcgggacgccatgggagggcctccggctcgtcctcatcctgctcgccggcaagacggtccagacgctggcgtcgcaccactacaacttccaggggcagctcctgggcatgcgcatccgtggcgcgctccagacggcgctgtaccgcaagtcgctgcgcctgtccaccggggcgcgccgcgcgcacggcaccggcgccatggtgaactacatgcaggtggacgcctcgacggtttcctccgccatgcacgggctccatggcctgtggcagatgccgctgcagatcgtggtggcgctcctcctcctctacacctacctcggcgtcgccgtgctgctgacgctcgccgtgat

SEQ ID NO: 28169 - protein, 456 aa, Panicum virgatum
  misc_feature: Ceres CLONE 1882163
  misc_feature: SWISSPROT Homolog: EC 3.6.3.44 Xenobiotic-transporting ATPase
MALPWWLATTACAPPSGSLGGWLPFLILSPCPQRALLGAVDLVFLAASLVVAARRPRSVKSGAAAAPEREPLLQERKPSPPLLRHALVLALAASAVFAAASVVLLALALALLPGTSWRAVKLAFLAVHAVAHGVAAWTAASAVRRAGGDAPAAAAPPAHLRVFWLATAVGAALFSASAAVRSADGSLVFPDDVLAFAGLLVSLPLAYVAVTGFTGRDAGAGDGESDRNGAEALAAPYAAASFLSHAAFSWINPLISKGYEAKTLAADDVPGVSAGHRAEASYALFMSNWPAQGSRHPVAVALWLSFWPQFVLTAALGLANIAAMYVGPSLIDRFVEFIRRGGTPWEGLRLVLILLAGKTVQTLASHHYNFQGQLLGMRIRGALQTALYRKSLRLSTGARRAHGTGAMVNYMQVDASTVSSAMHGLHGLWQMPLQIVVALLLLYTYLGVAVLLTLAV

SEQ ID NO: 28170 - DNA, 748 bp, Panicum virgatum
  misc_feature: Ceres CLONE 1882163-R
  misc_feature: Encodes the peptide sequence at SEQ ID NO. 28171
cacatccgcgtcatcaagctgcaggcctgggaggagacgtttggtggcagggtgcgcgagcgccggcaggacgagctggggtggctggtgaagttcacgctcttcctgtgtgccaacaacgtggtgttctcgagctgcccgctcgccatgaccgtgctcgtgttcgcgacgtacctcgcctccggaggggtgctggacgccggcaaggtgttcacggccacgtccttgttcggcatgctcaactccccaatgcgggacttcccgcagaccatagtctcgtccttgcaggcgttcgtgtcgctgggccggctcaacaacttcctttcggagacggagatcgacggcacggcggtagatcgcgtcgagagcgctgacgctggtcctgtggccgtgaaggtgcagggtggtgtgtttgcctgggacgtgccggtcagcgaggcaaacaacggcgagccgggccagggggaggaggcaaagatggagacggtgctcaaggggattcatgtggaagtcaggaagggtgagctcggggcggttgttgggatggtgggctccggaaagtcatcactgctgtcgtgcatcatgggagagatgcacaaactctcgggcaaggttagcatatatggaagcacagcatttgttgggcaaactgcttggatccgaaacggaaccattcaagagaacattttatttggaaatatgatgcacccagagagatattcagaagtcatacgtgcatgttgccttg

SEQ ID NO: 28171 - protein, 249 aa, Panicum virgatum
  misc_feature: Ceres CLONE 1882163-R
  misc_feature: SWISSPROT Homolog: EC 3.6.3.44 Xenobiotic-transporting ATPase
HIRVIKLQAWEETFGGRVRERRQDELGWLVKFTLFLCANNVVFSSCPLAMTVLVFATYLASGGVLDAGKVFTATSLFGMLNSPMRDFPQTIVSSLQAFVSLGRLNNFLSETEIDGTAVDRVESADAGPVAVKVQGGVFAWDVPVSEANNGEPGQGEEAKMETVLKGIHVEVRKGELGAVVGMVGSGKSSLLSCIMGEMHKLSGKVSIYGSTAFVGQTAWIRNGTIQENILFGNMMHPERYSEVIRACCL

SEQ ID NO: 28172 - DNA, 646 bp, Panicum virgatum
  misc_feature: Ceres CLONE 1882175
  misc_feature: Encodes the peptide sequence at SEQ ID NO. 28173
ttgaaattatttttgtgcaatgactacattccctctgctgagaaatcatctcgggggctccactaatttaggatgttcaaagtgtgcctttgaaacattagcatcacccacaaagacaataaaaaacatgttgactgtcccttgttcacctccatcacctgtcaatggaggttcagtcaagattgtgcaaatgacaccagtaacttctgccatgacaacagctaagtggcttcgcgaggtcatatcttcattgccagataaaccttcatctaagcttcagcagttgctgtcatcatgtgatagggatttgacaaatgatgtgacaaaaagggtcagcatagttttggaaccaattttccccacaaagtctgctgcagatcggggtggttcaataggcctcaattgtgcaaatgcatttgatgtcccttgggcacaagcaagaaaaatggaagcctccaagttgtactatagggtattggaggcaatctgcagagctgagtcacagaacagtagtgtaaataatctaactccattgctgtcaaacgagcgttttcaccgatgtttgattgcatgttcagctgagctagtattggcaacacatacgacactaatcatgatgtttcctgctgttctggagagaactggt

SEQ ID NO: 28173 - protein, 208 aa, Panicum virgatum
  misc_feature: Ceres CLONE 1882175
  misc_feature (59)..(208): Pfam Name: RB_A Pfam Description: Retinoblastoma-associated protein A domain
MTTFPLLRNHLGGSTNLGCSKCAFETLASPTKTIKNMLTVPCSPPSPVNGGSVKIVQMTPVTSAMTTAKWLREVISSLPDKPSSKLQQLLSSCDRDLTNDVTKRVSIVLEPIFPTKSAADRGGSIGLNCANAFDVPWAQARKMEASKLYYRVLEAICRAESQNSSVNNLTPLLSNERFHRCLIACSAELVLATHTTLIMMFPAVLERT

SEQ ID NO: 28174 - DNA, 703 bp, Panicum virgatum
  misc_feature: Ceres CLONE 1882176
  misc_feature: Encodes the peptide sequence at SEQ ID NO. 28175
gcattatagccgcatccctcctcctcctcctcctcctcctcctctcggtctgattcggagcgcgatcagcagcaagccaagatgcattccacgaatctcctgctcgaggagcccatccgcatggcctcaatcctcgagccatccaagaccagcttcttccccgcgatgacgaagatcgtggggacgctcgggcccaagtcgcgcaccgtcgacaccatctccgcctgcctcaaggccggcatgtccgttgcgcggttcgatttctcgtggggagacgccgcctaccaccaggagacgctcgagaacctcaagctcgccatcaaggccaccaagaagctatgcgccgtcatgcttgatactgtcggccccgagttgcaggtggttaacaagaatgaaaccccgatttccctcgaggagaatggcactgtggttctcacacctcatcaggggcaagaagcctcctccagcttgctgcccatcaacttctccggactcgccaaggctgtgacaccaggcgcaacaatatttgtgggacaatacttgttcactggcagtgagactacttcagtttggttggaggtttctgaagttcaaggagatgatgtggtctgtataatcaagaacacagctacattggctgggtcactgttcacactgcattgctcccagattcatattgacttgccaacgctatctgatgagg

SEQ ID NO: 28175 - protein, 207 aa, Panicum virgatum
  misc_feature: Ceres CLONE 1882176
  misc_feature (30)..(204): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRTVDTISACLKAGMSVARFDFSWGDAAYHQETLENLKLAIKATKKLCAVMLDTVGPELQVVNKNETPISLEENGTVVLTPHQGQEASSSLLPINFSGLAKAVTPGATIFVGQYLFTGSETTSVWLEVSEVQGDDVVCIIKNTATLAGSLFTLHCSQIHIDLPTLSDE

SEQ ID NO: 28176 - DNA, 647 bp, Panicum virgatum
  misc_feature: Ceres CLONE 1882183
  misc_feature: Encodes the peptide sequence at SEQ ID NO. 28177
agaccactactcgcaacactcacaagaggaaagagttcaccacttcacctcatcggctcgtccaaatcgccggcgccaatggagcccaatcccaatcccaccctgaccgtggtgctgcacgcctgcctcggcgtgggccacctgatcccgatggtggagctcgccaagctgttcctccgccgcggcctcgccgccgtcatcgccgtcccgaccccgccggcctccaccgccgacttcttcgcctcctcagcctccaccgtcgcggagctcgccgccgccaacccctccgtctccttccaccacctcccgcccccggactaccccgctccggacccggaccccttcctccagatgctcgacgcgctccgcctcacggcgcccgccctcgccgccttcctccgctccctcccctccgtcgccgcgctcgtactcgacctcttctgcgtcgacgcgctcgacgcggccgcatccatcggcgtcccggcctacttctactacacctcctgcgccggcgacctcgccgcgttcctccacctcccccactacttcgccgagacggacggcggcgctagcttcaaggacatgggcaaggcgctccttcacttccccggcgtcccgccgatcccggagtcggacatgccgcacac

SEQ ID NO: 28177 - protein, 189 aa, Panicum virgatum
  misc_feature: Ceres CLONE 1882183
  misc_feature: SWISSPROT Homolog: EC 2.4.1.218 Hydroquinone glucosyltransferase
MEPNPNPTLTVVLHACLGVGHLIPMVELAKLFLRRGLAAVIAVPTPPASTADFFASSASTVAELAAANPSVSFHHLPPPDYPAPDPDPFLQMLDALRLTAPALAAFLRSLPSVAALVLDLFCVDALDAAASIGVPAYFYYTSCAGDLAAFLHLPHYFAETDGGASFKDMGKALLHFPGVPPIPESDMPH

SEQ ID NO: 28178 - DNA, 684 bp, Panicum virgatum
  misc_feature: Ceres CLONE 1882212
  misc_feature: Encodes the peptide sequence at SEQ ID NO. 28179
caaagaaagaagaggtgattacctaggaaaaaccgtccaggttgtgccacatattacagatgaaatacaagattggattgaacgcgttgcaatgaatccagttgatggcaaagaaggaccacccgatgtttgtgtcattgaacttggcggcactataggggatattgagtcaatgcctttcattgaagcattaggtcaattttcatatcgtgttggacctggaaacttctgtttggttcatgtcagtcttgttcctgtcctaaatgtagttggtgaacagaaaacaaagcctacacaacatagtgttcgagggcttagaggacttgggttggcaccagatgttctagcatgtcgcagtactgagccattggaagagcatgtgaaagtcaagctctcacaattttgtcatgttccgatctcaaatattgtgaacctccatgacgtgacaaacatttggcacatccctttgttgctaagggaccagaaggcccatgaagccattctgaaagttttagagcttcagtatgctggaaaggtacctagggaacctaagttggcggagtggacagaaagggctaccaaatttgacaaactgaagactccggtcaatattgccatggttggaaaatatactgggctatcagattcgtacctgtctgttctaaaggctcttttgcatgcatc

SEQ ID NO: 28179 - protein, 227 aa, Panicum virgatum
  misc_feature: Ceres CLONE 1882212
  misc_feature (1)..(188): Pfam Name: CTP_synth_N Pfam Description: CTP synthase N-terminus
  misc_feature: SWISSPROT Homolog: EC 6.3.4.2 CTP synthase
KERRGDYLGKTVQVVPHITDEIQDWIERVAMNPVDGKEGPPDVCVIELGGTIGDIESMPFIEALGQFSYRVGPGNFCLVHVSLVPVLNVVGEQKTKPTQHSVRGLRGLGLAPDVLACRSTEPLEEHVKVKLSQFCHVPISNIVNLHDVTNIWHIPLLLRDQKAHEAILKVLELQYAGKVPREPKLAEWTERATKFDKLKTPVNIAMVGKYTGLSDSYLSVLKALLHA

SEQ ID NO: 28180 - DNA, 1345 bp, Panicum virgatum
  misc_feature: Ceres CLONE 1882238
  misc_feature: Encodes the peptide sequence at SEQ ID NO. 28181
atgggcccagacgacgaagcctcgtctctgccgtcggctgcgctgcgcctcctccacgcaactcggccaccgctcctaccctaccggcgaggtcgccgaagcctccgcctccgtctcctccaaagtctccactagtgctcgccggccccgccaatcggccacctgtatccccagacacaccgctccagatacaccggtgcacaggtgcccctgcacaggtgcgcagctgcctcgccggcccgccgccgcacgcctgctttcccttccttttagtataaccacctgcagctgcacccccgtgctctgctcagtgctcagcgctcgccaaccaactccccaaccaccggatcccaggcaaaagggagggatggccgccgagaccgtcgacggcagcgcgctcgcggggcgcgcgctggccgcggccggcgcccgccacatgttcagcgtcgtcggcatccccgtcacctccctcgcctcccgcgccgccgccgcgggggtccgcttcctcgccttccgcaacgagcagtccgcgggctacgccgccgccgcctacggcttcctcaccggctccccggggctcctcctcaccgtctccggccccggctgcgtccacggmctcgccggcctctcccacgccaccgccaacgcctggccgctcctcatgctctccggctcctgcgaccaggccgacgccggcaggggcgacttccaggagctcgaccagatcgccgccaccgagcccttcgccaagctcgcagtcaaggccaccaccatcgccgacatcccgcgcctcggctaccaggccctcgccgctgccgtctccggccgccccggcggctgctaccttgacatcccctccgacgtcctccaccagaccctccctcaatccgagggcgcggatctcatagcagcagcagcagccgagtcgggcgcttccaacccatccccgcccaaccagaagcccctagatgaagatgaggccatcgggaaagctgcggacctgctccggcgcgcggagcggcctcttgtcgtcattgggaagggtgccgcgtacgcacgcgcggaggaggccatccggaagctggtggacaccacgggcatcctcttcctgacgacgcccatggggaagggggtcgtgcctgactcgcacccgctctccgccacggcggcacgctcactcgccatcgggcagtgcgatgtggctctggtcgtcggtgcgaggcttaactggttgcttgacttcggcgagacgcccaagtggtccaaggatgtcaagttcatacttgtggatgtctgcgaggaggagattgagctccggataccgcatgtggggattgttgatgat

SEQ ID NO: 28181 - protein, 325 aa, Panicum virgatum
  misc_feature: Ceres CLONE 1882238
  misc_feature (6)..(175): Pfam Name: TPP_enzyme_N Pfam Description: Thiamine pyrophosphate enzyme, N-terminal TPP binding domain
  misc_feature (206)..(323): Pfam Name: TPP_enzyme_M Pfam Description: Thiamine pyrophosphate enzyme, central domain
  misc_feature: SWISSPROT Homolog: EC 4.1.1.8 Oxalyl-CoA decarboxylase
MAAETVDGSALAGRALAAAGARHMFSVVGIPVTSLASRAAAAGVRFLAFRNEQSAGYAAAAYGFLTGSPGLLLTVSGPGCVHGLAGLSHATANAWPLLMLSGSCDQADAGRGDFQELDQIAATEPFAKLAVKATTIADIPRLGYQALAAAVSGRPGGCYLDIPSDVLHQTLPQSEGADLIAAAAAESGASNPSPPNQKPLDEDEAIGKAADLLRRAERPLVVIGKGAAYARAEEAIRKLVDTTGILFLTTPMGKGVVPDSHPLSATAARSLAIGQCDVALVVGARLNWLLDFGETPKWSKDVKFILVDVCEEEIELRIPHVGIVD

SEQ ID NO: 28182 - DNA, 667 bp, Panicum virgatum
  misc_feature: Ceres CLONE 1882238-R
  misc_feature: Encodes the peptide sequence at SEQ ID NO. 28183
ccagttgcccgttgtagtaattgttttcaacaacaacggtgtctatggtggtgaccggagaagctctgatgagataactggacccttcaaagatgaccctgccccaacttcttttgtcccagcagcaggctaccacataatgatggaagcgtttggaggaaaaggttatcttgtggagacaccagacgagcttaaatctgccctttcggaatcattccgtgccaggaaaccagcagtcatcaattgtatcattgatccttacgcgggtgcagagagcggccggatgcagcacaagaactgagggtgtttgtaccataccatagcaagatgcagatgcgacttaataagcaatgccctccagcgtccagcccttttgtttttgacgactggttctttgttctgcgtaccgatgtgaggtgctctgtaaacttagctggacggttgaaactgaagcgggtattcacggaatttagcttcactcccccggtaaatatggtctatggatgctctcgtggatagtgttccatctttgatggcatgcacatgtattatgattatcctcaagccacgatgcaaatgtgaaactagtatcctctaaaagaacagtttgtaaactggtgtgtttttccttcttaaaatgaatgagtaataagttgcaacaggcttc

SEQ ID NO: 28183 - protein, 99 aa, Panicum virgatum
  misc_feature: Ceres CLONE 1882238-R
  misc_feature: SWISSPROT Homolog: EC 4.1.1.8 Oxalyl-CoA decarboxylase
QLPVVVIVFNNNGVYGGDRRSSDEITGPFKDDPAPTSFVPAAGYHIMMEAFGGKGYLVETPDELKSALSESFRARKPAVINCIIDPYAGAESGRMQHKN

SEQ ID NO: 28184 - DNA, 1366 bp, Panicum virgatum
  misc_feature: Ceres CLONE 1882239
  misc_feature: Encodes the peptide sequence at SEQ ID NO. 28185
agccgcttcgctcgcattctcccaccccggtctccccgctgccgcacgccgacccccaagaccgcgcgtccatcggggaggaggaggagccacgatggagtcggcggcggccgtgccgtgcgcggcgtgcggggacgacgcgtgcgccgcgtgccgcgcgtgcagctacgcgctctgcagggcctgcctcgacgaggacgccgccgagggacgcaccacgtgcgcgcgctgcggcggggagtacgccgccgcgaccgacccagcgcatcgcaacgaggtcgctgaagcggacgaggtggaggaccaccacgccggcggcggcctgcgtgagagggtcaccatgggcagccacctcaatgatcgccaggatgaagtaagccatggcaggaccatgagcagcttgtcgggaattggtagtgaactgaatgatgaatctggaaaacccatctggaagaacagggtggagagttggaaggagaagaagaacgagaaaaaagcctcagccaaaaaggctgcagcaaaagcacaggcaccacctgttgaagaacagatcatggatgaaaaggatttgacagatgcgtatgaaccgctctcccggatcatcccaatatcaaagaacaagcttacaccttacagagcggtcatcattatgcgtttgatagytcttgggctcttctttcactaccgtatcaccaatcctgtttacagtgcctttggtctctggatgacatcagtcatatgtgagatctggtttggtttctcctggatcttggatcaattccccaagtggtaccctattaatcgagagacttatgttgataggctgattgcaagatacggagatggtgaagattctggattggcacctgtggatttctttgtcagtacagtggatccattgaaagagcctccactgatcacttcaaacactgtattgtctattcttgctgtggactatcctgttgagaagatctcatgctatgtatctgatgatggttctgctatgctcacatttgaatcacttgccgagactgctgaatttgctagaaaatgggtaccattttgcaagaagtatgcgattgagccacgagctcctgagttctatttctcgcagaagattgactacttgaaggacaagatacacccgtcttttgtcaaggagcgtagggctatgaagagagactatgaagaatacaaggtgaggataaatgctttggtcgccaaggctcagaagacacctgacgaaggctggatcatgcaagacggtacaccatggcctgggaataatcctcgtgaccaccctggcatgatccaggttttccttggtgagactggtgcccgggactttgatggtaacgaaacttcc

SEQ ID NO: 28185 - protein, 423 aa, Panicum virgatum
  misc_feature: Ceres CLONE 1882239
  misc_feature (165)..(423): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 2 in US patent 7049481
  misc_feature: Functional homolog of the protein sequence given in SEQ ID NO 50793
  misc_feature: Useful for making plants with modulated biomass
  misc_feature: Functional homolog of the protein sequence given in SEQ ID NO 50794
  misc_feature: Useful for making plants with altered cell wall content and/or composition
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 26 in US patent 7312377
  misc_feature (190)..(190): Xaa is any aa, unknown, or other
MESAAAVPCAACGDDACAACRACSYALCRACLDEDAAEGRTTCARCGGEYAAATDPAHRNEVAEADEVEDHHAGGGLRERVTMGSHLNDRQDEVSHGRTMSSLSGIGSELNDESGKPIWKNRVESWKEKKNEKKASAKKAAAKAQAPPVEEQIMDEKDLTDAYEPLSRIIPISKNKLTPYRAVIIMRLIXLGLFFHYRITNPVYSAFGLWMTSVICEIWFGFSWILDQFPKWYPINRETYVDRLIARYGDGEDSGLAPVDFFVSTVDPLKEPPLITSNTVLSILAVDYPVEKISCYVSDDGSAMLTFESLAETAEFARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNET

SEQ ID NO: 28186 - DNA, 632 bp, Panicum virgatum
  misc_feature: Ceres CLONE 1882239-R
  misc_feature: Encodes the peptide sequence at SEQ ID NO. 28187
gacgacggtgctgatcccgccgaccaccatcctggtgctcaacatggtgggcgtggtggccgggttctccgacgcgctcaacagcggctacgagtcgtggggcccgctcttcggcaaggtgttcttcgccatgtgggtgatcatgcacctgtacccgttcctcaagggtctcatgggccgccagaaccgcacgcccaccatcgtcgtgctctggtccgtcctgctcgcctccgtcttctccctcctctgggtcaagatcgaccccttcatcggaggcaccgagcctatcaacagcaccaactgcaacacagtcatctgctgaggggccgccggtcagccggtggtgtgccgcggacgatgtcttttgtctttctggtgttgcagatgtggttgcctggagcgagggcggttggtttcctccctctgtcgcctctgccccaggatctgaaagatctgttgtagattagtactatttggcatccaattgctcattggttttgtatgtgttatgagaagttttggagttaaaatgttaaactcgcctgaattgtgagaaggcattgttatgttgaagtgtgtgtaaaaatcacaaatagggacgcaagaaaaaggtgccaatatactttcatacc

SEQ ID NO: 28187 - protein, 106 aa, Panicum virgatum
  misc_feature: Ceres CLONE 1882239-R
  misc_feature: SWISSPROT Homolog: EC 2.4.1.12 Cellulose synthase (UDP-forming)
  misc_feature: Functional homolog of the protein sequence given in SEQ ID NO 50793
  misc_feature: Useful for making plants with modulated biomass
  misc_feature: Functional homolog of the protein sequence given in SEQ ID NO 50794
  misc_feature: Useful for making plants with altered cell wall content and/or composition
  misc_feature: The sequence is a functional homolog of SEQ ID NO 6 in US patent 7285702
  misc_feature: The sequence is a functional homolog of SEQ ID NO 2 in US patent 7049481
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: Functional homolog of the protein sequence given in SEQ ID NO 50125
  misc_feature: Useful for making plants with modulated plant growth and development
TTVLIPPTTILVLNMVGVVAGFSDALNSGYESWGPLFGKVFFAMWVIMHLYPFLKGLMGRQNRTPTIVVLWSVLLASVFSLLWVKIDPFIGGTEPINSTNCNTVIC

SEQ ID NO: 28188 - DNA, 724 bp, Panicum virgatum
  misc_feature: Ceres CLONE 1882241
  misc_feature: Encodes the peptide sequence at SEQ ID NO. 28189
catacaccgcatcgacccaccaccacaccagccaccaccgcaagggaattgaagccacacacagatttcctctcctctcctcgccggcctccacgcactgaccgcccgcggccccccgcgcgccgcgccagtccagccaccaccttcttcgtgccgccgccgagctcgccctcagtcgccgctgcgcccttcttctctccgtcctcggccgtccggatctgaactggcctctcaataacaaggaaacaccttagggaatgcagaaagatgtgcttgcatgttaaagagctacctagtgagggacttggcagggtagccgcccatatttcttctttgccgcctcttgatgacattggggctcatcaacacgcacagcttctgctccttgtgcttccgcacaatggggttcgatgtggcagctcagccatcttcttagagaaccacctcgggggagacggttgaagtcttcaaaggcaattgcaggcttcttgttagtccattgcaactattggatcagtgcggccttttgtgtgcatatagtatacattcggcgcgatgacagagcagaaaggaaatgttttgatgcagaagtatgagatgggaaagatgcttggacaagggacctttgccaaggtctaccatgcccgtaacacaaagacttttgaaagcgttgcgataaaggtgattgataaggagaagggtatgaagggtggcctcatcgatc

SEQ ID NO: 28189 - protein, 56 aa, Panicum virgatum
  misc_feature: Ceres CLONE 1882241
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MTEQKGNVLMQKYEMGKMLGQGTFAKVYHARNTKTFESVAIKVIDKEKGMKGGLID

SEQ ID NO: 28190 - DNA, 1276 bp, Panicum virgatum
  misc_feature: Ceres CLONE 1882245
  misc_feature: Encodes the peptide sequence at SEQ ID NO. 28191
gtcgccgcctaaacccaccacactcctgccctgcactgggagcgagaggcaggcagggcaggcgccatgggggtccgcttggcggccacgaagctgcacatcccgccctcggccgcgcggcgcccccccaccttcctgcccttcgtcgccgtcctccttctctgctccgcctcctacctcctcggcgtctggcagcacggcggcttcgcctccccgtccgactcccccgccgtctccatcgccaccgccgtcgcctgcaccaccaccgccgcccccgccacgaggaagaaggccccgtacgcccgcgccaggacccgctccgcctccccctcccagccgtcccgggccctcgacttctccgcgcaccacgcggcggccgcggacgcctcgctcgcatccgccgccgcctcctccggttcctcgtcgtcgccggcgtcgccgcggaggtacaggtaccccgcgtgccccgtcaggtactccgagtacaccccgtgcgaggacgtggagcggtcgctgcggtacccgcgggagcggctggtgtaccgggagcgccactgcccggcgtcggagcgggagcggctgcggtgcctcgtcccggcgccgcgcgggtaccggaccccgttcccctggcccgccagccgcgacgtcgcctggttcgccaacgtgccgcacaaggagctcaccgtcsmkaaggcggtgcagaactggatccgcgtcgacggcgacaagctcaggttccccggcggcgggaccatgttccccaacggcgccgacgcctacatcgacgacattgccaagatcatcccgctcctcgacggctccatccgcaccgcgctcgacaccggatgcggggtggcgagctggggcgcgtacctgctgtcgcgggacatcctggccatgtcgttcgcgccgcgggactcccacgaggcgcaggtgcagttcgcgctggagcgcggcgtgccggccatgatcggcgtcctcgcgtccaaccgcctcacctacccggcgcgcgccttcgacatggcgcattgctcccgctgcctcatcccctggcaactctacgatggactgtacctgatcgaggttgaccgcgtgctgcggccgggagggtactggatcctgtccggcccgccgatcaactggaagaagtactggaaggggtgggagcggaccaaggaggacctcaacgccgagcagcaggccatcgaggccgtcgccaggagcctctgctggacccaggtcaaggaggccggcgacatcgccgtctgggcagaag

SEQ ID NO: 28191 - protein, 403 aa, Panicum virgatum
  misc_feature: Ceres CLONE 1882245
  misc_feature: The sequence is a functional homolog of SEQ ID NO 758 in the 10/412,699 US patent application
  misc_feature: The sequence is a functional homolog of SEQ ID NO 1593 in the 11/479,226 US patent application
  misc_feature (208)..(208): Xaa is any aa, unknown, or other
MGVRLAATKLHIPPSAARRPPTFLPFVAVLLLCSASYLLGVWQHGGFASPSDSPAVSIATAVACTTTAAPATRKKAPYARARTRSASPSQPSRALDFSAHHAAAADASLASAAASSGSSSSPASPRRYRYPACPVRYSEYTPCEDVERSLRYPRERLVYRERHCPASERERLRCLVPAPRGYRTPFPWPASRDVAWFANVPHKELTVXKAVQNWIRVDGDKLRFPGGGTMFPNGADAYIDDIAKIIPLLDGSIRTALDTGCGVASWGAYLLSRDILAMSFAPRDSHEAQVQFALERGVPAMIGVLASNRLTYPARAFDMAHCSRCLIPWQLYDGLYLIEVDRVLRPGGYWILSGPPINWKKYWKGWERTKEDLNAEQQAIEAVARSLCWTQVKEAGDIAVWAE

SEQ ID NO: 28192 - DNA, 1159 bp, Panicum virgatum
  misc_feature: Ceres CLONE 1882251
  misc_feature: Encodes the peptide sequence at SEQ ID NO. 28193
aaaaagccaacccaaaacctcccttttcccctccgttccgctccgctcccctcctcctctgtcgctcgatccgccgatccggtttctccgcgcccggtcgcgaaccccgtccggattccgccgtctgttctgcgcaatcggcgtcgttgatgcggcgcggctcgggccccgggctgtgattgggaggtgtcggtgcggcgggtggcggcggcggtgttggcgcgggcgcggcgggcctccatgaggcggcggccggtcctgccgtcccaccacgacgacacggacaagggcggcgggaagccggcgtcctcgcgcctctgcttcctcgccacgctctgcgccatgttctgggtcctcatcttctacttccacttcgccgtcgtctccaacgagcccgacgcctccgcggcgcaggctggcggggtgcgcattgcccgcgcccgcctccagctccccgaacctgacggcgccgtccgccacgacatgcccctagtgccccccgcccgcgcatcggagccgccgccttctgtcgcgcgccccaaggaggtggtggtggaggagaagcctgccgccggagcccgccaggaggaggcgcagcccaaggtggcggcgccgtacccgttcgagcgggcgctcaagacggccgagaacaagagcgacccgtgcggcggccggtacatctacgtgcacgagctgccgccgcggttcaacgaggacatgctccgggactgcgagaagctcagcgtgtggaccaacatgtgcaggttcatgagcaacgacgggcttggcccgccgttgagcgacgaggagggtgtcttctccagcaccgggtggtatggcaccaaccaattctccgtggatgttattttcggcaacaggatgaagcagtacgagtgcctgaccaatgactcgtccattgccgcagccgtctttgtgccattctatgccgggtttgatattgcaagatatctctggggttataatatctcaacaagggacgccgcatcgcttgatttggtggattggttgatgaagaagcctgagtggaatgtgatgggcggccgtgaccatttcttagttgcagggaggatcacttgggattttcagaaggttgacggaggaagagtcggattggggaagcaagctgctcttcttgccg

SEQ ID NO: 28193 - protein, 306 aa, Panicum virgatum
  misc_feature: Ceres CLONE 1882251
  misc_feature (147)..(305): Pfam Name: Exostosin Pfam Description: Exostosin family
  misc_feature: Functional homolog of the protein sequence given in SEQ ID NO 51273
  misc_feature: Useful for making plants with altered cell wall content and/or composition
MRRRPVLPSHHDDTDKGGGKPASSRLCFLATLCAMFWVLIFYFHFAVVSNEPDASAAQAGGVRIARARLQLPEPDGAVRHDMPLVPPARASEPPPSVARPKEVVVEEKPAAGARQEEAQPKVAAPYPFERALKTAENKSDPCGGRYIYVHELPPRFNEDMLRDCEKLSVWTNMCRFMSNDGLGPPLSDEEGVFSSTGWYGTNQFSVDVIFGNRMKQYECLTNDSSIAAAVFVPFYAGFDIARYLWGYNISTRDAASLDLVDWLMKKPEWNVMGGRDHFLVAGRITWDFQKVDGGRVGLGKQAALLA

SEQ ID NO: 28194 - DNA, 595 bp, Panicum virgatum
  misc_feature: Ceres CLONE 1882251-R
aaccttgaaagacgcatttgattgtttccatagaggcaatcattaacaaagtgacaaagttgagaagagatatcatcgcaggccgagaagataaagattttattgaagagaatagctggaagtatagtctattagaagatggacagcgaacaattggacctcacgaatgggatccattcttctcgaaacgcaaagaaaaaggtggagatcctagtagctcagctgctgaagctgccaagaattcttggaaaagtgaacaaagaggacagaattaaaccacaaggtacatcaccttggagatgtgatcaagggagcagagtttgctacactctctgaagatgttctaatgcaaatacattgcacataggtcaagatccagtagctatgatgatcatgaacatcattgatgatctagttcaccctacagttgtacaaagccattccaccaaaaatgctttggggaaatttggcacacagcgtttgcttacacctataaatatcattttctacactaatttttgtttgatgtttttggtcaataatcctttgtaagcccttacaggatttagaggtatatcgatgttgttattgtacc

SEQ ID NO: 28195 - DNA, 2271 bp, Panicum virgatum
  misc_feature: Ceres CLONE 1882252
  misc_feature: Encodes the peptide sequence at SEQ ID NO. 28196
aaagagtggaaataaacaaaagattttagaaataaacaagagagataaaactcagatctcactctccacagttcaacgccccaggttccctctcaatccaatcccccttgctgctcccagcccattcatccctgcggttatcttcttccgcggttgtatcctccaatctcttctccacagagaggattatttttggcttccaaatctcgcaaggagaagggttagaagaaaagcaaggtgctttgcgccgcaagaatcgccattgcccgccatatcttctgagatctcaactcaacccccctgacaataggtagatacccagatttctcctcccctttctgcagcgattttgctcttggagctgtagattgggtacgtgttcccttccattcgtgtccgaattagacattgggatcctgttcctcccttcgtattctcttttgccaagaattttccatattgttcgtggctctctgatccatctttgatgcgccaagaggcgagatgaacacgaattactcggcgctcccattgacctccccttccatcgagctccaatccaacgggaccaaatccagcgccgccaccaatggcgtcgtcctcaacggccacgccaagatctccaagcaagattcgttcttgggcgagctcgaggacggcggcggtggcggggagcacgacgaactcccgctcatcggcgacggccccgccgggccgccggaggggtcaagcgtacccgctgcggtgttcaacctcgctacctccatcatcggggccggcattatggcgctccccgccaccatgaaggtgctcggcgttgccgtcgggcttgtcgcgatcctcgtcatgggggtcctctccgagatcaccgtcgagctgctagtgaggttctcggcacactgccgagccctttcatacggcgaggtagtgcaccgggcactgggccggccggcgagcatcgtggcgcagatgtgtgtcatcatcaacaatgctggagtcctagtggtgtacctaatcatcatcggagatgtgatgtccgggtcgctgaagcacattggcgtcatggatcagttgattggccatggggagtgggataaccggaagctgctgatcttggtggttcttgtgatcttccttgcgccattgtgtgcacttgaaaagattgactcactgagcttgtcatctgccgcatcggttgcccttgctgttgtgtttgtggttgtctcctgcatcattgccttgatcaagattgccgagggcaagatcagcatgccgaggatggggccagatttcagctcaagagcggcgatgctagacctgcttgtcgtgatacctatcatgacgaatgcctacatctgccatttcaatgtccagccaatctacaatgaactcaaggagaagacaccccagaatatgtacaaggttgggaggatcagcacagtgctatgcgttgtggtatatgccctgactgctctctctggctacctcttgttcggcgacgatacggagtccgacgttctcaccaacttcgacaaggatctcgggatcagattcagctcagtcctcaactacatcgtcaggattggttatgtcatccacctggtccttgtgttccctgttgtccacttctcactaagacagactgtggactcgctgatatttggggagctggctacccctagcaggaagaagacactcacattgacagttcttctactggcgctcatctaccttggctcaacgatgatacccaacatctggatggccttcaagttcaccggtgcaacaactgggctggcattggggttcatgttcccggccctggtggcattaaggctggacaaggaagggaaccgcttggggcatggagagaggctcctgtcacttgggttgctggggctgtccatagtcgttagcgtcatcggagttgtcggaaatgtatacaccctgaagagtaagtctgagtgatctcacgaagatgaacaaattggtagctaggttagatgaatctgtacaccatgacatggtgtcttacaacaagagacggagattgtgtaagcatggtcattatacagtagtcagctatgatactattcgagagaaccacaggatctcagatacagtctctttaccttctgaggtgcatcatggaacagttcttaagagaattcttttttgtactttataccagattttttttatgtaacaatttacgagggtcctggagttattttttttgataaaggcaacacaagaatccagttcacttgt

SEQ ID NO: 28196 - protein, 487 aa, Panicum virgatum
  misc_feature: Ceres CLONE 1882252
  misc_feature (73)..(484): Pfam Name: Aa_trans Pfam Description: Transmembrane amino acid transporter protein
MNTNYSALPLTSPSIELQSNGTKSSAATNGVVLNGHAKISKQDSFLGELEDGGGGGEHDELPLIGDGPAGPPEGSSVPAAVFNLATSIIGAGIMALPATMKVLGVAVGLVAILVMGVLSEITVELLVRFSAHCRALSYGEVVHRALGRPASIVAQMCVIINNAGVLVVYLIIIGDVMSGSLKHIGVMDQLIGHGEWDNRKLLILVVLVIFLAPLCALEKIDSLSLSSAASVALAVVFVVVSCIIALIKIAEGKISMPRMGPDFSSRAAMLDLLVVIPIMTNAYICHFNVQPIYNELKEKTPQNMYKVGRISTVLCVVVYALTALSGYLLFGDDTESDVLTNFDKDLGIRFSSVLNYIVRIGYVIHLVLVFPVVHFSLRQTVDSLIFGELATPSRKKTLTLTVLLLALIYLGSTMIPNIWMAFKFTGATTGLALGFMFPALVALRLDKEGNRLGHGERLLSLGLLGLSIVVSVIGVVGNVYTLKSKSE

SEQ ID NO: 28197 - DNA, 569 bp, Panicum virgatum
  misc_feature: Ceres CLONE 1882282
  misc_feature: Encodes the peptide sequence at SEQ ID NO. 28198
atcacgaatccgaagaatccccacgagcagaagagaaaacccagagaaaccaagcgaaaaatccaatcttttcctcgattcagcccccgattccgcggcgagaagagccatggccgagtccgccaacaacgacgccccggccgccaccaacaaccagcccactacggtaagagatggttccgtgttcttggatttcccctgattcggttgcgtttggtgccgtttctggtggtgctgatttggggggtgttgttggttcgcaggaggaggtgacgattgagagggcggcgacccaggaggaggaggagaggctgcggtacctcgagttcgtgcagcaggcggcggcgcaggcgctggtgctggccgccgcggcgtacgcgtacgccaagcagggcgcggggccgctccgccccggtgtcgaccacgtcgagggctccgtcaagaccgtcgtggggcccgtctacgaccgcttccatgccgtcccgctcgacctcctcaagttcctcgaccgcaaggttggtgagtccgttgaggaaattgaccgccgcgtccctccagtgggaaaggaa

SEQ ID NO: 28198 - protein, 131 aa, Panicum virgatum
  misc_feature: Ceres CLONE 1882282
  misc_feature (38)..(131): Pfam Name: REF Pfam Description: Rubber elongation factor protein (REF)
MVPCSWISPDSVAFGAVSGGADLGGVVGSQEEVTIERAATQEEEERLRYLEFVQQAAAQALVLAAAAYAYAKQGAGPLRPGVDHVEGSVKTVVGPVYDRFHAVPLDLLKFLDRKVGESVEEIDRRVPPVGK

SEQ ID NO: 28199 - DNA, 712 bp, Panicum virgatum
  misc_feature: Ceres CLONE 1882292
  misc_feature: Encodes the peptide sequence at SEQ ID NO. 28200
cccggtgcccgaacgccgaacggcagcgcagccgaaagcccggacccgctcgcgccgccgcccgcctcccccccgtctcacccagccgcgcgctcccttctaccgcgccgccgcctccgcgcggctgggccccgcgcacgccgccccaatcagacgcgccgccgccctcctgggggtggcggaggcagcggggacccgctcccatggagagcgccgccaacagcggcgggggggacgacgactcggtcgggaagctgttggtgaaccgctacttgaagggcgcaacgatcggccagggcacgtatggagtcgtcaacaaggccatcgacaccaagactggaaatacagtcgcgataaagaaaatcctgatgagggagaagaaggacggtgtcaacttcacagcattgagggaaattaaactactgaaggagctgaaagatcctaatattatagagctgattgattgtttcgcttacaaagatagcctgcaccttgtatttgagctcatggaaactgatctggaagctgtcataaaagctaaacacattgtattatctccagctgacacaaaatcatatgcccagatgatgttgaaaggtctagctttctgccacaagagatgggtgctgcacagggacatgaaaccaaataatttactcatcggtgctgatgggcagctcaagcttgctgactttggtctggcacgtatgtt

SEQ ID NO: 28200 - protein, 169 aa, Panicum virgatum
  misc_feature: Ceres CLONE 1882292
  misc_feature (23)..(169): Pfam Name: Pkinase Pfam Description: Protein kinase domain
  misc_feature: SWISSPROT Homolog: EC 2.7.11.23 [RNA-polymerase]-subunit kinase
MESAANSGGGDDDSVGKLLVNRYLKGATIGQGTYGVVNKAIDTKTGNTVAIKKILMREKKDGVNFTALREIKLLKELKDPNIIELIDCFAYKDSLHLVFELMETDLEAVIKAKHIVLSPADTKSYAQMMLKGLAFCHKRWVLHRDMKPNNLLIGADGQLKLADFGLARM

SEQ ID NO: 28201 - DNA, 474 bp, Panicum virgatum
  misc_feature: Ceres CLONE 1882304
  misc_feature: Encodes the peptide sequence at SEQ ID NO. 28202
aagaagagcctccgcctcctcctcctccggtacccgagctcttctccactccacgtctcctccagccgcccatccatcgcaactaccaagctcccagacacagccacgaaccttttcagttcagctgtgccgttgagacacatggagtgcgagaacggacgcgtcgccgccgccaccggcaatggcgtgtgcctgccggtgccgccgcgggccgaccccctgaactggggcaaggcggcggagaacctggccgggagccacctggaggccgtcaagcggatggtggaggagtaccgccggccgctggtgaggatcgagggcgccagcctcacggtcgcccaggtcgccgccgtggccgcggccggcgaggcccgggtggagctcgacgagtccgcccgcggccgcgtcaaggccagcagcgactgggtcatgagcagcatgatgaacggcaccgacagctacggcgtcaccacc

SEQ ID NO: 28202 - protein, 110 aa, Panicum virgatum
  misc_feature: Ceres CLONE 1882304
  misc_feature: SWISSPROT Homolog: EC 4.3.1.5 Phenylalanine ammonia-lyase
  misc_feature: Functional homolog of the protein sequence given in SEQ ID NO 51172
  misc_feature: Useful for making plants with altered cell wall content and/or composition
  misc_feature: Functional homolog of the protein sequence given in SEQ ID NO 50787
  misc_feature: Useful for making plants with altered lignin content
MECENGRVAAATGNGVCLPVPPRADPLNWGKAAENLAGSHLEAVKRMVEEYRRPLVRIEGASLTVAQVAAVAAAGEARVELDESARGRVKASSDWVMSSMMNGTDSYGVT

SEQ ID NO: 28203 - DNA, 692 bp, Panicum virgatum
  misc_feature: Ceres CLONE 1882311
  misc_feature: Encodes the peptide sequence at SEQ ID NO. 28204
acaccacacctcaggccctgacactcccggccttctgctctgccaccccatccatcccctcctcccagagtctccagcaggcagctgctagcctcctgctccggccaactaaccgtgccagcatggccgcgcgctgtccttacttcgccgccgacgagaccacccgcgtcatccgcccgggggagtccccggccgcggcgttccgccggatcctcgccaaacccggcgcgcaccaggcgccctgctgcttcgacgcgctcgccgcccgcctcatcgagcgcgccggcttcgagatcggcttcatgagcggtttctgcgtttcggccaccaggcttggcttgcctgacgttggcctcatttcctatggagaaatggtggaccaagggcgtctgatcaacgaatctgtatcgattccagtgcttggtgatggggacaatggctatggaaactctatgggcatcaagagaaccatcaaagggtacatcaatgctggttttgctggaatcatgcttgaagatcaggtgccctctaatattaatcaataatcctttcatatattgtcaccttattattagctaacatagtatcacatatggtccttgtcaggtttaactccgactgcaacgatgagttcctaaactgttgttgtctctactattagctttaatttgataataaaccctgccacttcc

SEQ ID NO: 28204 - protein, 140 aa, Panicum virgatum
  misc_feature: Ceres CLONE 1882311
  misc_feature: SWISSPROT Homolog: EC 2.7.8.23 Carboxyvinyl-carboxyphosphonate phosphorylmutase
MAARCPYFAADETTRVIRPGESPAAAFRRILAKPGAHQAPCCFDALAARLIERAGFEIGFMSGFCVSATRLGLPDVGLISYGEMVDQGRLINESVSIPVLGDGDNGYGNSMGIKRTIKGYINAGFAGIMLEDQVPSNINQ

SEQ ID NO: 28205 - DNA, 702 bp, Panicum virgatum
  misc_feature: Ceres CLONE 1882317
  misc_feature: Encodes the peptide sequence at SEQ ID NO. 28206
acgagctagctcatatggctacaatggaaggaccgcagatccttcttgtgctcctcgtccttacccagataagcctcaccggctgcagccctccgcgggatccggtagcctgcatcgacggcacctccaactgcaccatcagcaacgcatatggctccttcccggaccgcagcatctgccgcgcggcgagcgtcgcctacccccgcagcgagcaggagctcgtggcggccgtggcggccgcggtggcggccaagcgcaaggtgaaggtcgccacgaggtactcccacagcttccccaagctggcctgccccggcggcagcgacggcaccatcatcagcacgcagtggctcaaccggaccgtgcggatcgacgccgagaagcagctcatgacggtagagggcggcatggtgctcagggacctcatctacgccgccgccggggcagggctcgcgctgcctcactcgccctactggtacggcctcaccatcggcggcctcctgggcaccggcgcgcacggcagctcgttgtggggcaaagggggcgccgtgcacgagtacgtcatggggctgaggattgtgacgccagcaccggcgagccagggcttcgccacggtgagggatctcggcatagacgacccggacctcaacgcggccaaggtatcgatcggagttctcggcgtcatctctcaggtacgaattgtat

SEQ ID NO: 28206 - protein, 229 aa, Panicum virgatum
  misc_feature: Ceres CLONE 1882317
  misc_feature (57)..(204): Pfam Name: FAD_binding_4 Pfam Description: FAD binding domain
  misc_feature: Functional homolog of the protein sequence given in SEQ ID NO 50472
  misc_feature: Useful for making plants with modulated nitrogen use efficiency
MATMEGPQILLVLLVLTQISLTGCSPPRDPVACIDGTSNCTISNAYGSFPDRSICRAASVAYPRSEQELVAAVAAAVAAKRKVKVATRYSHSFPKLACPGGSDGTIISTQWLNRTVRIDAEKQLMTVEGGMVLRDLIYAAAGAGLALPHSPYWYGLTIGGLLGTGAHGSSLWGKGGAVHEYVMGLRIVTPAPASQGFATVRDLGIDDPDLNAAKVSIGVLGVISQVRIV

SEQ ID NO: 28207 - DNA, 2130 bp, Panicum virgatum
  misc_feature: Ceres CLONE 1882334
  misc_feature: Encodes the peptide sequence at SEQ ID NO. 28208
atttttgctcccccaccccaaagctcatcccccgcgttgcaggggcggcgtcgaccaccggtccaccaccgtacgtccccgcactgcgacctttatttgctcccccaccccaaagctcgtcctcgctcccgcagccactcatcacggaatcgcgctgccgccgctccctgaccttggccgcatctcgccgcggtggctgctggagaggctggatcagggcctcctcggctccgtcctcaccgtcgcccggctccttctccagctcgccggactcgggggccacatatatataacgaggcgggatccggccatccgggtcgttcggagtccggaagccaggcccagagcgccggatcctcctcgccgccgcgccgaggacccggggccggccgttcaccgcggcgcgtccagtccggcgggtgctcccttgcaacctaggcttctgcgcgttctctccacaggaaccgcccaagcggtgcacctctctcggcagctccgatccaggtagctagccggtagaacagcaatggcggttgtagtaggtgttaccacgggggtgatgaaaccgctcctgtccaagcttaccaagctgctggaagaagagtacgtcaagttcaagggtgttcgcaagcagatcaagttcttgagagatgagctgagcgccatgagtgccacgctcaaggatctcgcagatgcggatccggagaagctcaactctgaagtgaggctctggagggacaagctacgcgagctggcctatgatttggaagattgcatcgatgccttcatggctcatgttgaccacgggcatgatgggggtacgggcttcaagaaatacctgaagagactgatagcacgccgtgatattgccaatcagatccaagaactcaaggcatccgtaatggaggccgccgagaggcacaggaggtttgaattcgcccaattaaaacaatttgcccaattaaaacacaactctagcacttcttccgttgatcccaggctgcatgcacttcatgaggatattgaaaaacttgtgggcatcgatgtccccaagaagcatatcattgagttgttatccatggagatggatgggccatccacaaagcttaaggtggtctcaattgctggctgtggaggtcttggtaagactactcttgcaaagcaagtctacgacaccatcaaaggccagttctcctgttcagcttttgtgtcggtttctcgaacacctgatgtgaggaagattctaatacacattagtagtggagttggattcactggttacacgcaggatgatggcgtgcagcagctcattgataaactcaggaattaccttcactgtaaaaggtacattgttataattgatgatgtatgggacacagaagattgggaatttatcaaacttgcattaccgaataatgattatgggagccgaataatcagtacgacacgcagtattgctgttgcaaaatgttgttcctctcaaatttatgaaatagagcctcttagttttgatgactccaaaaggttgtttttcaaaagagcatttggttctgagacttcatgctatcctcacttggaagatgttccggatagaatattaagaaaatgtggtggtctaccattggcaattgttactgtatctagcatgttaacaaatgagcttgcaaaagcagaatgggatagggtactgagagctatcggttctgcacttgcaaacaaacctgatgctaagaagatgaccagtataatatctctgagttactttgatattccttgctgtctgagaacttgtttgttgtacttgagtgtgttcctagaagattttgagatagagaagcaacctttgatccatagatggattgcagaagggttcattcatgaggaaggagggcgaactaaatatgaaattggtgagggttattttaatgatctcatcaatagaagcatgatccaacctgttgatgtagagtacggtcaggcaaaggcatgccgagttcatgacatcattcttgactatatcaagtgcaaggctgctgaagagaattttgtaactctatccaatggtgcagagcatgtatacacatcatcggattacaaggttcgtaggctttgcgtcagcaatcacaccgg

SEQ ID NO: 28208 - protein, 534 aa, Panicum virgatum
  misc_feature: Ceres CLONE 1882334
  misc_feature (154)..(455): Pfam Name: NB-ARC Pfam Description: NB-ARC domain
MAVVVGVTTGVMKPLLSKLTKLLEEEYVKFKGVRKQIKFLRDELSAMSATLKDLADADPEKLNSEVRLWRDKLRELAYDLEDCIDAFMAHVDHGHDGGTGFKKYLKRLIARRDIANQIQELKASVMEAAERHRRFEFAQLKQFAQLKHNSSTSSVDPRLHALHEDIEKLVGIDVPKKHIIELLSMEMDGPSTKLKVVSIAGCGGLGKTTLAKQVYDTIKGQFSCSAFVSVSRTPDVRKILIHISSGVGFTGYTQDDGVQQLIDKLRNYLHCKRYIVIIDDVWDTEDWEFIKLALPNNDYGSRIISTTRSIAVAKCCSSQIYEIEPLSFDDSKRLFFKRAFGSETSCYPHLEDVPDRILRKCGGLPLAIVTVSSMLTNELAKAEWDRVLRAIGSALANKPDAKKMTSIISLSYFDIPCCLRTCLLYLSVFLEDFEIEKQPLIHRWIAEGFIHEEGGRTKYEIGEGYFNDLINRSMIQPVDVEYGQAKACRVHDIILDYIKCKAAEENFVTLSNGAEHVYTSSDYKVRRLCVSNHT

SEQ ID NO: 28209 - DNA, 349 bp, Panicum virgatum
  misc_feature: Ceres CLONE 1882348
  misc_feature: Encodes the peptide sequence at SEQ ID NO. 28210
ctctcttttcccctccggcctccctcttcccgggccgaggagcgacctccgccgccgccgccatgccgaagcactaccgccctgcgggcaagaagaaggaggggaatgccgcgaactacatcacgaggaccaaggcggtcaactacctgcaagtcagccttgcaattttcaggaagctatgtattctcaagggtgtttttcctcgtcaaccgaagaagaaggtggaaggaaaccacaagacatactaccacatgaaggatattgccttcatcgctcatgaccctttgatcgagaagttcacgccaacccagggcccacgaaagaagttaaaaaggctattggtaaaaaa

SEQ ID NO: 28210 - protein, 95 aa, Panicum virgatum
  misc_feature: Ceres CLONE 1882348
  misc_feature (8)..(95): Pfam Name: Pescadillo_N Pfam Description: Pescadillo N-terminus
MPKHYRPAGKKKEGNAANYITRTKAVNYLQVSLAIFRKLCILKGVFPRQPKKKVEGNHKTYYHMKDIAFIAHDPLIEKFTPTQGPRKKLKRLLVK

SEQ ID NO: 28211 - DNA, 2165 bp, Panicum virgatum
  misc_feature: Ceres CLONE 1882353
  misc_feature: Encodes the peptide sequence at SEQ ID NO. 28212
aaagctcagctcacctctccctcgccctcgccctcgccctcacctcacctcgtgtcagcccccctcctcgggatgccattcctgcctccacgtcgcagtccgccccagcgacctctattaaacgtcgacacctcacgctgccacacccgccgcttatcaatgggctgccgacggcgattgagcgagttcagcggctagaagaatttcttttgcttccggagagaatgcggggcggcggcggcggttccgggcttgggtttcccggcggcgtgctggtggaggaggaaggggaggaggtggtctcggcgccggagaggccaatgtggcgccggcggtggggagtcgaggtggacgacggctactcgccgagctccacgggcggcggtggaagcagctgctgcgactccttcggctgcgattcgcctttggctgggttcgtgcgcccagatggtgacccagacacagatctggagacagatgggttggccacttcctcctccagtgcttctgcagccttcacggagcggcaggacgacgaggaggtgctatgcggggtgaaggaagaggagtgggcgaaggtacaagaaccggccaaaaatccggcaggccgttccaccccagaatgccacaaccagcagcaccgaacggaggctactgttcttttgcacagtaggaagggatcgaaacagcggccagcctcgctcgacttcggtagccctgggttccatggagccacattttcaccgaatttcgtggttggtggtgtgggtttgatgaataagggacttgtagcatcacacatcaggtcagacgtgtttcatagtcctggaacaccgaactattcgcggcaccgtgcatcagtgttggggttccagaaagggtggtgctctgagagagtgccgcatccttccaaaggaagtagaaggtaccctgggagcagcatggcatttccttacagcagtggaaggacattgccctcgaaatgggaggacgcagagaggtggatattcagtcctaattccagtgaagttctcggaagaagcacggttgctcatgctcggcaaccaaagtctaaaagtggccctctgggacctccgggaagacttggcggacagtattcatctgtttcttcagtgccactgcttgacagtgggagagctggacctattacatcaaattcaccttttgtggcaggagtactaatgccagaacatgtttgtggagggaagaatgcaaatggaacatattcgggtagaccagctggtgatgaaaccactattggaagcaatgtcaggttttgtccaccgaatggtggatctcatgctattcgatcttccagagttcgtcgtcgattagatgctgccattgaatcatcttcttcattgcctagcaccagagaatctatccaaggtgagcaggttgaaatcacagaagattcggctactactttcgcctcgatgatttccaggaaagatgctgcaactcaaactagcccagagctaagtaggtcctcttcgcccaacaacactagaccaacatttacccgttcgcggtcgacgcaacaagtcaaagagagcgagagctgtttctcagatcttgagatcagggatgttcagatggatgatcgagtgactctgactaggtggtcaaagaaaaatgtaacacgatcatctaacaagaattcaacaaacataatagagtggaaggaaaagacagttgaatcaaaatcttcgtcctggggctttgccgaagcaaagtgcatatctaagattgagagagaggatgcaaaaattaccgcatgggagaatattcaaaaagcaaaagctgaggcagcaattcagaagttagtgattaagctcgagaagaaaagatcgtcttcgctggacaagattttgaacaccctcaagtctgctcaaagaaaagcgcaggtgatgcgtgagcgtgatgcagcaacagcaaaccaagatgaaaaaggctctaggaagggaaaaaaggcagcacagcttagcaagaatggccaaatcagttcactgagtggctgtttcacttgccatgctttctgatacatgtgcttccaccccataatagagtaagttgcattcagactattactgtgcatcttgtttgggtattgaattttcaagtagcttgatgttctgtttctc

SEQ ID NO: 28212 - protein, 612 aa, Panicum virgatum
  misc_feature: Ceres CLONE 1882353
  misc_feature (493)..(605): Pfam Name: Remorin_C Pfam Description: Remorin, C-terminal region
MRGGGGGSGLGFPGGVLVEEEGEEVVSAPERPMWRRRWGVEVDDGYSPSSTGGGGSSCCDSFGCDSPLAGFVRPDGDPDTDLETDGLATSSSSASAAFTERQDDEEVLCGVKEEEWAKVQEPAKNPAGRSTPECHNQQHRTEATVLLHSRKGSKQRPASLDFGSPGFHGATFSPNFVVGGVGLMNKGLVASHIRSDVFHSPGTPNYSRHRASVLGFQKGWCSERVPHPSKGSRRYPGSSMAFPYSSGRTLPSKWEDAERWIFSPNSSEVLGRSTVAHARQPKSKSGPLGPPGRLGGQYSSVSSVPLLDSGRAGPITSNSPFVAGVLMPEHVCGGKNANGTYSGRPAGDETTIGSNVRFCPPNGGSHAIRSSRVRRRLDAAIESSSSLPSTRESIQGEQVEITEDSATTFASMISRKDAATQTSPELSRSSSPNNTRPTFTRSRSTQQVKESESCFSDLEIRDVQMDDRVTLTRWSKKNVTRSSNKNSTNIIEWKEKTVESKSSSWGFAEAKCISKIEREDAKITAWENIQKAKAEAAIQKLVIKLEKKRSSSLDKILNTLKSAQRKAQVMRERDAATANQDEKGSRKGKKAAQLSKNGQISSLSGCFTCHAF

SEQ ID NO: 28213 - DNA, 1921 bp, Panicum virgatum
  misc_feature: Ceres CLONE 1882361
  misc_feature: Encodes the peptide sequence at SEQ ID NO. 28214
actctgctttccctctctacaaagtagaagaggaaaaaaaacaccccaaaggaaaggctcacaccacccacccaaccaacaaattgagctagattagcagaggaccggaggtagagagcggcgcaacgcagcatcgaggggcggcggcggcggcggcgagaccaatctagagggagcagaggccgggcgcgcgcagggatgggcgcgccggtgcgcggcgcccttctcctctgcctcctgctcctggcgggggcggcgggggcggccggggacgcggcgccgcaggaacccacattgcccgccgcgggcgccggcgccggcggcgggccggcggtgggggtcaactccaactcggtgctggtggcgctgctggactcgcactacacggagctggcggagctggtggagaaggcgctgctcctgcagacgctcgaggacgccgtggggcggcacaacgtcaccatcttcgcgccgcggaacgaggcgctggagcgggacctcgacccggagttcaagcgcttcctcctcgagccccgcaacctcaagtcgctccaggcgctgctgctctaccacgtcctccccgcgcgcctcccctccgactcctggcccgccgcctcccaccccacgctctccggcgaggagctcgagctcgccgccggcatgcgcgtcggccacgccgccgtcacgcgcccggacgcggtgctccgccccgacggggtcatccacggcatcgagcgcctcctcgtgccccgctccgtgcaggaggacttcaaccgccgccgcagcctcgccgctatctcggccgtgctgcccacgggcgcgcccgaggtcgacccgaggacgcaccgcctcaagaagcccgcgccgccggtgccccccggcgcgccccccgtgctcccgatctgggacgccatggcgcccggcccggccatcgcccccgcgcccgcgcctgggcccggctccgggaagcaccacttcgacgggcacagccaggtcaaggacttcatccagaccctcctcctgtacggcggctacaacgagctcgccgacatcctcgtcaacctcacctcgctcgccaccgagatgggccgcctcgtctccgagggctacgtgctcaccgtcctcgcccccaacgacgaggccatggcgcgcctcaccacggaccagctcagcgagcctggctcgccggagaacatcctctactaccacatgatccccgagtaccagaccgaggagtccatgtacaacgccgtgcggcggttcggcaaggtgcgctacgacacgctgcggctgccgcacaaggtcgtggcgcgggaggccgacggctccgtcaagttcggccagggcgagggctccgcctacctcttcgacccggacatctacaccgacggtaggatctcggtgcagggcattgacgccgtgctcttcccgccgggtgacaagaacgcgacgcagacggccgaccctcacaggaagcctcccgccatcaccacccacaagaagatcaagctccggcgaggcaagttgttagaagcatcgtgccaaatggctgccctcttcggtcagcgatcgcgattcgcaagctgccaagattgatctccatgataccgaaagacgaacgaactgaaacaaccaagtgatggccgatgggggctgtgctggagggagccgtccacattattatttgttttcttttttttgtttattgataagaataatgaatcaggtggggatgtaaactcggtggttgttggtgtgtccagagaaagagggggaaaaaagaaaaggcaagaaaaaaaattgtccatacatgaaggaagaccaggatcgtcgtctgtgtataggaagaattaaacgttttgttttctgtttttcgtcattctttgcttctgttcccgttttgacaatgagaatctcgggt

SEQ ID NO: 28214 - protein, 465 aa, Panicum virgatum
  misc_feature: Ceres CLONE 1882361
  misc_feature (61)..(184): Pfam Name: Fasciclin Pfam Description: Fasciclin domain
  misc_feature (278)..(411): Pfam Name: Fasciclin Pfam Description: Fasciclin domain
  misc_feature: Functional homolog of the protein sequence given in SEQ ID NO 50622
  misc_feature: Useful for making plants with altered carbohydrate content
  misc_feature: Functional homolog of the protein sequence given in SEQ ID NO 50623
  misc_feature: Useful for making plants with altered cell wall content and/or composition
MGAPVRGALLLCLLLLAGAAGAAGDAAPQEPTLPAAGAGAGGGPAVGVNSNSVLVALLDSHYTELAELVEKALLLQTLEDAVGRHNVTIFAPRNEALERDLDPEFKRFLLEPRNLKSLQALLLYHVLPARLPSDSWPAASHPTLSGEELELAAGMRVGHAAVTRPDAVLRPDGVIHGIERLLVPRSVQEDFNRRRSLAAISAVLPTGAPEVDPRTHRLKKPAPPVPPGAPPVLPIWDAMAPGPAIAPAPAPGPGSGKHHFDGHSQVKDFIQTLLLYGGYNELADILVNLTSLATEMGRLVSEGYVLTVLAPNDEAMARLTTDQLSEPGSPENILYYHMIPEYQTEESMYNAVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFASCQD

SEQ ID NO: 28215 - DNA, 687 bp, Panicum virgatum
  misc_feature: Ceres CLONE 1882365
  misc_feature: Encodes the peptide sequence at SEQ ID NO. 28216
gagggcacgatttctctctcgaaccctagcggagatccaaccctagccccgcccccccgctcttctccctcgcccgcgcggcgacgacgcagggttttctgtcgggggattttttcgtcgccgactcgccggcgtccaagatgaggccggtgttcgtgggaaacctggactatgacacccgtcactcggagctcgaccacctcttctaccgctacggcaggatcgagcgcatcgacatgaagtcaggaactaccagggcaaacatagctccaccggggctcctcaactcctgaaatgccttccattcactcacccggccatcattttcttcgcttgaaaccatccgttcatgtgcactgctgtacactgttactactgctcgagcatgtttaacaggactgtgattcgtgccatgccatcagtaccatcatgccatgccatgccatgccatgccatgactagaagtatcaccaacatgacaacgtgctacttgtactgtattgataagcaagagttccatttatggcgaagcatgttcaatgtcaccagtcattatttcttactttggatataagttgttcaactccatgcttagctctgatcatgaatggaatctacctctgtagtgctcttcatatcatcagaactatgcaggatttgctttcgtttactttgaggatgagcgtg

SEQ ID NO: 28216 - protein, 50 aa, Panicum virgatum
  misc_feature: Ceres CLONE 1882365
  misc_feature: Functional homolog of the protein sequence given in SEQ ID NO 50813
  misc_feature: Useful for making plants with modulated biomass
MRPVFVGNLDYDTRHSELDHLFYRYGRIERIDMKSGTTRANIAPPGLLNS

SEQ ID NO: 28217 - DNA, 687 bp, Panicum virgatum
  misc_feature: Ceres CLONE 1882367
  misc_feature: Encodes the peptide sequence at SEQ ID NO. 28218
aaccagaccaccacggcaccaccaccacctcgagcttcccctcccctcccctcctctgctacaaccgcttcgtttcgtcccccccaaattgagctccgattcggcgtctccatcacgaatcgcgcactagttccaccccgaaaatcgccgccgcactggacccgcggatggagtgaccagttagggttccgaagccggcaatggaggcgcagtggctcgccgagtacccgcaccagggcgccgacaagcggccgcgcaagcggccccggctcgcctgggatgtcgcgcccacggtgttccagccccccaaggtatcgtactcgcgctgttagccgccaacttcggttactgggcgtgggattgcggtggtagttttggctagatctaggcgcggtttccactagatttggaggccgtatgttcgatcagggcatgtagctcgaagaattgcggatttgtggtacggttgttgcggatcatcgtggggatttggccaattagtggtgtatttggttggagcaggtcgctcgtgataagagctatttcgagaaataaggggaattttatgacccgttaccttgttctggcttttggagccttctaacataactttggagttgataactgtcctttttttctagaatagaatgtggaagtgttacagggtgaatttctcaagtaaaggtt

SEQ ID NO: 28218 - protein, 43 aa, Panicum virgatum
  misc_feature: Ceres CLONE 1882367
  misc_feature: SWISSPROT Homolog: EC 2.7.12.1 Dual-specificity kinase
MEAQWLAEYPHQGADKRPRKRPRLAWDVAPTVFQPPKVSYSRC

SEQ ID NO: 28219 - DNA, 683 bp, Panicum virgatum
  misc_feature: Ceres CLONE 1882371
  misc_feature: Encodes the peptide sequence at SEQ ID NO. 28220
aactcgcagaagtggtcttccctcgcatcatccgccctccgccggcccaccacctccgccgcctcgcccctgccgcgtccccgttcccggccccgcaaaccctaaccctaatggccgcctacgccgggaccaccagctccttcccgtacctactcgccggttcctccccggcggcccgccgccacggggccgcacaccggatccacgcctcggcatcagggacgacaggggaggcggcaatggacgtggtgtcggaggcggagctgcgggagaaggggttcatggggatgcggaagacgaagctggtgtgcacggtggggcccgcctgcgtggaggcgctgccggcgctggcgcgcggcgggatgggcggggcgcgggtcaacctctgccacggcggccgcgagtggcaccgggccgccatgcgcgccgtgcggaggctcaacgacgaggaaggcttctgcgtctcgctcatggtcgacaccgagggctcccagctactcgtcgcggaccacggaggcgccacctccgtcaaggccgaggatgactcagagtggctatttacaaacaaaaagactgatgaagcccatccattcacaatgcatgtcaattttgagaagttttctgatggcattctagttggtgatgagcttgtgatagacggtggaatggcaacatttgaagtt

SEQ ID NO: 28220 - protein, 190 aa, Panicum virgatum
  misc_feature: Ceres CLONE 1882371
  misc_feature: SWISSPROT Homolog: EC 2.7.1.40 Pyruvate kinase
MAAYAGTTSSFPYLLAGSSPAARRHGAAHRIHASASGTTGEAAMDVVSEAELREKGFMGMRKTKLVCTVGPACVEALPALARGGMGGARVNLCHGGREWHRAAMRAVRRLNDEEGFCVSLMVDTEGSQLLVADHGGATSVKAEDDSEWLFTNKKTDEAHPFTMHVNFEKFSDGILVGDELVIDGGMATFE

SEQ ID NO: 28221 - DNA, 1352 bp, Panicum virgatum
  misc_feature: Ceres CLONE 1882372
  misc_feature: Encodes the peptide sequence at SEQ ID NO. 28222
aaagttgcgcctcttcgcctcacgctgtcccgcgggcccgcacgtcagcgacagccgcccgaggtttagctgttccgcctcaatcccttccgcgccgccggcgagcaagggcgaagagatctgcttcgcgggagcgggaccatggcggcggcggagcagggggcggacgccgtgaaggagaaggaggagcaggagcaggtggtgagcccgtgggaggtgtcggcggggaagggcggcatcgactacgacaagctcgtggaccagttcgggtgccagcgcctcgacgccgcgctcgtcgaccgcgtcgcgcgcctcaccggccgcccgccgcacgtcttcctccgccggggcctcttcttcgcccaccgggattttaacgagatactggaactgtatgagaagagggagaaattctacctgtacacggggagggggccctcgtcggaggcgctgcacctcggccacctcatccctttcatgttcaccaaatatctgcaggaggctttcaaggtgcccttagttatacagctaactgacgatgagaagttctactggaagaacttgactgttgaggaaagcaaaaggcttgctcgtgaaaatgctaaagacattatagcatgcggttttgatgttgacagaactttcattttcacggatttcggttatgtcggaggcgccttttatgaaaatatggccaaagttgccagatgtgtgacatacaataaggctgtaggaatatttggattctcacctgaggatcatataggaaagtgtagctttcctccagtgcaagcagttccatcctttccttcttcgtttccccatctctttgctggcaaggaccaactgcgctgccttatcccatgtgccattgaccaggatccttattttaggatgactcgtgatgttgctcccagaattggttatccgaaaccatcactgattgaatcaagatttttccctgctcttcagggggagaacacaaaaatgtcagccagtgacgcaaattccgcgatatatgttacagatagtgttaaagaaataaagacaaaggtgaataaatatgccttctcaggtggacaggactcgatagagctccacagaaaacttggagctaaccttgatgtggatgttccaatcaagtacttaaacttctttcttgaagatgatgacgagcttgagcacataaagaaggagtacaaggaaggaaggatgttgactggtgaagtgaagcagagactcatcgcagttctatctgagctggttgccaggcatcaaagagctagagctcaagtgactgatgagatggttgatgcattcatggcagtcaggccgctttcccaaaatgtttg

SEQ ID NO: 28222 - protein, 403 aa, Panicum virgatum
  misc_feature: Ceres CLONE 1882372
  misc_feature (86)..(376): Pfam Name: tRNA-synt_1b Pfam Description: tRNA synthetases class I (W and Y)
  misc_feature: SWISSPROT Homolog: EC 6.1.1.2 Tryptophan--tRNA ligase
MAAAEQGADAVKEKEEQEQVVSPWEVSAGKGGIDYDKLVDQFGCQRLDAALVDRVARLTGRPPHVFLRRGLFFAHRDFNEILELYEKREKFYLYTGRGPSSEALHLGHLIPFMFTKYLQEAFKVPLVIQLTDDEKFYWKNLTVEESKRLARENAKDIIACGFDVDRTFIFTDFGYVGGAFYENMAKVARCVTYNKAVGIFGFSPEDHIGKCSFPPVQAVPSFPSSFPHLFAGKDQLRCLIPCAIDQDPYFRMTRDVAPRIGYPKPSLIESRFFPALQGENTKMSASDANSAIYVTDSVKEIKTKVNKYAFSGGQDSIELHRKLGANLDVDVPIKYLNFFLEDDDELEHIKKEYKEGRMLTGEVKQRLIAVLSELVARHQRARAQVTDEMVDAFMAVRPLSQNV

SEQ ID NO: 28223 - DNA, 689 bp, Panicum virgatum
  misc_feature: Ceres CLONE 1882383
  misc_feature: Encodes the peptide sequence at SEQ ID NO. 28224
ccccgccccaccaacactcccaccatctctccactcgtccacagccaaatccgcctcccatccagcccacccacccacccaccaacgttccagtgagttcgagcgaggtaagcttagatctgagcgagttctcgcgcgtcgcaggtaaaagttcactcccgaccctcctcttcctccccttccttttgttttcttggtcttggtttcgtcttcatcgagcagactgcgggagacccggggccttttcgatcctgggcttcagatctgccatttcttcttcttccgtttgggtttcctgtagcagtctaggttgctagttcggtagccaagaggggttctttttccacacctcccttgtgcaagttcgtgtgcagatctgccaccagaggccacctgtttttactgcggccgctgggttctgcctgatttgttcttggttttgctagagagaaaaaaaacaaaaaaaagtttgtttcttcagatctgctatagtctagatggctgccgctatagatctgtccggggaggagctgatgagagcactcgagccttttatccgggatgcctctgctcctcgcgaatccagtccgcttctccagcaccaccaccctctgagccccacttcgcccttctccttccaccaccacgccgccgccgccgccgctgcctacggcgggtacccgttcgcg

SEQ ID NO: 28224 - protein, 63 aa, Panicum virgatum
  misc_feature: Ceres CLONE 1882383
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
MAAAIDLSGEELMRALEPFIRDASAPRESSPLLQHHHPLSPTSPFSFHHHAAAAAAAYGGYPF

SEQ ID NO: 28225 - DNA, 2269 bp, Panicum virgatum
  misc_feature: Ceres CLONE 1882390
  misc_feature: Encodes the peptide sequence at SEQ ID NO. 28226
gacgcctccctccctcttcttcttcctccatctcccaccccagcgcggcgtccccatcgagagcgagctacacgagctagcagctagcttgcaacaaccgcagcagctagctaatcagagctgtaaccaaagtgatcgtacaccgagctgctgcattcttgcacgctagctagctagctagacccgcccgtcctccaacaatggcgctccaggcatcgactccctccgtgttccgcgcggtcccggccaccgcccacgcctcctgccgccggcagttccaggtgcgcgcgagcgcggcggcccagagcgccggcggcagcagcagcgtcggcgccgacgggaagatggtggtccccaaggacaaggagccgatcaagccgagttcggccccgtggaaggtggacttctctggcgagaagccggcgacgccgctgctggacaaggtgagccacccggtgcacatgaagaacctcgccaccccggagctggagcagctggcggcggagctccgcgcggagatcgtgcacacggtgtcccagaccggcggccacctgagctccagcctcggcgtggtggagctcgccgtggcgctccaccacgtgttcgacacccccgaggacaagatcatctgggacgtcggccaccaggcgtacccgcacaagatcctcaccgggcggcgctcccggatgcacaccatccggcagacctccgggctggcgggcttccccaagcgcgacgagagcgcgcacgacgcgttcggcgccggccacagctccaccagcatctcggcggggctgggcatggcggtggcgcgcgacctcctggggcgcaagaaccacgtcatctccgtcatcggcgacggcgccatgaccgccgggcaggcctacgaggccatgaacaactcgggctacctcgacaccaacatgatcgtcgtcctcaacgacaacaagcaggtgtccctccccaccgccacgctcgacgggccggccacgcccgtcggcgcgctcagccgcgcgctcaccaagatccagtccagcaccaagttccgccgcctccgcgaggccgccaagtccgtcacccggcagatcggcgggccggcgcacgaggtcgccgccaaggtcgacgagtacgcgcgcggcatgatcagcgcctcgggctcctccctcttcgaggagctcggcctctactacatcggccccgtcgacggccacaacgtcgaggacctcgtcgccatcttcgagaaggtcaagtcgatgccggcgccgggacccgtgctcatccacatcgtcacggagaagggcaaggggtacccgccggcggaggcggcggcggaccggatgcacggcgtcgtccgcttcgacccttcgacggggaagcagttcaagtccaaggccccgacgctgtcctacacgcagtacttcgccgaggcgctgattcgggaggcggaggccgacgccaaggtggtgggcatccacgccgccatgggcggcggcacggggctcaactacttccagaagcgcttcccggagcggtgcttcgacgtgggcatcgcggagcagcacgccgtgacgttcgcggcggggctcgccgccgaggggctcaagcccttctgcgccatctactcctccttcctccagcgcggctacgaccaggtggtgcacgacgtcgacctccagaagctcccggtgaggttcgccatggacagggccgggctagtcggcgccgacgggcccacgcactgcggcgccttcgacgtcgcctacatggcgtgcctccccaacatggtggtcatggcgcccgctgacgaggccgagctcatgcacatggtcgccaccgccgccgccatcgacgaccgccccagctgcttccgcttcccgcgcggcaacggcatcggcgccgtgctcccgccggggaacaaagggacgccgctcgaggtcggcaagggccgggtgctcgtcggcggcacccgggtggcgctgctcggctacggcaccatggtgcaggcctgcctcaaggccgccgaggcgctcaaggagcacgacgtgtacgtgaccgtggccgacgcccgcttctgcaagccgctcgacacggagctcgtcagggacctcgccgccgagcacgaggtgctcatcaccgccgaggagggctccatcggcggcttcggctcccacgtcgcgcactacctcagcctcgccggcctcctcgacggcaacctcaaactgagatccatgttcctgccggaccggtacatcgaccacggcgcaccgca

SEQ ID NO: 28226 - protein, 689 aa, Panicum virgatum
  misc_feature: Ceres CLONE 1882390
  misc_feature (399)..(565): Pfam Name: Transket_pyr Pfam Description: Transketolase, pyrimidine binding domain
  misc_feature (580)..(689): Pfam Name: Transketolase_C Pfam Description: Transketolase, C-terminal domain
  misc_feature: SWISSPROT Homolog: EC 2.2.1.7 1-deoxy-D-xylulose-5-phosphate synthase
  misc_feature: The sequence is a functional homolog of SEQ ID NO 12 in US patent 7132250
MALQASTPSVFRAVPATAHASCRRQFQVRASAAAQSAGGSSSVGADGKMVVPKDKEPIKPSSAPWKVDFSGEKPATPLLDKVSHPVHMKNLATPELEQLAAELRAEIVHTVSQTGGHLSSSLGVVELAVALHHVFDTPEDKIIWDVGHQAYPHKILTGRRSRMHTIRQTSGLAGFPKRDESAHDAFGAGHSSTSISAGLGMAVARDLLGRKNHVISVIGDGAMTAGQAYEAMNNSGYLDTNMIVVLNDNKQVSLPTATLDGPATPVGALSRALTKIQSSTKFRRLREAAKSVTRQIGGPAHEVAAKVDEYARGMISASGSSLFEELGLYYIGPVDGHNVEDLVAIFEKVKSMPAPGPVLIHIVTEKGKGYPPAEAAADRMHGVVRFDPSTGKQFKSKAPTLSYTQYFAEALIREAEADAKVVGIHAAMGGGTGLNYFQKRFPERCFDVGIAEQHAVTFAAGLAAEGLKPFCAIYSSFLQRGYDQVVHDVDLQKLPVRFAMDRAGLVGADGPTHCGAFDVAYMACLPNMVVMAPADEAELMHMVATAAAIDDRPSCFRFPRGNGIGAVLPPGNKGTPLEVGKGRVLVGGTRVALLGYGTMVQACLKAAEALKEHDVYVTVADARFCKPLDTELVRDLAAEHEVLITAEEGSIGGFGSHVAHYLSLAGLLDGNLKLRSMFLPDRYIDHGAP

SEQ ID NO: 28227 - DNA, 129 bp, Panicum virgatum
  misc_feature: Ceres CLONE 1882390-R
caacgcgccgcaccaaacgcaagaggacaaggggggggggaaaccgacaaacgagggcaccgccaggcgcggagcccgggagcagggagcggggaggccacccccgcggccagcggcggaccggggaca

SEQ ID NO: 28228 - DNA, 1307 bp, Panicum virgatum
  misc_feature: Ceres CLONE 1882396
  misc_feature: Encodes the peptide sequence at SEQ ID NO. 28229
gatcgcaaattcaaatcgcccgaacggtcgaaccacgagctgttccccatccggcaatccctagcccccgatccagcaatccccctccatccgaagccccgagcgctcgcagatggcgccgcctgcgccgatgcagctcaaggtgcgcctcccggagaacgaggaggtcgcgcgcgccctccacgagaagcggctggcgatgagggagcagccgagcggtttcaaggagcacctcgaccgcacgttcggcaaagcctaccacaatgtctgcgctgccacggagcccatccggaccctcaaagacttctccaagatcaaaggtgtgggaccatggctcatacgttgtatgaaaggattctttgcagagtctagccaggatttatctcctgctaaacgtaatgtagcaggagagaatgggaagaaaccaaggggaccaaagcgttgtgtgccaaagaagaaaactgctgcttctggttctcctggaaaggaggctcctgccaacttaaactgtcagattgctctgtctcttcctccatgccaaggaacacttgatctgcaatcagctggtaaaatggattctgctgaatttaatgtgctagacaagaactctgtattaacggaccactctatactagctatgccacctcatcaatcaaacgaggagtttcttgaagcttatgaagttgttttgatactagatgatcgtgagaatttcgggtctcgttcgagaaaagttgcatcaagaaaagttgctgataacacatgttcacagtttaatgtatctgtagaggttaagcgtttgcctgtaggtgatggcatttggattgctcgtcataggaaatttcttacagagtatgttctggatttcattgttgaaaggaaaaatgttgcagatttaggtagctcaattagagacaacagatacaaagatcagaaatcacggctgcagaattgcgggctaaggaagctcatatatcttgttgaaggcgatccaaacactgcaaacggatcagtggcaagcattaaaacagcctgtttcacaactgagcttttcgaaggatttgatgttctgcggaccactgggtacactgatacccagagaacatatggctatcttacacaatcaataattgactactacagcacaaatttctgcagtcttgctaaaagtgatcgtatttgcccaacctatgatgagtttgagggaaactgccgtagccttcagaagaaaacagtgagcccaatatttgctctgcaacttatgcaggtgccacaagtaacagagaaagttgcgttggctgttatag

SEQ ID NO: 28229 - protein, 398 aa, Panicum virgatum
  misc_feature: Ceres CLONE 1882396
  misc_feature (192)..(294): Pfam Name: ERCC4 Pfam Description: ERCC4 domain
MAPPAPMQLKVRLPENEEVARALHEKRLAMREQPSGFKEHLDRTFGKAYHNVCAATEPIRTLKDFSKIKGVGPWLIRCMKGFFAESSQDLSPAKRNVAGENGKKPRGPKRCVPKKKTAASGSPGKEAPANLNCQIALSLPPCQGTLDLQSAGKMDSAEFNVLDKNSVLTDHSILAMPPHQSNEEFLEAYEVVLILDDRENFGSRSRKVASRKVADNTCSQFNVSVEVKRLPVGDGIWIARHRKFLTEYVLDFIVERKNVADLGSSIRDNRYKDQKSRLQNCGLRKLIYLVEGDPNTANGSVASIKTACFTTELFEGFDVLRTTGYTDTQRTYGYLTQSIIDYYSTNFCSLAKSDRICPTYDEFEGNCRSLQKKTVSPIFALQLMQVPQVTEKVALAVI

SEQ ID NO: 28230 - DNA, 273 bp, Panicum virgatum
  misc_feature: Ceres CLONE 1882403
  misc_feature: Encodes the peptide sequence at SEQ ID NO. 28231
ataccatatccatcttcaattctccatccatcaagtgaagttcagcgcaaatcaccccgatgccgagcatggcggcgccattgctctgcctggcgctgctcctggcgtccggcgccgccgccggcgcccaagctctcaaagactacccacaggtaaagttcagcaccgcgtcggcgacgccggagaagtacaacacctttatcgccgctgtccgcgccgcgctggtgagcaaagctggggggaagagcaacgggatccccgtgctggtcgaac

SEQ ID NO: 28231 - protein, 71 aa, Panicum virgatum
  misc_feature: Ceres CLONE 1882403
  misc_feature: SWISSPROT Homolog: EC 3.2.2.22 rRNA N-glycosylase
MPSMAAPLLCLALLLASGAAAGAQALKDYPQVKFSTASATPEKYNTFIAAVRAALVSKAGGKSNGIPVLVE

SEQ ID NO: 28232 - DNA, 1139 bp, Panicum virgatum
  misc_feature: Ceres CLONE 1882405
  misc_feature: Encodes the peptide sequence at SEQ ID NO. 28233
actcaccaatccattccacccccgttcaccccgtccatttgatttgcgtttagtgcgttgcgtttcttgggtttctcctagttcggaaggagcacctccttcctctggcactcctgttctccgctcggagaaaggcttgaggacccaagaagaggataataatgggggaagctgccggcgaccgcgtcctgagccgcctccacagcgtcagggagcgcatcggtgactccctatctgctcaccccaatgagctcgtcgctgtcttcaccaggctgaaaaaccttggaaagggcatgctgcagccccaccaggtcattgctgagtacaacagcgctatccctgaggctgagcgcgagaagctgaaggatggtgcctttgaggacgtcctgagggcagctcaggaagctattgttatccccccatgggttgcactcgccatccgccctaggcctggtgtctgggagtatgtgagggtcaatgtcagcgagctcgcggttgaggagctgcgagtccctgagtacctgcagttcaaggaacagcttgtggaagaaggccccaacaacaactttgttcttgagctggacttcgagccattcaatgcatccttcccccgtccttctctgtccaagtccattggcaatggtgtgcagttcctcaacaggcacctgtcgtcaaagctcttccatgacaaggagagcatgtaccccctgctcaacttccttcgcgcccacaactacaaggggatgaccatgatgttgaacgacagaatccgcagcctcagtgctctccaaggtgctctgaggaaggctgaggagcatctgtccagccttccagctgataccccatactctgacttccaccacagattccaggagcttggtctggagaagggttggggtgactgcgctaagcgtgcgcaggagactattcacctcctcttggaccttcttgaggccccagatccgtccaccctggagaagttccttgggaccatccccatggtgttcaatgttgttatcctctccccccatggttacttcgctcaagctaatgtcttgggttaccctgacactggaggccaggttgtctacattttggatcaagtccgcgctatggagaatgaaatgcttctgaggatc

SEQ ID NO: 28233 - protein, 325 aa, Panicum virgatum
  misc_feature: Ceres CLONE 1882405
  misc_feature (11)..(325): Pfam Name: Sucrose_synth Pfam Description: Sucrose synthase
  misc_feature: SWISSPROT Homolog: EC 2.4.1.13 Sucrose synthase
  misc_feature: Functional homolog of the protein sequence given in SEQ ID NO 50269
  misc_feature: Useful for making plants with altered carbohydrate content
  misc_feature: The sequence is a functional homolog of SEQ ID NO 12 in US patent 7091398
  misc_feature: Functional homolog of the protein sequence given in SEQ ID NO 50270
  misc_feature: Useful for making plants with altered cell wall content and/or composition
  misc_feature: The sequence is a functional homolog of SEQ ID NO 2 in US patent 7091398
MGEAAGDRVLSRLHSVRERIGDSLSAHPNELVAVFTRLKNLGKGMLQPHQVIAEYNSAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSSLPADTPYSDFHHRFQELGLEKGWGDCAKRAQETIHLLLDLLEAPDPSTLEKFLGTIPMVFNVVILSPHGYFAQANVLGYPDTGGQVVYILDQVRAMENEMLLR

SEQ ID NO: 28234 - DNA, 613 bp, Panicum virgatum
  misc_feature: Ceres CLONE 1882405-R
  misc_feature: Encodes the peptide sequence at SEQ ID NO. 28235
cactggagcaagatctcgcagggcgggctccagcgcatcgaggagaagtacacatggaagctctactcggagaggctgatgaccctgaccggcgtgtacgggttctggaagtacgtgtccaacctggagaggcgcgagacccggcggtacctggagatgctgtacgcgctcaagtaccgcaccatggccagcacggtgccgctggccgtggagggagagccctccagcaagtgaggtggcggggacgacctgaatgaaagaagcagggagcacttggagtcgtgtctttttcctgggtttccttccgcatttcctcccctgattcggggttcggaggccaaaaaaaaagagaagagtttgcttttcctaggcgggctttcttcaagaattaaggtcgatcttcttccattgatgtggggtgttgctgctagttttgagttgattcggtagttggggtgagtgagtctggtcgggatggatggggtgtgtcagtgtgcagttggtcatgggtgcccccttgtttcctgggtggatggatggatgttgctccttgaataaacgcagcggccttggcgccgtttctgaaataagagtagcatgccatgcctctctc

SEQ ID NO: 28235 - protein, 77 aa, Panicum virgatum
  misc_feature: Ceres CLONE 1882405-R
  misc_feature: SWISSPROT Homolog: EC 2.4.1.13 Sucrose synthase
  misc_feature: Functional homolog of the protein sequence given in SEQ ID NO 50269
  misc_feature: Useful for making plants with altered carbohydrate content
  misc_feature: Functional homolog of the protein sequence given in SEQ ID NO 50271
  misc_feature: Useful for making plants with altered cell wall content and/or composition
  misc_feature: The sequence is a functional homolog of SEQ ID NO 2 in US patent 7091398
  misc_feature: The sequence is a functional homolog of SEQ ID NO 12 in US patent 7091398
HWSKISQGGLQRIEEKYTWKLYSERLMTLTGVYGFWKYVSNLERRETRRYLEMLYALKYRTMASTVPLAVEGEPSSK

SEQ ID NO: 28236 - DNA, 239 bp, Panicum virgatum
  misc_feature: Ceres CLONE 1882415
  misc_feature: Encodes the peptide sequence at SEQ ID NO. 28237
gacgacgatccggacgccctactggcacgtgaggggagagtgcctgagcgagaaccccaacatgtttccctacaaggcgccgcctctggacgcgcggcgagaggtcgtggagatggaggtgcccaagctcggcggggaggaggcacacaaggcgatggaggagtggtgcccgtcacggtcctagatcacgcgcctcgtcacctgcatggccgcctgcgacgacatgggcggcgcccacc

SEQ ID NO: 28237 - protein, 60 aa, Panicum virgatum
  misc_feature: Ceres CLONE 1882415
  misc_feature: SWISSPROT Homolog: EC 2.3.1.74 Naringenin-chalcone synthase
TTIRTPYWHVRGECLSENPNMFPYKAPPLDARREVVEMEVPKLGGEEAHKAMEEWCPSRS

SEQ ID NO: 28238 - DNA, 1305 bp, Panicum virgatum
  misc_feature: Ceres CLONE 1882421
  misc_feature: Encodes the peptide sequence at SEQ ID NO. 28239
aatacccgttgcccactccctccaatctctccatcacccaatttcgcgtcggcttcttcctcctacgccgcaagagagaaagccgaacgtctcttgaattcatacctgctcgcacgcgcgtgcacgtgcacagctggcagcgacagctacagcgccgtcttccatggcggcgagctaccggcaggccctgacccttgcggccgctctggtggcggcggcggtcgccgggctgccggcggcgggagcgctcggggtgaactggggcacgatagcgacgcaccggctgccgtcgggcatcgtggtgcggatgctggaggacaacggcatcaggaaggtgaagctgttcgacgccgaccccgggccgatggacgcgctcgccggcagcggcatcgaggtgatggtgggcatccccaacaacatgctggacatgatgacggactacggcacggccagggactgggtgaaccagaacgtcagccgctacaacttcgacggcggcgtgaacatcaaatacgtagccgttgggaatgagcctttcctgtcgtctttcaacggcacgttcctgaacgtgacgctgcccgccctgcagaacatccagcgcgcgctcaacgacgccggcctcggcgaaaccatcaaggccaccgtgccgctgaacgccgacgtgtacaactccccggcgagcaaccccgtcccgtctgccggccgcttccgcgccgacatcgccgacctcatgacggagatcgtgcagttcctcaaccagagcggcgcgcccttcaccgtcaacacctacccgttcctgagcctgtacggcaacgacggcttcccgctggactacgccttcttcgacggcacgagcagccccgtggtggacgccggcagcggcatccagtacacgaacgtgttcgacgccaacttcgacacgctcgtgtcggcgctcggcgcggcgggcgtcggcggcctccccgtcgtggtcggcgaggtcgggtggccgaccgacggcgacaagcacgccaccgcggcgtacgcgcagaagttctacgcggggctgctgcggaagctggcggccagggccggcacgccgctgcgccccaaccagtacatcgaggtgtacctgttcggcctcatcgacgaggacgccaagagcgtggcgccgggcaacttcgagcggcactggggcatcgtgcgctacgacggccagcccaagtacccgatggacctgtccggcgggcagggcgggaacgcggcggcgctggtggcggcgcgcggggtgcagtacctgccccggcagtggtgcttggtgaaccc

SEQ ID NO: 28239 - protein, 380 aa, Panicum virgatum
  misc_feature: Ceres CLONE 1882421
  misc_feature (29)..(352): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Functional homolog of the protein sequence given in SEQ ID NO 51176
  misc_feature: Useful for making plants with altered carbohydrate content
  misc_feature: Functional homolog of the protein sequence given in SEQ ID NO 51240
  misc_feature: Useful for making plants with altered cell wall content and/or composition
MAASYRQALTLAAALVAAAVAGLPAAGALGVNWGTIATHRLPSGIVVRMLEDNGIRKVKLFDADPGPMDALAGSGIEVMVGIPNNMLDMMTDYGTARDWVNQNVSRYNFDGGVNIKYVAVGNEPFLSSFNGTFLNVTLPALQNIQRALNDAGLGETIKATVPLNADVYNSPASNPVPSAGRFRADIADLMTEIVQFLNQSGAPFTVNTYPFLSLYGNDGFPLDYAFFDGTSSPVVDAGSGIQYTNVFDANFDTLVSALGAAGVGGLPVVVGEVGWPTDGDKHATAAYAQKFYAGLLRKLAARAGTPLRPNQYIEVYLFGLIDEDAKSVAPGNFERHWGIVRYDGQPKYPMDLSGGQGGNAAALVAARGVQYLPRQWCLVN

SEQ ID NO: 28240 - DNA, 489 bp, Panicum virgatum
  misc_feature: Ceres CLONE 1882453
  misc_feature: Encodes the peptide sequence at SEQ ID NO. 28241
atcttctgttggaaagctgtttgaggagtttgtgcacattagtctcctgctctgttctcccggaaccatggctgttgtggagctcaaggttggaatgcactgcgaaaggtgcatcaaagcgattaagaaggctataaaaacaatcgatgatatggagagctatcaactagagacggagacgaacaaggtcacggtgacagggaacgtgaccccggaggaagtcgtcaaggctctccacaagattggtaagacggcaacctgctggacggaagattgagaactgatggttttctcagccccactctgacagtcagttagctatcaagttcctacctggactcctggagatgctacttactactggtaacttgagctaatagtctactagctaattactagcgagtagtattagttaatctgctttcctagcttgtgtaccaggatgtttgtacgctgcagctattctagaaataaacagggaccagtttt

SEQ ID NO: 28241 - protein, 69 aa, Panicum virgatum
  misc_feature: Ceres CLONE 1882453
  misc_feature (5)..(65): Pfam Name: HMA Pfam Description: Heavy-metal-associated domain
MAVVELKVGMHCERCIKAIKKAIKTIDDMESYQLETETNKVTVTGNVTPEEVVKALHKIGKTATCWTED

SEQ ID NO: 28242 - DNA, 634 bp, Panicum virgatum
  misc_feature: Ceres CLONE 1882508
  misc_feature: Encodes the peptide sequence at SEQ ID NO. 28243
acgccgcagcagcagctcgcgttcgcaatccaatccgccgaaccctccccgcctcctcgcgccgcccgtccgccgcccccgctccgatggcccgcacgaagcagacggcgcgcaagtcgaccggcggcaaggcgccgaggaagcagctggccaccaaggccgcgcgcaagtcggcgccggccaccggcggcgtgaagaagccgcaccgcttccgccccggcaccgtcgcgctccgggagatccgcaagtaccagaagagcacggagctgctcatccggaagctccccttccagcgcctcgtccgggagatcgcgcaggacttcaagacggacctccggttccagtcctccgccgtcgccgcgctgcaggaggccgcggaggcgtacctggtggggctcttcgaggacaccaacctgtgcgccatccacgccaagcgcgtcaccatcatgcccaaggacatccagctcgcgcgccgcatcaggggcgagagggcctgagcgccgagcctctgctgctgcactgtcgtcgtagcgctagaattagatggggggatttgtttcttgccgtgcttatcttgtagtcagattctggtccggttggacttgctgcaatggaacacgattgctagtttctc

SEQ ID NO: 28243 - protein, 136 aa, Panicum virgatum; identical to SEQ ID NO: 10238
  misc_feature: Ceres CLONE 1882508
  misc_feature (58)..(132): Pfam Name: Histone Pfam Description: Core histone H2A/H2B/H3/H4

SEQ ID NO: 28244 - DNA, 555 bp, Panicum virgatum
  misc_feature: Ceres CLONE 1882525
  misc_feature: Encodes the peptide sequence at SEQ ID NO. 28245
agttcaccaccagcgaagatctcgtattctcgtgcccgccgcgccctcattccccgcaggccgcagcaagcagatcgccttccagaaccttctcgccgccgtcgtagccgaagcaatggccggattcggatcgaaggccctcgccgtggtcgccgtcctggcggctgccgccctctccgtggcctccgctgccgacgcgccggcgcccagccccgtctccgccgccggcgccgcggccccgcccttcgccgccgccctcgtggcctccgccgccgccgtcctcttcgccgccgtccgccactgagcccgcggatgggcagtaccgctaccgccgcctagatctatttactttattagagatggatttcttccttgggtgctcgtgtcgtcgtcgtattttggtcggatctgggatgtgtttctaccgcgtcgtggtgtgtcgggttgcgtgatcccccttgtagatagtctgctatctcgttcgtgtgtgggatggttcggtctggttgctactgatattatcaatattattatctgtcccatttgagatgatgg

SEQ ID NO: 28245 - protein, 62 aa, Panicum virgatum
  misc_feature: Ceres CLONE 1882525
  misc_feature: Functional homolog of the protein sequence given in SEQ ID NO 50452
  misc_feature: Useful for making plants with altered carbohydrate content
MAGFGSKALAVVAVLAAAALSVASAADAPAPSPVSAAGAAAPPFAAALVASAAAVLFAAVRH

SEQ ID NO: 28246 - DNA, 676 bp, Panicum virgatum
  misc_feature: Ceres CLONE 1882552
  misc_feature: Encodes the peptide sequence at SEQ ID NO. 28247
atcccttgctacctgcatctatcgaccttgcattggcgagctcacagttcaatcaggtccggttcagcttcaggccgagctcgtcgtcaccgaggagatggcgctctctcaccgcatggccgcgcccgtcctcgtcttcctgctgctcctcgtcgccacagagatggggccggcgacggtggcggaggcgaggcactgcctgtcgcagagccaccacttcaagggcctgtgcgtgagcagcagcaactgcgccaacgtctgcaagaccgagaacttccccggcggcgagtgcaagacggagggcgccacccgcaagtgcttctgcaagaggatctgctagccgcccccgcccccgccccggcactgcactggtcctcccgccgttgttcgtgtgttcttccttctgttcgtcggttcctcatgcgcgcacgctgcgccgtgaacgctgtagcgggctgtgttcctctcgatcgtcttgttctcttttcctggaataaatttgagctcggtggcggtgctggtgatgccgaggtgtgcgatgcctgtgcgtgtggatcatctcgctgttgttctgcatccgtatgcactccattattagtgtactcctagtcgtaggcaaggtgatgtaaggtcctcctttcaacattgatgtaataatgcaatgcagtttcgtgct

SEQ ID NO: 28247 - protein, 80 aa, Panicum virgatum
  misc_feature: Ceres CLONE 1882552
  misc_feature (32)..(80): Pfam Name: Gamma-thionin Pfam Description: Gamma-thionin family
MALSHRMAAPVLVFLLLLVATEMGPATVAEARHCLSQSHHFKGLCVSSSNCANVCKTENFPGGECKTEGATRKCFCKRIC

SEQ ID NO: 28248 - DNA, 628 bp, Panicum virgatum
  misc_feature: Ceres CLONE 1882558
  misc_feature: Encodes the peptide sequence at SEQ ID NO. 28249
aaataattccggcacacgaatttcttcggttcctcctcctcgcgcttctccccttccccgagtaaccagcagcagcggcggcgccatggccaccgcctcctccctcttcctcgcctcgtcccccatctccaccgcgccgcgaacccgcaccggccccgcggcgtcctgccctcccgccgcccggccgtccctgcgcctccggcagaggccgtccccggccgtcgcggccgccgtgcaggccgagcaccggcccgccgtggccgcagcgccgaagccgcccgcgctcccggtccgcgtcggacacgggtttgacctccaccgcctcgaaccgaacctcccgctcatcatcggaggcatccacatcccccacgaacgtggctgccaggccgactccgacggggacgtgctgctgctctgcgtggtggacgcgattctcggagcgctggggctgccacacatcgggcaaatcttcccagactcagacctacggtggaagggtgccgattcatccctgttgctgaggcaagctgtaaaattgatgcatgagacgcgtgatgagcggggcaagcgtgaggctacgatgatcttgcaaaaactctaactcagtccatttaaggagactatccca

SEQ ID NO: 28249 - protein, 171 aa, Panicum virgatum
  misc_feature: Ceres CLONE 1882558
  misc_feature (69)..(171): Pfam Name: YgbB Pfam Description: YgbB family
  misc_feature: SWISSPROT Homolog: EC 4.6.1.12 2-C-methyl-D-erythritol 2,4-cyclodiphosphate synthase
MATASSLFLASSPISTAPRTRTGPAASCPPAARPSLRLRQRPSPAVAAAVQAEHRPAVAAAPKPPALPVRVGHGFDLHRLEPNLPLIIGGIHIPHERGCQADSDGDVLLLCVVDAILGALGLPHIGQIFPDSDLRWKGADSSLLLRQAVKLMHETRDERGKREATMILQKL

SEQ ID NO: 28250 - DNA, 522 bp, Panicum virgatum
  misc_feature: Ceres CLONE 1882562
  misc_feature: Encodes the peptide sequence at SEQ ID NO. 28251
gttccagcaaccagccatcatcttcctctttctaccgatcgatccatttctgagatcagtagtagtgggaagcagagcaagcaatggagctcccccggaagctcttctcggccgtcctcctcgtgctgctgctgctcgtggccacagaggttggcgggccggtgggcgtggcggaggcgcgcacgtgcctgtcgcagagccacaggttccggggcccctgcgtgcgccgggccaactgcgccaacgtctgcaggacggagggcttccccgacggcaagtgccgcggcttccgccgccgctgcttctgcaccacgcactgccgggagtgatatgtatcatcgagccaggggatcggatctatcggagatgccgcccgcccgtgcgtgtcttccttttaattctgctgccgccgcttgccggtgttgaataatcggcggcctagtagtgtgcccgtgtgtctctcttttttttaattgcaccgctctgtttagtaatgatgaaagttttgatttttttttcctc

SEQ ID NO: 28251 - protein, 81 aa, Panicum virgatum
  misc_feature: Ceres CLONE 1882562
  misc_feature (33)..(79): Pfam Name: Gamma-thionin Pfam Description: Gamma-thionin family
MELPRKLFSAVLLVLLLLVATEVGGPVGVAEARTCLSQSHRFRGPCVRRANCANVCRTEGFPDGKCRGFRRRCFCTTHCRE

SEQ ID NO: 28252 - DNA, 670 bp, Panicum virgatum
  misc_feature: Ceres CLONE 1882580
  misc_feature: Encodes the peptide sequence at SEQ ID NO. 28253
gcgagcgcatctcgcacttcgcgaaccacctcctcgtggtggcgctcgacggcggcgccctcgagcggtgccgcgccgtgcacccgcactgctacctcctccccgcggccaccggccgcaacctctccgacgagaaggtgttcatgagcaaggactacatcgacctggtgtggagcaaggtccggctgcagcagaggatcctcgagctcggatacaacttcctcttcacggacgtggacattctatggttccgcaacccgttcgagcggatgtcggtggcggcgcacatggtgacctcgtcggacttcttcttcggcgacccgtacagcccgatgaacctcccgaacacggggttcctgtacgccaagtcgagccggcgcacggtgggcgcgttcgaggcgtggcggcgggcgcgcgagtcgttcccggggaagcacgagcagcaggtgctgaacgagatcaaggtggagctggtggccacgcggggcctgcgcatccagttcctggacacggaccacaacgccgggttctgcaacaacacccgcgacttcaacacgctctacaccatgcacgccaactgctgcgtcgggctcggcgccaagctccacgacctcggcaacctgctgcgggagtggcgcgcgtaccggagcatggacgaaggggagcgcag

SEQ ID NO: 28253 - protein, 222 aa, Panicum virgatum
  misc_feature: Ceres CLONE 1882580
  misc_feature: Functional homolog of the protein sequence given in SEQ ID NO 50676
  misc_feature: Useful for making plants with altered carbohydrate content
ERISHFANHLLVVALDGGALERCRAVHPHCYLLPAATGRNLSDEKVFMSKDYIDLVWSKVRLQQRILELGYNFLFTDVDILWFRNPFERMSVAAHMVTSSDFFFGDPYSPMNLPNTGFLYAKSSRRTVGAFEAWRRARESFPGKHEQQVLNEIKVELVATRGLRIQFLDTDHNAGFCNNTRDFNTLYTMHANCCVGLGAKLHDLGNLLREWRAYRSMDEGER

SEQ ID NO: 28254 - DNA, 1007 bp, Panicum virgatum
  misc_feature: Ceres CLONE 1882583
  misc_feature: Encodes the peptide sequence at SEQ ID NO. 28255
ggagacggagacggagacggaggaagaagacgcgtagagacagggaagggagcatggcgagcgtcaagcagggcggcgacgcggcgaagggcgcgggaggcggagggggcctcgggatgccggcggcggaggtggagcaggtgttccggcgctacgacgccaacggcgacggcaagatctcggcggaggagctggcgtccgtgctgcgggcgctgggcgcgccgccggggcccggggaggtgcgccgcatgatggacgagatggacaccgaccgcgacggcttcgtcgacctcgccgagttcgtcgccttccactgcgccgcccggccggagggggaggacgaggacggcggcgccgcggaggccgagctgcgcgaggccttccgcatgtacgacgccgaccgcaacggcctcatctccgcgcgggagctccaccgcgtcctgcgccagctcggggacaagtgctccgtcgccgactgctcccggatgatccgctccgtcgacgccgacggcgacggcagcgtcaacttcgacgagttcaagaagatgatgggcgccggcaccggagccaggcgctagctaagccgccggagcctgactccgatccattccccaccaccaaaggtttaactggtcctcccttgatgtatgcgtggtttatctgcttattagctgattattaatcaagcatgattagtttctactacttactaaggtgaagtgagtagcctgcctgcatccatccagctgaacagccttggaattggatcttaggcctccttttactgtagtactccaccgggcaaagcacggttttggaggcactgatctgattttatggtgaacagcggaggtgatgttgtcgtgtaaaggtgtgatgacctgctactgcttttctgtctgcctgctcctatattatgatgatgtaatctactgattgactaatccctgctgtcgctaaacggctaaaggaggctccaacttttaatccctttgtttgattttgtt

SEQ ID NO: 28255 - protein, 174 aa, Panicum virgatum
  misc_feature: Ceres CLONE 1882583
  misc_feature (26)..(54): Pfam Name: efhand Pfam Description: EF hand
  misc_feature (105)..(133): Pfam Name: efhand Pfam Description: EF hand
  misc_feature (141)..(169): Pfam Name: efhand Pfam Description: EF hand
  misc_feature (62)..(90): Pfam Name: efhand Pfam Description: EF hand
  misc_feature: SWISSPROT Homolog: EC 2.7.11.1 Non-specific serine/threonine protein kinase
MASVKQGGDAAKGAGGGGGLGMPAAEVEQVFRRYDANGDGKISAEELASVLRALGAPPGPGEVRRMMDEMDTDRDGFVDLAEFVAFHCAARPEGEDEDGGAAEAELREAFRMYDADRNGLISARELHRVLRQLGDKCSVADCSRMIRSVDADGDGSVNFDEFKKMMGAGTGARR

SEQ ID NO: 28256 - DNA, 670 bp, Panicum virgatum
  misc_feature: Ceres CLONE 1882587
  misc_feature: Encodes the peptide sequence at SEQ ID NO. 28257
gcgactggggactggggtcataaactagcacgattccctcgcttcaccgccgtgccgtgcccgtggccgaacaaaccaaccacaccacaaccagcgaggcagcaagccgacaggcaagcagaccagcaaccgcaccgggcgggcggagcaggcgacgagcgagatgggttccttcttctcgaccatgttcacgccgccgcccgcgggcgacgaccccaactccgccgtggtcgccgcgcactccaaggccgcctacgaccagcagtgggaggccgccaagagcagcggcaagctggtggtgatcgacttctcggcgtcctggtgcgggccctgccgcttcatcgagccggccttcaaggagatggcctcccgctacaccgacgtcgtcttcgtcaagatcgacgtcgacgagctcgcggatgtggcaaggacatggaaggtagaggcgatgcctacattcgtactagccaagggtgggaaggaggtgagccgtgtggttggggcgaaaaaggacgagctcgagaggaagatcggcatgttccgatcatcttagtcatactaactcaacaatgcatgcaatcccatgttgaaatggtgggggagtcctgtggtttgcccaggttgaaatgccatgtcgttctcttctctgaatgctgcagaatttatgtga

SEQ ID NO: 28257 - protein, 129 aa, Panicum virgatum
  misc_feature: Ceres CLONE 1882587
  misc_feature (22)..(123): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Functional homolog of the protein sequence given in SEQ ID NO 50138
  misc_feature: Useful for making plants with modulated nitrogen use efficiency
MGSFFSTMFTPPPAGDDPNSAVVAAHSKAAYDQQWEAAKSSGKLVVIDFSASWCGPCRFIEPAFKEMASRYTDVVFVKIDVDELADVARTWKVEAMPTFVLAKGGKEVSRVVGAKKDELERKIGMFRSS

SEQ ID NO: 28258 - DNA, 686 bp, Panicum virgatum
  misc_feature: Ceres CLONE 1882596
  misc_feature: Encodes the peptide sequence at SEQ ID NO. 28259
acaagctctgctccattccccattccagttccccacactcgccccgctccccgattcccgacgacgagctcggagctccccccctccccagttcggtgctcgccgcgacaaccgcagccatggccgccgccaaccagctgaccgccctcctcaacaacatgtacgccacgggtttgctggatgagcaattccagcagctgcagatgctccaggacgccagctcccctgacttcgtctccgaggtcatcaccctcttctgcgaggacggcgacaggatcatcagcgagctcgccaagctgctggagaagcccagcgtggattttgacagggtcgacgcatatgtgcatcagctcaaggggagcagtgcaagatgcctcaaaacactggactcagtaaggactgagttttatgatctacgtggcaagttccagaccatgctgcagctgcaaaggcagctccatggcttctaccccaagtaaaccagagttggggagtggagctgcatgtcgggatgatgcttacacctctcaagtttcaagaacatgccgattgcgctcctcagttggcttctgtgaagcctgcaataacgtagctgcgagattagcgctgacacctttgtcgtcatcatcctagtatcatccgtgtcaggtgatccatgttcctgcaaccagtcgcaggtcatatgg

SEQ ID NO: 28259 - protein, 119 aa, Panicum virgatum
  misc_feature: Ceres CLONE 1882596
  misc_feature: SWISSPROT Homolog: EC 2.7.1.24 Dephospho-CoA kinase
MAAANQLTALLNNMYATGLLDEQFQQLQMLQDASSPDFVSEVITLFCEDGDRIISELAKLLEKPSVDFDRVDAYVHQLKGSSARCLKTLDSVRTEFYDLRGKFQTMLQLQRQLHGFYPK

SEQ ID NO: 28260 - DNA, 643 bp, Panicum virgatum
  misc_feature: Ceres CLONE 1882606
  misc_feature: Encodes the peptide sequence at SEQ ID NO. 28261
accccccccccccgccgctcgcattccccatcccaggttcccatccgccgagccctccccgcctcgtcgcgccccccgtccacggccccgctccgatggcccgcacgaagcagacggcgcctaagtcgaccggcggcaaggcgcccaggaagcagctggccccccaggccgcccgcaagtcggcgccggcccccggcggcgtgaagaagccgccccggttccgccccggcaccgtcgcgctccgcgagatccgcaagtaccagaagagcacggagctgctcatccgcaagctccccttccagcgcttggtgcgggagatcgcgcaggacttcaagacggacctccggttccagtcgtcggcggtggcggcgctgcaggaggccgcggaggcgtacctggtggggctcttcgaggacaccaacctgtgcgctatccacgccaagcgcgtcaccatcatgcccaaggacatccagctcgcgcgccgcatcaggggtgagagggcctgagcgccgggcttctgcttctgcattgtcgtcgtagcgatagaattggattgggggaattttttttcttgccgtgctatcctgtagtcagattctgaatgggttcgactccttgcaatggaacgtgattgctagtttcc

SEQ ID NO: 28261 - protein, 136 aa, Panicum virgatum
  misc_feature: Ceres CLONE 1882606
  misc_feature (58)..(132): Pfam Name: Histone Pfam Description: Core histone H2A/H2B/H3/H4
MARTKQTAPKSTGGKAPRKQLAPQAARKSAPAPGGVKKPPRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 28262 - DNA, 526 bp, Panicum virgatum
  misc_feature: Ceres CLONE 1882662
  misc_feature: Encodes the peptide sequence at SEQ ID NO. 28263
gagtcgataagatcgagctcggggaggttggggcgcaggaaaaaaaaatcatctacaatctccaaccaaactaaccctagcagcagccggcggttagggtttcgagcgagacggcggcggcggctgctttaagtgcggggagcctggccacatggccagggactgctccagcggcggaggaggctatggaggtggcggctacggaggaggcggcggcggtgcctgctacaactgcggccagaccggccacatggcgagggactgcggctccggcggcggcggcggcggccgcttcggaggtggcggcggcggcggcggcgaccgctcctgctacaactgcgaccagagcggccacatggcgagggactgcaccgcgtgagatcgggccggatcacgccacgccactacccggtggtgtagcctccccatagatctcgcctaagcctctcactgtgtctcgttcgtcggagcatcgctttagttttgccgatctgggcccgagcgcccgcctccttgctatagagga

SEQ ID NO: 28263 - protein, 75 aa, Panicum virgatum
  misc_feature: Ceres CLONE 1882662
  misc_feature (23)..(40): Pfam Name: zf-CCHC Pfam Description: Zinc knuckle
  misc_feature (58)..(75): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 468 in the 11/479,226 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50142
  misc_feature: Useful for making plants with altered lignin content
  misc_feature: Functional homolog of the protein sequence given in SEQ ID NO 50210
  misc_feature: Useful for making plants with modulated biomass
MARDCSSGGGGYGGGGYGGGGGGACYNCGQTGHMARDCGSGGGGGGRFGGGGGGGGDRSCYNCDQSGHMARDCTA

SEQ ID NO: 28264 - DNA, 664 bp, Panicum virgatum
  misc_feature: Ceres CLONE 1882676
  misc_feature: Encodes the peptide sequence at SEQ ID NO. 28265
agatgcgcaaacaccggatcgccggactcgtggctgccctgctcgccctcgccctctccctctccctctcgtccctccgcaccgcgcaagaggagccgcccatggcggacagcgggcctctggcgggcggcgtcacggacgtgccgcagaacgaaaacgacatccacctacaggggctcgcccgcttcgccgtcgacgagcacaacaagaaggccaatgctctcctggggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggatatctcgtcttccacgtgcaattgctacctgaagcactaaacagacttgcagaataaggagctggttcggatgtataatagatgtgctgttacgagctccgttgtgtagtatcataagatcaccttgccctttgtgtaatatcatgaataacggtgtcctttgtgtaaaatcatgaattcagtgccctttatgtgtaacattataaataaataacagggctgagtattcatcagtacgactcgtgacggat

SEQ ID NO: 28265 - protein, 135 aa, Panicum virgatum
  misc_feature: Ceres CLONE 1882676
  misc_feature (42)..(130): Pfam Name: Cystatin Pfam Description: Cystatin domain
MRKHRIAGLVAALLALALSLSLSSLRTAQEEPPMADSGPLAGGVTDVPQNENDIHLQGLARFAVDEHNKKANALLGFEKLVKAKTQVVAGTMYYLTVEVKDGEAKKLYEAKVWEKPWENFKELQEFKPVEESASA

SEQ ID NO: 28266 - DNA, 657 bp, Panicum virgatum
  misc_feature: Ceres CLONE 1882682
  misc_feature: Encodes the peptide sequence at SEQ ID NO. 28267
gaccgacttgctctgcctttccccagcagagagagagagagagagaggaggaaggactgaggagaggagcgatggcgccgcggaagctgtacgggatgccactgtcggcgaacgtgatacgcgttgccaccgtgctcaacgagaagggcctcgacttcgagatcgtccccgtcgacctccgcaccggcgcccacaagaacccggaattcctcgccctcaaccctttcggccagatccctgcgctggaggacggagatgaagttctctacgagtcccgggcgatcaaccggtacatcgcttccaagtacaagtcggagggccccgacctcctcccgacgccgtcggcgaagctggaggtgtggctggaggttgagtcgcaccacttctaccccaacgtgtcgccgctggtgttccagctcctcgtcaagccgctcctgggcggcgccccggaccccgtggtggtcgacaagcacgcgcaccagctcgccaaggtgctcgacgtctacgaggcgcacctcgccggcaacaagtacctcttctgcctcagcaagacccccaaggcgggcctcgtcgacgagaggccccacgtcaaggcctggtgggaggacatcgccgcccgccccgccttcaagaagaccgtcgccgccatccccttgc

SEQ ID NO: 28267 - protein, 195 aa, Panicum virgatum
  misc_feature: Ceres CLONE 1882682
  misc_feature (2)..(77): Pfam Name: GST_N Pfam Description: Glutathione S-transferase, N-terminal domain
  misc_feature (105)..(184): Pfam Name: GST_C Pfam Description: Glutathione S-transferase, C-terminal domain
  misc_feature: SWISSPROT Homolog: EC 2.5.1.18 Glutathione transferase
MAPRKLYGMPLSANVIRVATVLNEKGLDFEIVPVDLRTGAHKNPEFLALNPFGQIPALEDGDEVLYESRAINRYIASKYKSEGPDLLPTPSAKLEVWLEVESHHFYPNVSPLVFQLLVKPLLGGAPDPVVVDKHAHQLAKVLDVYEAHLAGNKYLFCLSKTPKAGLVDERPHVKAWWEDIAARPAFKKTVAAIPL

SEQ ID NO: 28268 - DNA, 859 bp, Panicum virgatum
  misc_feature: Ceres CLONE 1882685
  misc_feature: Encodes the peptide sequence at SEQ ID NO. 28269
cgcaaaatccacagatcaatcagatgatgatgggacagccacaattgtctgctctaccatgcaagcgccaacgtgttgaccaatacgacaatccttatggacagcatatgacaggccatcagcaggaaacaacaatattcaatacagcaatgggacaatcttttgggcctaacttacacaatgagttttcttcttttggtgcgtctatgccctcctctcttcctaaagatgcaacaagcaccgtttatgttgacggtctccctaacaactgtacaagacgggaagttgcacatatctttcgccaatatatggggttccgcgaagtgcgattggtcaacaaagggtctagtagacatgcaatatgctttgttgattttgctactcctacgcatgcttttctcgctatgagaactcttcaaggttataagttcgacgaacaggatcctaattcacgcattttgaacctacagttctctcactctcctcgcatgagctcacatggtgggtactagtcactaaattgttctacaccatcctgttattttgacatggaaagcagcagccgatcttgcttctgtcagtcattagcatgaaagaacaactcagccgatcttgcttctgtctgccattagcatgaaagaacaactcgactgtgatttaggctttggcttataacactctgacgaacctacctatgttacaactgacaccagtacttgactgctgaaggttaccttactagttactatatgatattactatagttgctgtggcgcattgtaacagcaagtacgttacagtgaatttcaaactctttgagccacctggtagtattgatgctttgtgcttttgctggttc

SEQ ID NO: 28269 - protein, 169 aa, Panicum virgatum
  misc_feature: Ceres CLONE 1882685
  misc_feature (81)..(150): Pfam Name: RRM_1 Pfam Description: RNA recognition motif. (a.k.a. RRM, RBD, or RNP domain)
QNPQINQMMMGQPQLSALPCKRQRVDQYDNPYGQHMTGHQQETTIFNTAMGQSFGPNLHNEFSSFGASMPSSLPKDATSTVYVDGLPNNCTRREVAHIFRQYMGFREVRLVNKGSSRHAICFVDFATPTHAFLAMRTLQGYKFDEQDPNSRILNLQFSHSPRMSSHGGY

SEQ ID NO: 28270 - DNA, 540 bp, Panicum virgatum
  misc_feature: Ceres CLONE 1882701
  misc_feature: Encodes the peptide sequence at SEQ ID NO. 28271
acctcatcgatcgagccagccatccagccagtcgcctatcctcgcctgctgcgcgcgtctctctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccacagaggcccccgccccggcgcccgcctccgacgccgccgccgcggtgcccctcgccgcggcgtccctcgccgccgccgccttccgatacctcttctgctcgatccgccgcccgttccccgggggtcctgctgatatgatgattcgatctggcgggacatgagtctagcccgcgtggggaggatgtcggtgggcgtgtgaatgtacgaattccgctgcagtgggggaggtgtgccagctgtggctgcatgcaacgacgccccggtcgcgatggagccgatcctgcactcccaccgtttctggttcttgattagatcctttatttgattctttctatcct

SEQ ID NO: 28271 - protein, 78 aa, Panicum virgatum
  misc_feature: Ceres CLONE 1882701
  misc_feature: Functional homolog of the protein sequence given in SEQ ID NO 50390
  misc_feature: Useful for making plants with altered carbohydrate content
  misc_feature: Functional homolog of the protein sequence given in SEQ ID NO 50827
  misc_feature: Useful for making plants with altered cell wall content and/or composition
MAGLRMKLVAAAAVAAALVASAAAATEAPAPAPASDAAAAVPLAAASLAAAAFRYLFCSIRRPFPGGPADMMIRSGGT

SEQ ID NO: 28272 - DNA, 685 bp, Panicum virgatum
  misc_feature: Ceres CLONE 1882708
  misc_feature: Encodes the peptide sequence at SEQ ID NO. 28273
aaacggccaaacagccactcacactcctgccgctctgttataacgcacatcccgtctgcaccccgaggtcggcgaattgctctctcttccggtcttctctcgcacaagtcatggcgaagccgcaggttcttctctgcctcctaatcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtgtaagtttaatgtctgccttctcatctgtttccttatgttgcaatagattaataatggcagttgttctacatagaactaatgtagtgctttctttgaataattgtagcaactatattgtttcatttcacccattcagcacgacttgcttgtcataacctttgtcaattctttttttttgccaatttcatttaaaataacctttgtttgagttggaaaagtgggacatatacaatagagcattgtaatctattgatggtattaccattgagcagaactgttaattcacccagcctcctctgcataaagttcttatactgcttacaataattaccttctgggttatgctcactttctgtcatttttctgacagggaaaacttactgatggaacagtttttgat

SEQ ID NO: 28273 - protein, 109 aa, Panicum virgatum
  misc_feature: Ceres CLONE 1882708
  misc_feature: SWISSPROT Homolog: EC 5.2.1.8 Peptidylprolyl isomerase
MAKPQVLLCLLIAAAALLLVAAAKKSGDVTELQIGVKYKPESCSIQAHKGDRVKVHYRVSLMSAFSSVSLCCNRLIMAVVLHRTNVVLSLNNCSNYIVSFHPFSTTCLS

SEQ ID NO: 28274 - DNA, 446 bp, Panicum virgatum
  misc_feature: Ceres CLONE 1882710
  misc_feature: Encodes the peptide sequence at SEQ ID NO. 28275
agagaccgagacagcagcgcagtgcgcacgcccctcaccctaagcgcggctccgcaggagagcgaaaatggcgaccctttccatggtctccgtccccatcgcaccctcctccctttccctctccacccggggccgcagctcctccgtatccttccccgctcccaagaaaggagggattggtcccggcggcctgcggattgagtgcatccgtattggtggtgttgagattcccaaccacaggagggtggagtactcgctgcagtacatccatggcattgggcggtcacgctgccgtcagatccttttggacctcaatttacacaacaagatccccaaggacctctctgaggaggaggtcctcaccctccctaaggaggtcggcaactacatgattgagggaaaccctaaacctttcccttcctgtggcgattgataggatgaagaag

SEQ ID NO: 28275 - protein, 121 aa, Panicum virgatum
  misc_feature: Ceres CLONE 1882710
  misc_feature (48)..(118): Pfam Name: Ribosomal_S13 Pfam Description: Ribosomal protein S13/S18
MATLSMVSVPIAPSSLSLSTRGRSSSVSFPAPKKGGIGPGGLRIECIRIGGVEIPNHRRVEYSLQYIHGIGRSRCRQILLDLNLHNKIPKDLSEEEVLTLPKEVGNYMIEGNPKPFPSCGD

SEQ ID NO: 28276 - DNA, 689 bp, Panicum virgatum
  misc_feature: Ceres CLONE 1882713
  misc_feature: Encodes the peptide sequence at SEQ ID NO. 28277
accagaccgcgcgtcccgaggcggaggaggagaggggagggcaaaatggcggtggtgggcgtcctcgcgctgcagggctcctacaacgagcacctggccgcgctgcggaggatcgcggtgaggggcgtggaggtgcgaaagccggagcagctcctcggcctcgactccctcattatccccggcggcgagagcaccaccatggccaagctcgccaactgccacaacctggtgggtgggtcggtttgcttctgctctcctcctttgcctctttcttctttgtggttgattgcttcgtcgataacatcgctcgtgacttggttgattggcgaaatccaaggattggttgatgagttgggtgtgtgctctgctgatgtgcttctgcctttgttagtaagctgatgatggagttggaaatgaatcatgcttctgcagtgttgatggatgattgagattggatggaaaagcacaatttcagaacatgattgttgaaaggacgatgttctgggtgcaatttcttttagtacgagttataggctgcacttttttgaaattgattgacacaatgctgagcaattcgtttttggtctggctaggttaaatactgttattatctcacaatgcatgcaggtttttctcaatttgtcagggaaatagtggttccttgtattggtcacaaaagaaacaactgg

SEQ ID NO: 28277 - protein, 117 aa, Panicum virgatum
  misc_feature: Ceres CLONE 1882713
  misc_feature: Functional homolog of the protein sequence given in SEQ ID NO 51274
  misc_feature: Useful for making plants with modulated drought sensitivity
MAVVGVLALQGSYNEHLAALRRIAVRGVEVRKPEQLLGLDSLIIPGGESTTMAKLANCHNLVGGSVCFCSPPLPLSSLWLIASSITSLVTWLIGEIQGLVDELGVCSADVLLPLLVS

SEQ ID NO: 28278 - DNA, 830 bp, Panicum virgatum
  misc_feature: Ceres CLONE 1882725
  misc_feature: Encodes the peptide sequence at SEQ ID NO. 28279
gacagccctgggcccctccctccctctcccttccccttctctgtctctcatccctcgggtttcctccactggtggcgacgactgggcgagcgacggcgccattcgcccagccctttgccggcgacgagcatccaccaggagcggggaaaattattcaggagatccagtaaggaaaatgaacaagggaaagattttcaagttggctaagggatttagaggaagggcaaagaattgcataaggatagcaagggagagggttgagaaagccttgcagtattcctacagggacaggcgtaacaagaaaagggatatgcgatccctttggatcgagcgcatcaatgctggcacacgattgcacggggtgaattatgggaactttatgcatggattgatgaaggagaacatccaactcaacaggaaggtgctctcagagctgtcaatgcatgaaccttacagcttcaaggcgcttgttgatgtatcccgcacagcatttccagggaacagacctgtcaaaaaggagggtctagcagctatcctatgaatcaacatttctaacaagtcactgaattcatgacggttgttccttccttgcacttgagagttactactaaattttctagctacttagcttgtatacccagcaacctcatgtaattttgcattactagtatttatgctccctttggtacttactttgatagacagaactgaaacagcagcagcttgggctgcacattattgttatttgttgccccctgtctgttggcttgatcgagataatcctctatgtactgttgataaattctgcaatctaattggttctgtgacag

SEQ ID NO: 28279 - protein, 121 aa, Panicum virgatum
  misc_feature: Ceres CLONE 1882725
  misc_feature (5)..(98): Pfam Name: Ribosomal_L20 Pfam Description: Ribosomal protein L20
MNKGKIFKLAKGFRGRAKNCIRIARERVEKALQYSYRDRRNKKRDMRSLWIERINAGTRLHGVNYGNFMHGLMKENIQLNRKVLSELSMHEPYSFKALVDVSRTAFPGNRPVKKEGLAAIL

SEQ ID NO: 28280 - DNA, 712 bp, Panicum virgatum
  misc_feature: Ceres CLONE 1882772
  misc_feature: Encodes the peptide sequence at SEQ ID NO. 28281
tcgctcacactcccactcgccatttcccagctcaggcagagcttgctctccatcttcccgagagcggccaccacacacaccaccagcaggagcaagaaagcgaacgaaggaaggaaggaagcagagcgtcgcagcagcaggccgggagatcagaggcctccccccatggcgggagccgtgcccctggccgcgccgccggcgctcgcggcggcggggagcccgtacgaggcgctacgggtggggcgcgccgccacgcaggggagatcaaggccgcgtaccgcgccatggccaagcgcctccacccggacgccgcctgcgcgtccggggcggcggcggcgttcctggaaatccgccgcgcctacgagacgctgtcggacccggacgcccgggcgcgctacgaccgctcgctcggcacgaccgaccaccggccaggacagggcgtcggcggcgtgcgggtgcggcggtgggagacggaccagtgctggtagcaaccgtgaccgtgccgtggcaaagacgccccatcaaccctcggaacctctctgcagggtccagggggagagcgctttgcttttttttttgagaaaaaatatatactatacttgtacaatggtagtgcagggtccagttgtcagtcactcatcagcagggcccgcctgttggcgacacagcttttgtaaatattcgtcaatatagtagttccaggttactaatt

SEQ ID NO: 28281 - protein, 161 aa, Panicum virgatum
  misc_feature: Ceres CLONE 1882772
  misc_feature (85)..(133): Pfam Name: DnaJ Pfam Description: DnaJ domain
AHTPTRHFPAQAELALHLPESGHHTHHQQEQESERRKEGSRASQQQAGRSEASPHGGSRAPGRAAGARGGGEPVRGATGGARRHAGEIKAAYRAMAKRLHPDAACASGAAAAFLEIRRAYETLSDPDARARYDRSLGTTDHRPGQGVGGVRVRRWETDQCW

SEQ ID NO: 28282 - DNA, 538 bp, Panicum virgatum
  misc_feature: Ceres CLONE 1882808
  misc_feature: Encodes the peptide sequence at SEQ ID NO. 28283
cattgcaagtgaagccctgtcggccatcagaaaggatgtcctatcaaaatgctatggtggtgatataacaagaaaaaagaaattgctgaagaaacaggctgaaggaaagaagagaatgaaagcaatcggaagggttgatgttccccaagaagcattcatggctgtgttgaagctggaaaaggaggtgctatgaagtagctcatgtaatctttctgaagcctcctttctgctgtaaggatctcaacttggaagcaacacgcgattatactcaagagtccgagaggttgctttcaacttgccatgccctggactaaaggaaccaattgactatagatcagtgtcggagcgaaatcagctaacctgaaatttactgatatcgaatatcaggttatgaaggaaaaaaaaaggcgggacacaattttggcagacacatgtacgaaactcttgttgtaaaggtcattacgacacttcaattacttgtaatgctatactaagacatgctccacaatagaatgtatattcgcaaattgatatagca

SEQ ID NO: 28283 - protein, 63 aa, Panicum virgatum
  misc_feature: Ceres CLONE 1882808
  misc_feature (1)..(59): Pfam Name: LepA_C Pfam Description: GTP-binding protein LepA C-terminus
IASEALSAIRKDVLSKCYGGDITRKKKLLKKQAEGKKRMKAIGRVDVPQEAFMAVLKLEKEVL

SEQ ID NO: 28284 - DNA, 370 bp, Panicum virgatum
  misc_feature: Ceres CLONE 1882825
  misc_feature: Encodes the peptide sequence at SEQ ID NO. 28285
ctgctagtacgccgccgcgcacacctccgtcactcgccgaagcgtccaactgtgtgtgcattaacttgtgagtgctgagtggggtgtggtgcattggagtaagggggttcttccagctgcaatgccggcggcgccgcggagtgtgaaggagatggcggcggccgaggtggtcttggcggcaatgctgctctcttcggcggcggtggcggcggcgcagcacgactacggcgacgccctgcacaagtgcatcctcttcttcgagggccagcgctccgggaggctcccgccggaccagcgcgtccgctggcgccgcgactccgggctccacgacggcgccgccgccggggtggacctgaccggagggtactac

SEQ ID NO: 28285 - protein, 82 aa, Panicum virgatum
  misc_feature: Ceres CLONE 1882825
  misc_feature: SWISSPROT Homolog: EC 3.2.1.4 Cellulase
  misc_feature: Functional homolog of the protein sequence given in SEQ ID NO 51275
  misc_feature: Useful for making plants with altered carbohydrate content
  misc_feature: Functional homolog of the protein sequence given in SEQ ID NO 51276
  misc_feature: Useful for making plants with altered cell wall content and/or composition
MPAAPRSVKEMAAAEVVLAAMLLSSAAVAAAQHDYGDALHKCILFFEGQRSGRLPPDQRVRWRRDSGLHDGAAAGVDLTGGY

SEQ ID NO: 28286 - DNA, 523 bp, Panicum virgatum
  misc_feature: Ceres CLONE 1882827
  misc_feature: Encodes the peptide sequence at SEQ ID NO. 28287
ccgcaacccaccgccaggaaggctcgcggctccccgccgaccccgagcgtccggccgcgcggcccctccatgcgccgctgatcgcgcgcgcgaacgatcaagccagctaccccaggggaaggatcggagcgcgggcggcgccgctcccctcagctctgccgccgccggccgggcggaagctaggtagctagcagccctgtacgcggcgaaccactggggcgggtcgttccagatcgccgacggggcggcggaagacgaccacagccgcaacatggacctggaccgcggcgcgctgtcgcggcagcagcaccacgagctggaccaaacgcagcagaactggctgctccgcccccccgaagccaagaaaaaagacaaatacgtccacctcggctgcgtcatcgtccagcgcaagctcctgtggtgggccttctggtgcgtcgtccgcgccttcgtcctcctcggcctccccctcatcatcgccaagtccatcccccacaagaagcaccggccgccgcccccccaa

SEQ ID NO: 28287 - protein, 83 aa, Panicum virgatum
  misc_feature: Ceres CLONE 1882827
  misc_feature: SWISSPROT Homolog: EC 3.2.1.4 Cellulase
  misc_feature: Functional homolog of the protein sequence given in SEQ ID NO 50501
  misc_feature: Useful for making plants with altered carbohydrate content
  misc_feature: Functional homolog of the protein sequence given in SEQ ID NO 51277
  misc_feature: Useful for making plants with altered cell wall content and/or composition
MDLDRGALSRQQHHELDQTQQNWLLRPPEAKKKDKYVHLGCVIVQRKLLWWAFWCVVRAFVLLGLPLIIAKSIPHKKHRPPPP

SEQ ID NO: 28288 - DNA, 663 bp, Panicum virgatum
  misc_feature: Ceres CLONE 1882829
  misc_feature: Encodes the peptide sequence at SEQ ID NO. 28289
atcgcgtctcgtctcgtggtgttccccgaacacaacccaaatccaaatcctcctcctcgcgaggctcgtcgattcctcccccggtttaagaaggagattttccttaagaacctccccgggaagaccctcccccttgagggagaatcttccgaacccctccaacaaggccagggccagaatcagggaaagggggggcttccccccgaacagcaaaaggttctttttcctgggaaagaggtggggggagggcccccttctccggaactacaccttcagaaaggaaagccccttccactgggggctcggccggagggggggaatgcaaattttctggaaaaccctcacgggcaaaaccttccccttggggggggaaagttttaacccctttgacaacgggaaggccaaaatccagaacagggagggcttccccccaaaccagcaccaattgttcttcgccggcaagcagttggaggacggccccacctttgcaaactacaacatccaaaaggaaagcacgctccatttggggctccgccggagagggggaatgcaaatcttcgtaaagaccttcactggcaagaccttcaccctggaggtgaagagctccaacaccattgacaatgtgaagggccagatccaggataaggagggcatccccccaaa

SEQ ID NO: 28289 - protein, 220 aa, Panicum virgatum
  misc_feature: Ceres CLONE 1882829
  misc_feature (112)..(180): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50597
  misc_feature: Useful for making plants with modulated cold sensitivity
SRLVSWCSPNTTQIQILLLARLVDSSPGLRRRFSLRTSPGRPSPLRENLPNPSNKARARIRERGGFPPNSKRFFFLGKRWGEGPLLRNYTFRKESPFHWGLGRRGGMQIFWKTLTGKTFPLGGESFNPFDNGKAKIQNREGFPPNQHQLFFAGKQLEDGPTFANYNIQKESTLHLGLRRRGGMQIFVKTFTGKTFTLEVKSSNTIDNVKGQIQDKEGIPP

SEQ ID NO: 28290 - DNA, 522 bp, Panicum virgatum
  misc_feature: Ceres CLONE 1882831
  misc_feature: Encodes the peptide sequence at SEQ ID NO. 28291
agaggaagccggaagctcccgtgcggccccccccccccgagagcgaggacgcggcggcgccggcgaggggagagctccggaagtgccgctgccttgagcgggcgatatggccgtggtgacggcgctggcgggggtggtggtggcggcgctcgcgccggccgcgcgcggggtggaccggagcgagttcccgccggggttcctcttccgcgccccgacgtcggcgtaccagatcgagggcgcgtacctggaggacggcaagggcctccaccactgggacctcttccccccccccccctctggagggatcatggacgggcggaacggggacctggcccaccacccctaccctccctacatgggagacgtggaggtgctgccgtccctgggcctccacgcgtacaggttctccctctcctgggccaggattctacccagaggcaggatcggccgcctccatcccgaccggataacggtcttccaccgcctggttcatgccctcctgccgaaaagagaacaggcgtt

SEQ ID NO: 28291 - protein, 138 aa, Panicum virgatum
  misc_feature: Ceres CLONE 1882831
  misc_feature: SWISSPROT Homolog: EC 3.2.1.21 Beta-glucosidase
  misc_feature: Functional homolog of the protein sequence given in SEQ ID NO 50474
  misc_feature: Useful for making plants with altered carbohydrate content
MAVVTALAGVVVAALAPAARGVDRSEFPPGFLFRAPTSAYQIEGAYLEDGKGLHHWDLFPPPPSGGIMDGRNGDLAHHPYPPYMGDVEVLPSLGLHAYRFSLSWARILPRGRIGRLHPDRITVFHRLVHALLPKREQA

SEQ ID NO: 28292 - DNA, 654 bp, Panicum virgatum
  misc_feature: Ceres CLONE 1882838-R
  misc_feature: Encodes the peptide sequence at SEQ ID NO. 28293
tgctggggtggtggaactggatgggccgtggaggatgccaaggacaagataacaaagctcttggaggaatacgagagtggaggcgatgtaggggaagcgtgcaactgcatccgtgagctgggcatgtctttcttcaaccatgaagttgtcaagaaggctctcgtgatggcgatggagaagaagaatgagaggaccctgaccctgctgcaggagtgcttcagtgaagggatcataaccatcaaccagatgaccaaggggttctcaagggttagggatgggcttgacgacctggctctcgacattcctgatgccaaggagaagttcctctcctacatggagcacgcaaagaagagtggatggctcttgccctcgttcggtgttgcgtctgcggcttgaactgctgggcagagaagtatcaagctgaagcagaaggcaagcgcaggctgtatcgtggcacagccgacccagtttccctgtgtttctttctgtcatgtgtcgttgcgcttttgcgtaggtagcggagcgagcccctcctggttgcggtggtggtggcttgtgtgtctagatgtcgcacctgacatgctcatgctgttcttgtttcactccattttctctctccatagaacctttcttttttacatgaagtaaaaacag

SEQ ID NO: 28293 - protein, 131 aa, Panicum virgatum
  misc_feature: Ceres CLONE 1882838-R
  misc_feature (13)..(122): Pfam Name: MA3 Pfam Description: MA3 domain
CWGGGTGWAVEDAKDKITKLLEEYESGGDVGEACNCIRELGMSFFNHEVVKKALVMAMEKKNERTLTLLQECFSEGIITINQMTKGFSRVRDGLDDLALDIPDAKEKFLSYMEHAKKSGWLLPSFGVASAA

SEQ ID NO: 28294 - DNA, 727 bp, Panicum virgatum
  misc_feature: Ceres CLONE 1882838
ctctctctctctcttacaaaacagaagccggggagagagaaggaaaaaaaattatccatcatcactcgcagtcccgcacacaaatctcgcgcacggggttgggggggcttcgtcgccgcgccggctcgatccgcggccgaaaccctaggtacggaaaccctcctccccctcgctcgagccgcgcccccattccggctcgtcggctgacgcgtctcgttccgctgctgcgcgcgcgtgcggttggtctgctgctgcaggtggtggcggcggggatggcgtcgccgaagaaggacggggggttcctgacccaggaccagcgggagaagctgcggatcgcggtgcagaacgcggagacgctgtcgctcgcctccccgcgctcgcccacggggggctccgcctccgcgctgctgcagcagtacgagcagcagatgctggagcagaagcgcgccgcggcggccggtaggggcgggggaggcggaggcggaggcgggccgaggcacgtgcgccgcacgcattccgggaagaccatcaaggtgaagaaagatggtgctggtggcaaagggacttggggcaaacttattgatactgatgcagatgcctgccttgaccgaaatgatccaaactatgacagtggtgaggagccatatgagttagttgaagcccctgtttcaaccccactagaagactacaagaaatctgttgtccaattattgaggaatatttcagc

SEQ ID NO: 28295 - DNA, 564 bp, Panicum virgatum
  misc_feature: Ceres CLONE 1882839
  misc_feature: Encodes the peptide sequence at SEQ ID NO. 28296
atcccaccaccagcagctcgttctcattcataaacgaccctcaccgtctcgtctccctgctccgctccccacacacgctcacccctccatccctccatcactaccctcctcaccggagctcgcgcaccgtgccgtttccaccatgtatgacatcttcgccgagctcgggtgccccgactgctcccaggcccagagggcgcgcgtcctcgcctgctcccgcaggctgaggcacccgggacccgactggtcgggggtgtaccagcacgagggcaacttcctcacccagcagcggctcgccgtcatctccccactgtccggcgaccagccgatcttcaacaaggaccgcaccgtcatcgtcgtggcccatggggagatctacaaccacaagaagatccggaagcagttcgccttcgtgctctactacacccacaacaagacctacatggtgccgcgcgacgccatcagcgtcaaccccctctacatcggctggggcggcgacggtcccgtctggttcgcctccgacatgaaggcgctgaacgaggactgcgtccggttcgagcactt

SEQ ID NO: 28296 - protein, 140 aa, Panicum virgatum
  misc_feature: Ceres CLONE 1882839
  misc_feature: SWISSPROT Homolog: EC 6.3.5.4 Asparagine synthase (glutamine-hydrolyzing)
MYDIFAELGCPDCSQAQRARVLACSRRLRHPGPDWSGVYQHEGNFLTQQRLAVISPLSGDQPIFNKDRTVIVVAHGEIYNHKKIRKQFAFVLYYTHNKTYMVPRDAISVNPLYIGWGGDGPVWFASDMKALNEDCVRFEH

SEQ ID NO: 28297 - DNA, 2231 bp, Panicum virgatum
  misc_feature: Ceres CLONE 1882865
  misc_feature: Encodes the peptide sequence at SEQ ID NO. 28298
aatggcatcggcatcccctgcgcgccgtgccgcgccctccgcgccaactcgtcgccgtcgcggacggcgtcgcctgctcctggtaccatggccgtataaaagcggcggggcctagccccattggagagcgggcaaagcaagctagcgcggcccccagattctctcgcgcctccactttaccttctccttctggccttccccgcgccatggcccacgaacgggagccgctcctgcagcagccgcagagcggcggcggcggcggcggcaatgccgccggtgccaagggctcgtcctcggcgcccgccgccgccccgctgccgtcgctggccaggaccgtgctcaagttcctgatgtgggcggtgttcctcacctgggccgcggggatcttcttctacccgaccaagcccgcgcaggccgtgttcaagaagtgggttgggctcaccagggactccacgggcatcgccggtacgctctcatcaagaaatcgtactcttcttcttccttttccgatgtgaaagcaggggaaagcaagtgactggtctttccccatttttctgtttctggttcttgcaggtagcatttttctgaccttcagcgcacccatcctgataattgcgcttctggcatatgtgtacatctccttcttcccgagtgatcatatggagaagaggaagctgaggtcattgagtttccggctctggacattccctgttcttgtcgatggcccttttggagttgtttctgcagttgaattcatcggaattgtcctatttatcgtttatgttgtctactcaatgacctactatgctttggagagtgtgagccttgtctcaaaatttgatacaccatcaaagactgatagtgagttgatactgcatgtcatcggtcttcgcttaggatcagttgggctgttctgcatgttgttcctgttcctgccagttgcaaggggctcagttcttcttcggcttatcgacattccgtttgagcatgctactagataccacgtctggctcggacatctcacgatggctctctttacattgcatggcttgtgctatgtgatcgaatggtccatgcaagggctcctacttaaaaagatggcaggatggaaggaaattggaattgcaaacttccctggcgtgatcagcttggcagctggcctacttatgtgggtgacctcacttcacccagtgaggaagaagttctttgagctcttcttctacacccaccaactctacgtcatctttgtcgtgttcttggcattacacgtcggcgacttcatcttcagcatttcagctggggccgtcttcctcttcatgctcgatcgcttcctaaggttttggcagtcaagggccaaagttgacatcatttcagctgcctgccgcccatgcgggacagtggagctagtcttctcaaaaccagcaagtctccgctacaatgctctcagtttcatcttcattcaagtgcgcgagttgtcattcttgcagtggcatccattcagcgtatcttcgagtccaatggatgggaggtaccacatgtcggttctcataaaagtactgggcacatggactgagaagctgaggagcatcatcaccgatgtccaggagcagaacaggggtgactctgagttgcaatgtggtcgcataacagcctgtgtggaagggccgtatggacatgaatctccctatcacttgatgtacgagaatctcatcctggtggcaggaggaattggaatatctccgttcttggcgatcttgagtgacataatccacaggatcgaggagggcaagcaatgcatgcccaagaacgtgctggtcctgtggtcagtgaagaagtccaaggagctttctctcttgttgggcgtcgatgcgcagaccatccgttcatctgtctctgacaagttgcgcttggatatccaggcattcgtgacccaagaaacccaggctccattggaggatggcatcgttggcgacgaccagaaagtccctggcatgttcgtcaagaacgggacgaccatgtccgggctggtcggcaccggggacaacttctgggcggccatgtacttcctggcgtcgacgctcgggttcctcctggcgtacgccctggtgcaggtgtactacgtgaagccccacaacgtggtggcgtggtggtacctgggcctcctgttcatgctgtgcatggccgccggcgtcgccctccccggcggcctcgtcgtgctcctgtggcacctg

SEQ ID NO: 28298 - protein, 523 aa, Panicum virgatum
  misc_feature: Ceres CLONE 1882865
  misc_feature (79)..(201): Pfam Name: Ferric_reduct Pfam Description: Ferric reductase like transmembrane component
  misc_feature (231)..(341): Pfam Name: FAD_binding_8 Pfam Description: FAD-binding domain
  misc_feature: SWISSPROT Homolog: EC 1.6.3.1 NAD(P)H oxidase
MEKRKLRSLSFRLWTFPVLVDGPFGVVSAVEFIGIVLFIVYVVYSMTYYALESVSLVSKFDTPSKTDSELILHVIGLRLGSVGLFCMLFLFLPVARGSVLLRLIDIPFEHATRYHVWLGHLTMALFTLHGLCYVIEWSMQGLLLKKMAGWKEIGIANFPGVISLAAGLLMWVTSLHPVRKKFFELFFYTHQLYVIFVVFLALHVGDFIFSISAGAVFLFMLDRFLRFWQSRAKVDIISAACRPCGTVELVFSKPASLRYNALSFIFIQVRELSFLQWHPFSVSSSPMDGRYHMSVLIKVLGTWTEKLRSIITDVQEQNRGDSELQCGRITACVEGPYGHESPYHLMYENLILVAGGIGISPFLAILSDIIHRIEEGKQCMPKNVLVLWSVKKSKELSLLLGVDAQTIRSSVSDKLRLDIQAFVTQETQAPLEDGIVGDDQKVPGMFVKNGTTMSGLVGTGDNFWAAMYFLASTLGFLLAYALVQVYYVKPHNVVAWWYLGLLFMLCMAAGVALPGGLVVLLWH

SEQ ID NO: 28299 - DNA, 776 bp, Panicum virgatum
  misc_feature: Ceres CLONE 1882865-R
ccatattttttggaattatgataatttctcagtttaaaatttggatactatgatgatcaacatgcagtggtagaaggttccgagcatatttgggggattcaagcgacgtgggggaattttatggctacaacatacttacactcatttctaagctttgctctgtttcatcatgttatgctttgaacatagctttaatccggtgttgcttctctatgttcgcagatcatttagcccaactagttgctagttcatccatctgatttggtcataaaatgttcggtttgggatttctctctggtttgatttgctctatctatatttttgtgcgtgcttcttcatgtggtggctgcaggattagtttggcattgggaacttcctgcatctaagaactggcacttgaaattgggggcaggtcagagtctagtgcacgattttggttagtattggttccattacttgtattcagtcttttcagatctgaatggttggatgatattttgcctctccaatgggatgatgacgaggtttgagactctgaatttattcagtattgtataagctgatctttgttctggtgtgttttgtgtcattcagagatgcaggtggggcattggttgtggaggttggttgatgtagaaggtttggttatggttgacagtagttttgctatttctgtgtcattatgatgatattagacattacatctttaatgccagcgcttcaattgtgatcgatgttcaaatctatagaatgcttggaagcaacactttgactgg

SEQ ID NO: 28300 - DNA, 1972 bp, Panicum virgatum
  misc_feature: Ceres CLONE 1882881
  misc_feature: Encodes the peptide sequence at SEQ ID NO. 28301
gggctgctgggggaaggtcgccgacgggatcgatggaagatttgtctacgtttacggacggagaggtggccgaagaagcgaagcggcaggctccaggccaaggaagctctgaaggtagtcatagtactcttttgcaaggcatgaaggagcaggaaacaagaaaaggaaaggcggctgttggatccactgagcttatgagggaggatctggttcagagtgctgttagttttttgaaacatccgaaagtagtaacctctttggatggacagaggcgatctttccttgaaaacaaaggactcactgtggatgaaatagatgaagcatttcggcgtttacaagtaagaatttgtttgttcactttctactggctctgattttcttccctgattactctaccttaatttctactggctctgattttcttccctgattactctacctttttattttctgaactcgtttttggggtggaattaaagagcccatcttcgaattctttgagctcaaatgcttgcacatctcaaggtatggaaagatactccatttgttaatcattcttttagatgatcttttttttctcaaatacgcaggagagctgcgtatctttgtattaatagagagaaaaagtcggccccttacaagcagtacactcactccgagccgagctgtgagtggctgagatacaaaatttttgtttctaaaaaataaaataaacacttgaccactagaccactcaggacacagataaaacttatcctagtccaatgtcttgaccagcagtcaaggagttaaggctccgagcgcctgcaagacaccacaaatggtgttcatccttgaaagcctgaagtaaaatgtccaagctcggtctggcaccctcgaagacgcatgcatttcggtgtttccaaatgatccaggcacccaacatgaccaaagtgagtgtagcagagatgcggatgttatacggtgatgttatacggtgctgaatgttggcctacaaaaaggcgacatgtgcagcaactgagtgtagcagagatgcggatgttgcggtggttttgcgggcacacaaggagggatagagtctggaacgaagttattcgggatagggtcggggtggcaccaattgaggagaaacttactaagcatcggctgagatggtttggacatgtccaacgaaggcctcctgaggcgccggtgcgtaatagggttcttgagcgggtcgataatgtaaagaggggtagaggtagacctaaactgacgtgggatgagttggttaaaagagaccttaaggattggaatatctctaaagagatagctttggataggagcgcttggagactagctatcaatgtgcctgaaccttgaacttatttctttcgggtttcatctctagcctaccccaacttgcttgggaaaaaaaggctatgttgttgttgttgttgttgttgtatccctactatattttatagagaggattgaacctgagactgaaccggtggcccctgtggtgcctcgtcatccaaaatcatatatggaggtcagctacctatctaacatgggtaaatggctgcaagtttaatccttacttcgctgcagactactgcatacatgatatctgaatatgtctgttttaaaataaacttcagaacttagatagctaactgcttgtttcagtgcaattagattgaatttctgaacttagaattattcctaactgctcggtgttgcattatccatgatttattgagcccttcggtttagcttgatgttggtcctcagagattaactcacctgaatctggacttatgtattggtaacggattgatagatttaaagggaacaatcttgtgctcagtttcatttgagttttaaatgtgggactgtatttgacttggcagatcatggaaatgatacagaggggtgagcggccagatgatatccaggatattaatgatgaccctccaaaccctgatca

SEQ ID NO: 28301 - protein, 113 aa, Panicum virgatum
  misc_feature: Ceres CLONE 1882881
  misc_feature (55)..(113): Pfam Name: Pex14_N Pfam Description: Peroxisomal membrane anchor protein (Pex14p) conserved region
MEDLSTFTDGEVAEEAKRQAPGQGSSEGSHSTLLQGMKEQETRKGKAAVGSTELMREDLVQSAVSFLKHPKVVTSLDGQRRSFLENKGLTVDEIDEAFRRLQVRICLFTFYWL

SEQ ID NO: 28302 - DNA, 1340 bp, Panicum virgatum
  misc_feature: Ceres CLONE 1882883
  misc_feature: Encodes the peptide sequence at SEQ ID NO. 28303
attcccggccgccgccgccgtcgccgcctcctcctaaccagtagccaccccgtcgagcatccgccgccgtggtcatgagccctaccgccgcggcggcactgaatcgccgcatgcgcagtaagccgccgccggtcgcgtcctcccgcaggtccaatgatctcaccgtcgccggcgccaacggctacggctgcggcaacggcaagttctcccccaagccccgctgccccagccacgccgcaagggaaaagactgtcaagaagctccggctgtccaaggcgctgacgatcccggacgggacgacggtctcggaggcgtgcaagatgatggcggtgaggcgggtcgacgccgtgctactcaccgacgccaacgacctcctctccggcatcctaacggacaaggacatagccacgagggtgattgccgagggtctgcgttgtgagcaaacaatcgtctccaagatcatgacaaggaaccctgtgtatgtcacgtctgacacacttgctattgacgcactgcagaaaatggtccaagggaaatttagacaccttccagttgtggaaaatggtgaggttattgcaatgctgaacatagcgaaatgcctctatgatgcgatatcaagactggaaagggcagcagagcaaggaaataatgcactagcagctgctgtagaaggggttgagcgtcaattagggggcaatatctcatcttctcaaaatctcatagagactctgagagaacagatgtataaactttctttgtcaaccattatcacggagaatacaaaagtagcaactgcttcaccttcagatcctgtttatgtagcaacccagaaaatgcgtgacttacaagttaattcagttgttattactgccggaaattcactgctaggaatctttacttcaaaggatgtgcttatgcgagttgtggcgcaaaatctttctcctgagttaactctggtggaaaaggtaatgactgcacaccccgactgcgctacattagacatgacaatcattgatgcactacatatcatgcatgatggaaaattcttgcatattcctgttctcgatggagaggggcgagtcgctgcttgcttggatgttctgcaacttactcatgcagccatttcaatgtttgaaggaggtcctgggactgcaaatgatgtggcgaacacaatgatgcagaaattctggaactccgcccttgctctagagcctctagatgaggattttgatagtcacagtgaattatctttagtggcgccatcagaggctggggatggcaggagctgtatgtatcctcctgctgttggtaattcatttgtatttaagcttcgggaccag

SEQ ID NO: 28303 - protein, 421 aa, Panicum virgatum
  misc_feature: Ceres CLONE 1882883
  misc_feature (62)..(180): Pfam Name: CBS Pfam Description: CBS domain pair
  misc_feature (232)..(350): Pfam Name: CBS Pfam Description: CBS domain pair
  misc_feature: SWISSPROT Homolog: EC 1.1.1.205 IMP dehydrogenase
MSPTAAAALNRRMRSKPPPVASSRRSNDLTVAGANGYGCGNGKFSPKPRCPSHAAREKTVKKLRLSKALTIPDGTTVSEACKMMAVRRVDAVLLTDANDLLSGILTDKDIATRVIAEGLRCEQTIVSKIMTRNPVYVTSDTLAIDALQKMVQGKFRHLPVVENGEVIAMLNIAKCLYDAISRLERAAEQGNNALAAAVEGVERQLGGNISSSQNLIETLREQMYKLSLSTIITENTKVATASPSDPVYVATQKMRDLQVNSVVITAGNSLLGIFTSKDVLMRVVAQNLSPELTLVEKVMTAHPDCATLDMTIIDALHIMHDGKFLHIPVLDGEGRVAACLDVLQLTHAAISMFEGGPGTANDVANTMMQKFWNSALALEPLDEDFDSHSELSLVAPSEAGDGRSCMYPPAVGNSFVFKLRD

SEQ ID NO: 28304 - DNA, 669 bp, Panicum virgatum
  misc_feature: Ceres CLONE 1882883-R
  misc_feature: Encodes the peptide sequence at SEQ ID NO. 28305
gaatggacgtatgcatagatttacttgtgggtctgagagtttagatgagttgatgtcttctgtaaagcaaagattaggcattggtggtgaaaagagcacagttcaactcttgtatgaggatgatgaaggtgacaaggtgctcctaactacagattctgatcttgctggtgctgtgctcaatgccaaatcaaatcgattaaaggctttgaagttgcatattgacgactctgattccaaaaacaaagtggcgacacaacaattgtcagagctagaaccatcccacggaattgagttgatggatgttcattatggtctgatggcttgtggaattgctctaacaggagtagccatgatggttttcttgagacactccacagtctaaatttttcaaggggaatgtataattttgtacttacatataaagttaatatgtatagatgtgtagcacgccttggctcattaagaaggctaagaatgaagaaaaacaagggtcgtcaatggttcactgaatgcatttgtggcccaaaaggaatcggctgactgtcaagttctccagttggctcagtgtggtggtgggaaggaagcctgtacaacttgaatccagtgacgtctcgattaatctctgtaactatgtatatgcatgtgagtaagaaaatcaagacttatcgc

SEQ ID NO: 28305 - protein, 126 aa, Panicum virgatum
  misc_feature: Ceres CLONE 1882883-R
  misc_feature (1)..(76): Pfam Name: PB1 Pfam Description: PB1 domain
NGRMHRFTCGSESLDELMSSVKQRLGIGGEKSTVQLLYEDDEGDKVLLTTDSDLAGAVLNAKSNRLKALKLHIDDSDSKNKVATQQLSELEPSHGIELMDVHYGLMACGIALTGVAMMVFLRHSTV

SEQ ID NO: 28306 - DNA, 458 bp, Panicum virgatum
  misc_feature: Ceres CLONE 1882884
  misc_feature: Encodes the peptide sequence at SEQ ID NO. 28307
accgcagctcgcactcgcactcgcactcgcactcgcactcgccctcgccctcgccctcgccctcgccctcgccctcgcatttgatccatcgctaataacaatggcgtcgttgctgccggcgttcacggtgcggcggggggagccggtgctggtggcgccggcggagcccacgccgcgggaggtcaagccgctgtcggacatcgacgacggggagggcatgcggttctacagctcggggatccacctgtaccgcaacaacccggccaaggcggggcaggacccggccagggtcatccgggaggcgctcgacagggcgctcatcccgaactacccgctcgcgggccgcctccgcgaggaccgagggaggaagctcgtcatgcactgcgccggccagggcgtcatgctcgcccaggacgaacccgacctcacagccgatgacttacgggacgtgcagagcc

SEQ ID NO: 28307 - protein, 119 aa, Panicum virgatum
  misc_feature: Ceres CLONE 1882884
  misc_feature: SWISSPROT Homolog: EC 2.3.1.167 10-deacetylbaccatin III 10-O-acetyltransferase
MASLLPAFTVRRGEPVLVAPAEPTPREVKPLSDIDDGEGMRFYSSGIHLYRNNPAKAGQDPARVIREALDRALIPNYPLAGRLREDRGRKLVMHCAGQGVMLAQDEPDLTADDLRDVQS

SEQ ID NO: 28308 - DNA, 689 bp, Panicum virgatum
  misc_feature: Ceres CLONE 1882890
  misc_feature: Encodes the peptide sequence at SEQ ID NO. 28309
aggctgagggctcctccccttctctctctctctctctctctctctctctctctccccctaccgtctcctgcgatcccatcgcctcgccgccgccgccgccgccatggcgttcctcgcgagggcgctccgccagtcgaactcgcgcctgtcgtcgcgctgccccgccgtggccgcgtcctgccgctggatctccccgaccgccgccgcgggatcgccggaggccggcgcggcggtggcgccggccgacccggagctgccgccgccgcgggagcccgtggggggcgctcgggtggagctcccgcccaacccggaggacgcgctcgaggtgttcgtggacgggcacgcggtgcggatccccaaggggttcaccgtgctccaggcctgcgaggtcgccggcgtcgacataccgcgcttctgctaccacagccgactctccatcgccgggaactgccgcatgtgcctcgtcgaggtcgagaaatcgcccaagcccgtcgcctcctgcgccatgcccgcgctcccagggatgaagattaagacaaacactccagtggcgaagaaggcaagggagggtgtcatggagttcctgctgatgaaccatccacttgactgcccaatctgcgatcagggtggggagtgcgacctccaggatcagtctatggcatttggtgctgaccgtggtcggttcactg

SEQ ID NO: 28309 - protein, 195 aa, Panicum virgatum
  misc_feature: Ceres CLONE 1882890
  misc_feature (75)..(139): Pfam Name: Fer2 Pfam Description: 2Fe-2S iron-sulfur cluster binding domain
  misc_feature: SWISSPROT Homolog: EC 1.6.99.5 NADH dehydrogenase (quinone)
MAFLARALRQSNSRLSSRCPAVAASCRWISPTAAAGSPEAGAAVAPADPELPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNHPLDCPICDQGGECDLQDQSMAFGADRGRFT

SEQ ID NO: 28310 - DNA, 2445 bp, Panicum virgatum
  misc_feature: Ceres CLONE 1882903
  misc_feature: Encodes the peptide sequence at SEQ ID NO. 28311
tccctgcgctgtgccactctccgcggccttgagcgcttctccgtcgctgcttgctagcaggaccaacgccttttctctttcttcaccacagcctctccctctctctctctcctttccgtagccatttgccgctgttcacctgttcttgccagttaccgcttttttgagctaccagcaacagtgttgagctcagttattacagttctgtcttcggctcgcagcaaagcctcgtgctgcttgtagcatcagagctactggtagcttgtggtctgttgctgtagccagttgctggcttgctgctggtagcaaggggagccttcgatccgcttgcagcggtcggccttccaccgccggagctttccaatcggcgaccagcctcccccgcttctatccaagaagctagcgcttccacttttttcttgggaaaaaagctttgccctttttttttctccctcatccgtttgttccctccccgagctagctagccgccagcgccgtcgcggcccaccactcgcggagctcggcggagcctcggtagcacgcgcgctgtccggagctccagacatggcggcattacggcgccttggcacggcggtggacggaaatttccaggggccggccggcgggatggtgccgcggtccccgcgcctcctcgcctcgaacggcagcgcgcccaggtcccccgcggcgggcggccgtcgggaggaggaggcggccagcggcggaggcggccctggcctcgccgcgctccgtcccactcccgccaagccgccgctcgggagcggtaagattaagaagctatttgccgccccaggcgccggcggcggcaagcccaggaagcgcgcgccgctctggcaggccgccctcttcgtctccgtcgccatacacgtcgggctcttcctccacccctacgtcaacagcacagctcctccgcgccgccaccaccacccccaggagccccaggcctgcctgacgcatccagaagctgcaggcagcggcggcggcaggagaagggcgacgcaggagaaggcctgggccgccggggctccgtcgacgggcaagccggcggtgacgccggagtcagtgatcaacctcgaccacggtgacccgaccatgttcgaggagttctggcgcgggacgggggcggcggcggagatcgtcatcccggggtggcagaccatgagctacttctccgacgtcggcaacgtgtgctggttcctggagcccggcctcgaccacgaggtgcgccggctccaccgcctcgtcggcaacgccgccgtggacggctaccacgtccttgtcggcaccggctccacgcagctcttcatggcggcgctctacgcgctgtcgccgcccgccgccgcgcccatgagcgtggtgtccacggcgccatactactcgtcctaccctgccgtcaccgacttcctccagtcggggctcttccgctgggctggcgacgccggctcgttcacgggcgacacctacatcgagctggtgtgctccccgaacaaccccgacggcgccatccgcgaagctgttctctcctccgagtccggcgtcgccgtgcacgacctggcctactactggccccagtacaccgccatcaccaggcgggccgaccacgacatcatgctcttcaccgtgtccaagagcacggggcacgccggcacgaggatcgggtgggcgttggtgaaggaccgcgacgtcgcgaagaagatgaccaagttcatcgagctcaacaccatcggcgtgtccaaggactcgcagctgcgcgccgccaaggtcctcagggcggtctccgacgcctacgagctctcgggggcgggggaagagcaccgccgcctgttcgactacgggcggcgcaaaatggcggagcgctggagcatgctgcgcgaggccgccgccgcgtcgggcatcttcagcctgcccgacgagacctccggctactgcaacttcaccgaggacatggcatccactaaccctgcgttcgcgtggctgcgctgcgacagggaggacgtggaggactgcgcgagcttcctccgggggcacaagatcctgacccggagcgggagccagtttggagcggacccgaggtacgtccgggtcagcatgctggacagggacgacgcctacgacatcttcgtgaagcgcctcgcctccctcaagtgaggtgaagacgacggaccatggatcgatgccaccctgccggcgccggcaacgcatgccccgtgggagcatgagtagagcagcagtatcggtagagtaggaagaagcagaagaggcaggagcaacgttttgttttgctttttccttctgctgtgtgctgtgttgttggggatggatgcatgtcgcatcgtctcaaaaattcttataaaggtttcattttttttcttgctaattgctagtatgtgagactaagctgacatgagaaaataatcgatccag

SEQ ID NO: 28311 - protein, 534 aa, Panicum virgatum
  misc_feature: Ceres CLONE 1882903
  misc_feature (175)..(534): Pfam Name: Alliinase_C Pfam Description: Allinase
  misc_feature: SWISSPROT Homolog: EC 4.4.1.4 Alliin lyase
MAALRRLGTAVDGNFQGPAGGMVPRSPRLLASNGSAPRSPAAGGRREEEAASGGGGPGLAALRPTPAKPPLGSGKIKKLFAAPGAGGGKPRKRAPLWQAALFVSVAIHVGLFLHPYVNSTAPPRRHHHPQEPQACLTHPEAAGSGGGRRRATQEKAWAAGAPSTGKPAVTPESVINLDHGDPTMFEEFWRGTGAAAEIVIPGWQTMSYFSDVGNVCWFLEPGLDHEVRRLHRLVGNAAVDGYHVLVGTGSTQLFMAALYALSPPAAAPMSVVSTAPYYSSYPAVTDFLQSGLFRWAGDAGSFTGDTYIELVCSPNNPDGAIREAVLSSESGVAVHDLAYYWPQYTAITRRADHDIMLFTVSKSTGHAGTRIGWALVKDRDVAKKMTKFIELNTIGVSKDSQLRAAKVLRAVSDAYELSGAGEEHRRLFDYGRRKMAERWSMLREAAAASGIFSLPDETSGYCNFTEDMASTNPAFAWLRCDREDVEDCASFLRGHKILTRSGSQFGADPRYVRVSMLDRDDAYDIFVKRLASLK

SEQ ID NO: 28312 - DNA, 1266 bp, Panicum virgatum
  misc_feature: Ceres CLONE 1882904
  misc_feature: Encodes the peptide sequence at SEQ ID NO. 28313
acgaaccctccttgaggggttcgaatttgctcctgatccaagcgccaagctcctagattccgcctcccaaatcatcttcccgatccgatctgccagttccccttcgatcccgcatcccccgccgattcctgcgagccctcgccaccatggatccgcgcgccaggtaccctccgggcatgggcaacggccgcggcgggaaccccaactactacggccgcggaccgccgccgcaacagccgcaccagcacaaccaccagcaccatcagacgtcgggggcgcatcaccaccagcagtacgcgcagaggcagcagcagcaccaccaccacaacctcaaccacccccagcaacagcagcaacaccacaatcaccaccagcaacagcagcagtggctgcggcggaaccagatcgcccgcgggcccgcgggcgcggccggtaccagcgagccgaaggccctggtgccatccacggccgccgatggcatggattcgagttcacaagattggaaggctcaattgaagctgccgcctcaagatacacgctacaggacagaggatgttacagccactaagggaaatgagtttgaagactactttctcaagcgtgaactcttgatggggatatatgagaagggatttgaaagaccctctcctatccaagaagaaagcattcctattgctttaactggtagtgacattcttgcaagagcgaagaatggaactggcaagactgctgcgttttgtattcctgctctggaaaagattgatcaagataataatgctattcaagttgttatattggttcccacaagggaattggctctacagacatcacaagtttgcaaggagctcggtaaacatttgaagattcaagttatggttaccactggtggaaccagcttgaaggatgatattgttcgtctgtaccaacctgtacatttacttgttggaacacctgggcgtattttggatcttacaaagaaaggtgtttgcattttgaaggactgttcgatgcttattatggatgaggcagacaagcttctgtctcctgagtttcaaccttctgtggaacagttgattcgctacctccctgctagtcgacagattttgatgttctcagcaacatttcctgtgactgttaaggagttcaaggacaaatatctgcctaaaccttacgtgattaaccttatggatgagcttacactgaagggaattacacagttctacgcgtttgttgaagaaagacagaaaattcactgtcttaacaccc

SEQ ID NO: 28313 - protein, 373 aa, Panicum virgatum
  misc_feature: Ceres CLONE 1882904
  misc_feature (167)..(333): Pfam Name: DEAD Pfam Description: DEAD/DEAH box helicase
  misc_feature: Functional homolog of the protein sequence given in SEQ ID NO 50788
  misc_feature: Useful for making plants with altered lignin content
MDPRARYPPGMGNGRGGNPNYYGRGPPPQQPHQHNHQHHQTSGAHHHQQYAQRQQQHHHHNLNHPQQQQQHHNHHQQQQQWLRRNQIARGPAGAAGTSEPKALVPSTAADGMDSSSQDWKAQLKLPPQDTRYRTEDVTATKGNEFEDYFLKRELLMGIYEKGFERPSPIQEESIPIALTGSDILARAKNGTGKTAAFCIPALEKIDQDNNAIQVVILVPTRELALQTSQVCKELGKHLKIQVMVTTGGTSLKDDIVRLYQPVHLLVGTPGRILDLTKKGVCILKDCSMLIMDEADKLLSPEFQPSVEQLIRYLPASRQILMFSATFPVTVKEFKDKYLPKPYVINLMDELTLKGITQFYAFVEERQKIHCLNT

SEQ ID NO: 28314 - DNA, 636 bp, Panicum virgatum
  misc_feature: Ceres CLONE 1882904-R
ggggcgtacgtcctgccacatttaggcacatagtagtgtatattgctaggtgcctgttcctagggctgtcccggtctagtttctttgcatttctcgctttttttttttttgtcaatctgtgtcgttagctgtttctcacaggacattttaaccctgttgctggttctgggcttgtggcctgtgggtgcacgcaagcgtgtttccaagtccaacttggtgctatgtgccgtggatgggtaattgggtgtgacgagtcggccattgaacttgaggtcagaagtctgaactgtagtagttgactgaaggtgtgtgtcgtgtgaagttgaaacaatttgccaataatctgtggtacgctgcatcatggtaagctgtctttcccttgcagccatgccacttagcttgtgccatgtcgtcatttggattctgtaggccttaagtgagcatgtaattgtcggatagaacgttcttcacctgtctgtcttgtgcagaattgttttgtcaggcacatgcaacatgtcaaggttatgggtactagactgtttcatgatgtttctatcataataagatacttatgtattctccggtgtttttgcacctaaattactgggccagttgtgctctggtttgaggaatcct

SEQ ID NO: 28315 - DNA, 1859 bp, Panicum virgatum
  misc_feature: Ceres CLONE 1882915
  misc_feature: Encodes the peptide sequence at SEQ ID NO. 28316
gcggcatgcatatccattagcaatttattaattgctccgccacggacgccaactccaactccatcgcctgccctccaccacctaaacccaaaaataattccagcaaccgcagcgacgaggcggaggcgagagccaactcgctcacagcggcggtgaccaagtctccggcggaaaccctagcaggccgagcgctcaatggcggaggacggcgacaaggccgcgccgcccgctatggcgtcagctgcggcgcccgcggacggaggaggagcagcagggaagggaggcggcggcggcgaggaggggagcgtgaagctcttcgtggggcaggtgtccaagcacatgacggaggccgagctgctcgccatgttccgggaggtggccgccgtcgacgaggtcaccgtcatcaaggacaaggtcaccaaggtctcccgaggctgctgcttcctcatatgccccacaagggaagaagctgacaaggcggtgaatgcctaccacaacaagcgcacgctccctggggcatcaagtcctttgcaagtaaagtatgctgatggagagttggagaggctggaacataagcttttcattggaatgcttccgaaaaatgttacggatactgagttgactgatctgttttgcaaacatggaaatatcaaggatttacaaattttaagaggttcacaacaaacaagcaaagctggctgcgccttccttaaatatgagacaaaagagcaagcattggcagccattgaggctctaaacgggaagcacaaaatagagggttctagtgtgccattggttgtcaaatgggctgatacagagaaggaaagacaggctaggaaagcacaaaaagctcaactacagttatctaatatgcccaatgcaagtcctatgcagcaatcttcactgtttggaactttacagatgggatatatgcctcaatataatggatttggttatcagccaccgggcacctatggacttatgcagtaccctctgtcacctatgcaaaatcaaggtcccttccaaaacatggttcaacctgttaatcaaggaaactcaataagaggagtcaaccctgaactgtcccccagttcagttcaaaggtcatttaatgcaatgcagttaggcagcccttatcctcctatccctggtatgcagtatcctggatcatatcctggtgatctcatgagcaatcgtccttttggaaattctcacaattcgattaaagttccacattcgaatgccacttctgccatatctactagtcccagaagcaatactggtgggcagatcgaaggtcctcctggagccaatctatttatttatcatatcccacaagactatggtgaccaagaactttccaatgcatttcagagttttggtagagtactaagtgctaaggtgtttgtagacaaagcaacgggtgtcagcaaatgcttcggttttgtgagctacgattctccagcttctgcacaggcagccatcagtatgatgaacgggttccaattaggcggtaagaaactcaaagtacaactcaagagagaaaacaacaagcatagtaaaccctattgacaaaagcagcagcagttgtgaccatacgacacgatcaggttcttggtacatatttgtcagataattgatcgtttaccacattgtttccttcgtcagctccctcccaaccagccagtcagcccatcagactcggggagcccattgtatcgttctttgttcagttcacattcttgaaagatcgccaagttgtgtaatgtaattcattgcagcatagtcggtagcatttgtaccatcagatcacttgtacacaagactgccaattcattcaattgttaccttttccaact

SEQ ID NO: 28316 - protein, 458 aa, Panicum virgatum
  misc_feature: Ceres CLONE 1882915
  misc_feature (374)..(445): Pfam Name: RRM_1 Pfam Description: RNA recognition motif. (a.k.a. RRM, RBD, or RNP domain)
  misc_feature (128)..(200): Pfam Name: RRM_1 Pfam Description: RNA recognition motif. (a.k.a. RRM, RBD, or RNP domain)
  misc_feature (40)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAEDGDKAAPPAMASAAAPADGGGAAGKGGGGGEEGSVKLFVGQVSKHMTEAELLAMFREVAAVDEVTVIKDKVTKVSRGCCFLICPTREEADKAVNAYHNKRTLPGASSPLQVKYADGELERLEHKLFIGMLPKNVTDTELTDLFCKHGNIKDLQILRGSQQTSKAGCAFLKYETKEQALAAIEALNGKHKIEGSSVPLVVKWADTEKERQARKAQKAQLQLSNMPNASPMQQSSLFGTLQMGYMPQYNGFGYQPPGTYGLMQYPLSPMQNQGPFQNMVQPVNQGNSIRGVNPELSPSSVQRSFNAMQLGSPYPPIPGMQYPGSYPGDLMSNRPFGNSHNSIKVPHSNATSAISTSPRSNTGGQIEGPPGANLFIYHIPQDYGDQELSNAFQSFGRVLSAKVFVDKATGVSKCFGFVSYDSPASAQAAISMMNGFQLGGKKLKVQLKRENNKHSKPY

SEQ ID NO: 28317 - DNA, 1893 bp, Panicum virgatum
  misc_feature: Ceres CLONE 1882917
  misc_feature: Encodes the peptide sequence at SEQ ID NO. 28318
tttttgaagcccgacctgctgcaatggacttgcccgacggcgcgcgagccgtgttcgtgtgccgacaatctccgccgcctgccggcggccgtggcggtccttccctcctcccggcctggcgtccgccgccgcccgcgctgtgcaccgcccggatagagcttctcgccgtcgccggccgtgcgaacgacgacggcgccgccccgttcgacgtacgtcgtggacatctccgggcgcgtcgcgacggcgacgctggtccggcgaggaagcagccgggcgccccgccggtcgagcatttttcttttggaggaaaaagtccgtgttttctttgcagaaaattcaacacttctaccaggattttgcacctcccgcgacgtcgacgtccacaaagaaccaccccacattggagcgacggccagcagcgtcgtccacaaaccccagtcgcggcgaggtcgtcaacgcttcagtctccggtcagagcacgcacacgccgaggcgtcgtcgtcgtcgtcgtccacaaacccccaatcccgccgccgccaccgcttagcttcttcctccagcaccgggatccgtccaggtcctattcctggactcctggtaagcacctctcgctccgatttttttgtggcctcgggaatcatggcgtcgtcgaagccgtcgtgcagcgccgggcggccggttgctgcagacgggcgcgccgacgccgttcccgctcccgccggcgtcctgctgcccccggacgccgtctacgagatcctgctgcgcctcccggcgaaggagctctgccgcctccgcgccgtgtgccgcccgtggcgggccctcctctccgacagggccttcgctgacgcccacgcggcccgccaccaggagccgctcgtcgtcgccggctacgccacgcacacgagcggcggcgccctctacgacgtcctggacctctccggccgcgtcgtcaagcgcgcgcgcggggcggccgtcgccggcgccggcaggacggagaacgagtgggtggtgtccgcgcggctggacctcgtctgcgtcgcgagaggcgtcggcgtgagctgcgcgctgctgagcccggccgccgcgcgcgcgcgcgccctgccccaggggctggcggaggagcacgcggcgcacgagcgggagatcagccaccacgccgccatggtcgcgctcgggcaggtcgccgccacgggcgagcgcaaggtgctccgcgtgctccacctgttccccggcacggctcggcagctctacgagatcaccaccctcgacggcggcgacggcggcggcggccggagccggtggcggcggatcaaggaccccgcgtgccctgttgcatccggcacgtgggcggtggtcgacggcgccgtcttcttcttctccagcgagctcgttcatggccaagacgccatgcccgaccgcgtagcctcattcgacctcgcgaccgaggagtgggcgccgacaatccgaggacccctgagtagcagtagcctcggggacgacggcgccgccgccgccgccgggcatcccgacgatcacatgggttggggcgagttgtcactggctgacatgaatggctgcttggtcgtgacgcatcgcacagttgcctcctccatggacctgtggttcttgatggatgtggagaaggcatcatgggtcaggaaatacaggatgcagcttagtatcagctaccggcatgctgaacatacggtgcgtcctctgctggtgctgaatgatggcaggatagtgctagttcacataggaaacaggggatctctgaagatttatgatcctaggacaagcacttctacagatgtggcagatattgggccctgcgttgcagttggtttgtacaatggaagcgtattgagcttggcaaatggtttttaaaagagt

SEQ ID NO: 28318 - protein, 415 aa, Panicum virgatum
  misc_feature: Ceres CLONE 1882917
  misc_feature (26)..(73): Pfam Name: F-box Pfam Description: F-box domain
MASSKPSCSAGRPVAADGRADAVPAPAGVLLPPDAVYEILLRLPAKELCRLRAVCRPWRALLSDRAFADAHAARHQEPLVVAGYATHTSGGALYDVLDLSGRVVKRARGAAVAGAGRTENEWVVSARLDLVCVARGVGVSCALLSPAAARARALPQGLAEEHAAHEREISHHAAMVALGQVAATGERKVLRVLHLFPGTARQLYEITTLDGGDGGGGRSRWRRIKDPACPVASGTWAVVDGAVFFFSSELVHGQDAMPDRVASFDLATEEWAPTIRGPLSSSSLGDDGAAAAAGHPDDHMGWGELSLADMNGCLVVTHRTVASSMDLWFLMDVEKASWVRKYRMQLSISYRHAEHTVRPLLVLNDGRIVLVHIGNRGSLKIYDPRTSTSTDVADIGPCVAVGLYNGSVLSLANGF

SEQ ID NO: 28319 - DNA, 693 bp, Panicum virgatum
  misc_feature: Ceres CLONE 1882918
  misc_feature: Encodes the peptide sequence at SEQ ID NO. 28320
acgcagccccgcagccgccgcccaaaccctagcgacccgccgtccgtcgccatggccgacgaccactactcctccaagcgcaagtacgacgacccctcgccgctgccgcgtcgcacggggttctcctcgggcccgccgcccgcctcgccgcccgctggcggcggcgtctcgtcgtacaacagcgtgccgccgccccccgacgagatccagctcgcgaagcagcgcgcgcaggagatcgcagcgcggctcttcaacgccgccgaggccaagcgcccccgcgtcgacaacggcgacgatgacgccggcggctacgggggaggaggctccctgggcggcagcgggggcggtggcggtggcggtggaggtggccgcatcggcggcggggggcttggctactcgtcctctgccggtggtgggcatgggtcttctatcccgccgttatcttcacagggtggtgcgtctcagtactcttcatatggtggatatcagggtacaagcaaaaagatcgaaataccaaatggaagggttggtgttattatcggaaaagctggggaaacaatcaggtatctccaacttcagtcaggagcaaagattcaagtaacaagagacaatgaagctgaaccaggtgcacagacaagatcagttgagctttcaggcactcctgagcagataagcaaagctgagcagctgatc

SEQ ID NO: 28320 - protein, 213 aa, Panicum virgatum
  misc_feature: Ceres CLONE 1882918
  misc_feature (149)..(213): Pfam Name: KH_1 Pfam Description: KH domain
MADDHYSSKRKYDDPSPLPRRTGFSSGPPPASPPAGGGVSSYNSVPPPPDEIQLAKQRAQEIAARLFNAAEAKRPRVDNGDDDAGGYGGGGSLGGSGGGGGGGGGGRIGGGGLGYSSSAGGGHGSSIPPLSSQGGASQYSSYGGYQGTSKKIEIPNGRVGVIIGKAGETIRYLQLQSGAKIQVTRDNEAEPGAQTRSVELSGTPEQISKAEQL

SEQ ID NO: 28321 - DNA, 735 bp, Panicum virgatum
  misc_feature: Ceres CLONE 1882925
  misc_feature: Encodes the peptide sequence at SEQ ID NO. 28322
atctccatctccatctccatggatgggtgtggatctcatcatctgctacctcatctccatcaactgcctgtctcccgcgccccccagttgccactgaagaaagccgctgatcggtcgagcagctagctagctatcttcgcttgcttgcttcttgcttggataattattagacaccatcgtcagtcagttcgatcatcgagatggctttcaaaggacttccacgcgactcccggggatctttggaagtcttcaatccagacgccgcccccacctcgcgggagcccgtcacctccccgttcctcatcgccgatgaggaggtgcaggaggacgacaaggatgctgccgtggggcgggccgcgcaaagggccgccgagtggggcctcatcctccagaccgacaagcacaccggccggccgcagggcgtcaccgcccgcccctccggctccggccacaccagcgagagtggaaactccctcgacgacaaggccgccgccggcatacctcgggtgtcggaggagctccgcgccgcgctctccgcgttccagcagaccttcgtggtgtccgacgccacccgccccgatcaccccatcctctacgccagcgccggattcttcaatatgaccggctactcctccaacgaggtcgtcggaaggaactggtgggtcgctccctgcacttgttcgcctaataatataatatatatgtatattattaattaatgattaatatctgtgc

SEQ ID NO: 28322 - protein, 172 aa, Panicum virgatum
  misc_feature: Ceres CLONE 1882925
  misc_feature: SWISSPROT Homolog: EC 2.7.11.1 Non-specific serine/threonine protein kinase
MAFKGLPRDSRGSLEVFNPDAAPTSREPVTSPFLIADEEVQEDDKDAAVGRAAQRAAEWGLILQTDKHTGRPQGVTARPSGSGHTSESGNSLDDKAAAGIPRVSEELRAALSAFQQTFVVSDATRPDHPILYASAGFFNMTGYSSNEVVGRNWWVAPCTCSPNNIIYMYIIN

SEQ ID NO: 28323 - DNA, 367 bp, Panicum virgatum
  misc_feature: Ceres CLONE 1882950
  misc_feature: Encodes the peptide sequence at SEQ ID NO. 28324
cagctagctccgcctccaactgcgcagcaagggcagagagggcgagggcgccatggcgcgggagcacggcgctgctgtcgacggagatcgtgaaccgcggcgcggagccgtccggcccggacgccgggtcgccgaccttctcggtgcgcgtgccgccccggctgccggacttcctgcagtcggtgaacctcaagtacctgcgcctcgggtaccactacctgatcagccacggcgtgtacctggccaccatccccgtcatcgtgctggtgtgccgcgcggagcctgggcagcctcacccgcgacgagctgtgggccaaggtgtggggggaggccaccttgcacccccccgcgcgcggccggagcttct

SEQ ID NO: 28324 - protein, 121 aa, Panicum virgatum
  misc_feature: Ceres CLONE 1882950
  misc_feature: SWISSPROT Homolog: EC 2.3.1.119 Icosanoyl-CoA synthase
ASSASNCAARAERARAPWRGSTALLSTEIVNRGAEPSGPDAGSPTFSVRVPPRLPDFLQSVNLKYLRLGYHYLISHGVYLATIPVIVLVCRAEPGQPHPRRAVGQGVGGGHLAPPRARPEL

SEQ ID NO: 28325 - DNA, 749 bp, Panicum virgatum
  misc_feature: Ceres CLONE 1882960
  misc_feature: Encodes the peptide sequence at SEQ ID NO. 28326
acgagctagctcatatggctacaatggaaggaccgcagatccttcttgtgctcctcgtccttacccagataagcctcaccggctgcagccctccgcgggatccggtagcctgcatcgacggcacctccaactgcaccatcagcaacgcatatggctccttcccggaccgcagcatctgccgcgcggcgagcgtcgcctacccccgcagcgagcaggagctcgtggcggccgtggcggccgcggtggcggccaagcgcaaggtgaaggtcgccacgaggtactcccacagcttccccaagctggcctgccccggcggcagcgacggcaccatcatcagcacgcagtggctcaaccggaccgtgcggatcgacgccgagaagcagctcatgacggtagagggcggcatggtgctcagggacctcatctacgccgccgccggggcagggctcgcgctgcctcactcgccctactggtacggcctcaccatcggcggcctcctgggcaccggcgcgcacggcagctcgttgtggggcaaagggggcgccgtgcacgagtacgtcatggggctgaggattgtgacgccagcaccggcgagccagggcttcgccacggtgagggatctcggcatagacgacccggacctcaacgcggccaaggtatcgatcggagttctcggcgtcatctctcaggttactctggctctgcagccactgttcaagcggtcggtctcgatggtgaactgcgatgaa

SEQ ID NO: 28326 - protein, 244 aa, Panicum virgatum
  misc_feature: Ceres CLONE 1882960
  misc_feature (57)..(204): Pfam Name: FAD_binding_4 Pfam Description: FAD binding domain
  misc_feature: SWISSPROT Homolog: EC 1.1.3.8 L-gulonolactone oxidase
  misc_feature: Functional homolog of the protein sequence given in SEQ ID NO 50472
  misc_feature: Useful for making plants with modulated nitrogen use efficiency
MATMEGPQILLVLLVLTQISLTGCSPPRDPVACIDGTSNCTISNAYGSFPDRSICRAASVAYPRSEQELVAAVAAAVAAKRKVKVATRYSHSFPKLACPGGSDGTIISTQWLNRTVRIDAEKQLMTVEGGMVLRDLIYAAAGAGLALPHSPYWYGLTIGGLLGTGAHGSSLWGKGGAVHEYVMGLRIVTPAPASQGFATVRDLGIDDPDLNAAKVSIGVLGVISQVTLALQPLFKRSVSMVNCD

SEQ ID NO: 28327 - DNA, 2128 bp, Panicum virgatum
  misc_feature: Ceres CLONE 1882964
  misc_feature: Encodes the peptide sequence at SEQ ID NO. 28328
acactgcctccaagctcgagctcccccaattcccaaatcccaaaccctaggcgactgcgggcggcggcggcgctcagcttggcggcgcgcggcagtcggcacgggcgcacgacggtctgcggcggcgctcagctcagctcgggctgctcggctcggcggcgcgccgcgcgggaaacggcgcgtgctcagccccgcgcgcggcggcgcgcggcagtcggcacgggcgcacggcgttctgcggcgacgctcagctcggctcggcggcgctcagctcagctcgggctgctcggctcggcggcgctcagctcagctcgggctgctcggctcggcggggccggcggccaggcggcgcgtccgcgcaggaaacggcgcgtgctcggcgccgcgcgcagggcgtcgcggcgaccggcgccggcgcggcgagccagcgcgccagactgccaggggagcgggcgagcggcgcaagctgcaagcaagccccgaggcggcgcggcagcaggcaggcccacacgcagagggcgaggagacagagggcgacgcgcggcttcggcgaaacgaccgaacaacgaatccacgggctgcgtcgggcgtcctctccccggcacgtgtcgctcagggagcgttcgactgctcccgtcgctccccctccagggcgcatagtaataagagttgaaagagttgttaatttgaggctgtacagttccatcagcaatgatttattgtactcactgtgctgattactgcccctccataaaggaccccgacaaaggatacatatgctgtggtacatgtggaaaggttcttgatcaggaaatatatactgatgagcctaattttgttaaagatagcacggggcagagccgcttggctggaagtattctgacaagcattgagtctggatattcaatgtcccatcaaagaactgtagaaaaagggaaggatgagattagtcagattgtcaataacttacatgtcagcggtggagatactatcatttcgaaggctcttaaatactatgagctagctcttgaccgtaattttacaaggggtcgtagaacaacacatgttgcagctgcttgcctttacattgcctgccggcaaagtaaaaaagcttatcttcttatcgatttctctgactatctgcaaataagtgtttatgtcctaggtgctgtttttctccaactttgccaagttttgctactcgcaaatcatccatttgttcaaaagcttatagatcccagccttttcatccatcgttttactcaacgtttgctggggaaaagggataatgctgtatcagacacagctttacgcattatagctagcatgaagcgagactggatgcagactggtaggaagccgagtggattgtgtggtgcagcattatacattgctgcactctctcatgggtataattacaccaaggcagatattgtttctgttgtgcatgtgtgtgaagccactctaactaagcgattgatagagttcgaaaatacagatgcgggcagcttaacgattgaagaatttctggcgacagctgatgaatgtaatcaagaatctgttccaaaatgttcactcaagcctggagaagttctttgcaagcacaaggataaatgttctgagcattttgctcatggactttgtgaaaaatgctacaagttcactaaactctcaggtggactagaaggtggttgtgaccctccagcattccaacgagctgaaaagctaagacttgaagctgctaaaagggctgaagatgctgcagcagcaaaggaggcagtgctggaagaatctctttgtgacacacagaattctgatgttgagaataccataactcctagtaagggtataagcagagataaatcttcagaagttgcatctgagggatgcacaaatgactccataccgtccaaagatcctgaaggaggaggtgaaaattgtgaaggcgatgctgatccagaaagcctttctgatattgatgatgtagaggttgattggtaccttcacaatgaggaagaaacacaatataaaaagattatctgggaggaaatgaacaaagagtaccttgaggaacaagcagcaaaggaagctttggcagctgagttggtagctagaggtgttgatgcag

SEQ ID NO: 28328 - protein, 472 aa, Panicum virgatum
  misc_feature: Ceres CLONE 1882964
  misc_feature (79)..(151): Pfam Name: TFIIB Pfam Description: Transcription factor TFIIB repeat
  misc_feature (180)..(252): Pfam Name: TFIIB Pfam Description: Transcription factor TFIIB repeat
MIYCTHCADYCPSIKDPDKGYICCGTCGKVLDQEIYTDEPNFVKDSTGQSRLAGSILTSIESGYSMSHQRTVEKGKDEISQIVNNLHVSGGDTIISKALKYYELALDRNFTRGRRTTHVAAACLYIACRQSKKAYLLIDFSDYLQISVYVLGAVFLQLCQVLLLANHPFVQKLIDPSLFIHRFTQRLLGKRDNAVSDTALRIIASMKRDWMQTGRKPSGLCGAALYIAALSHGYNYTKADIVSVVHVCEATLTKRLIEFENTDAGSLTIEEFLATADECNQESVPKCSLKPGEVLCKHKDKCSEHFAHGLCEKCYKFTKLSGGLEGGCDPPAFQRAEKLRLEAAKRAEDAAAAKEAVLEESLCDTQNSDVENTITPSKGISRDKSSEVASEGCTNDSIPSKDPEGGGENCEGDADPESLSDIDDVEVDWYLHNEEETQYKKIIWEEMNKEYLEEQAAKEALAAELVARGVDA

SEQ ID NO: 28329 - DNA, 709 bp, Panicum virgatum
  misc_feature: Ceres CLONE 1882991
  misc_feature: Encodes the peptide sequence at SEQ ID NO. 28330
ctcctgctcctctctcccgctcagcccatccccccccccccgccggttcccccccaaatctgcgcagcgtcctcgccagatttcccgcggcgtcggagatggtcgggagcgtgggcaacgggctggcggatctgggcgcctccatgaacgggaacgggaaggcggcgtcggagccgctcccgatggagatggacccgccggcggacgtgatggcggcggctgctgcggcggccgcggccgagggggaggcggcctcgaacgggaggagggagatcgtgatggggaggaacgtgcacacctcctgcttcgcggtcaaggagcccgacgcggacgacgaggagaccggcgagcgggaggccaccatggccagcgtcctcgcgctctaccgccgctcgctcgtcgagcgcaccaagcaccacctcggttacccatacaatctggacttcgattacggtgcattggggcagctgcagcacttctccattaacaaccttggagaccccttcattgagagcaactatggtgtccattccaggcagtttgaggttggagtgctggattggttcgctcgcctctgggatttagaaaaggataaatactggggatacattacaaactgtggtacagaaggaaatctgcatgggattcttgttggtagggaggtgttccctgatggaatcttgtatgcctctcgtgagtctcattattc

SEQ ID NO: 28330 - protein, 203 aa, Panicum virgatum
  misc_feature: Ceres CLONE 1882991
  misc_feature: SWISSPROT Homolog: EC 4.1.1.22 Histidine decarboxylase
MVGSVGNGLADLGASMNGNGKAASEPLPMEMDPPADVMAAAAAAAAAEGEAASNGRREIVMGRNVHTSCFAVKEPDADDEETGEREATMASVLALYRRSLVERTKHHLGYPYNLDFDYGALGQLQHFSINNLGDPFIESNYGVHSRQFEVGVLDWFARLWDLEKDKYWGYITNCGTEGNLHGILVGREVFPDGILYASRESHY

SEQ ID NO: 28331 - DNA, 1959 bp, Panicum virgatum
  misc_feature: Ceres CLONE 1882995
  misc_feature: Encodes the peptide sequence at SEQ ID NO. 28332
acggaaccaccacccagaaagcctcgccccgctcgctctcccaccgccgcgccatgagcgccgccgcgtgcctcttcgccggcgccgccgcctccccaaccccccgttccacctccgcgccggcctccgcgtgcgcaccgggcgcgcgctgccggcggagccctggccccctcctccgctcctccccggctcgccgccgcgggccggcccgggcgctcgacgagcggctgctcgaggccgcggcggctcgggatgcggaggagaccgaaggggaggaggcgggcgtcgatgtaggaggtgggttcggggacgcagagggcggtgaagtgggagggcaggcggtggtggaggaggaggagcggccgccggcgaaggcgttcgtgaagagcaggcggcagaggcaggaggaggaggagtccgccgcggggcaagacaggttcaagctcatcaacggcaaagagatatttcaagagaaggcttatctggttggtgtcgagttcaaacagaaaggagggaacctcttcggaatagaggagtctcttaaggagctggagcaactggctgatactgcagggctcgtggtcgtcggctctacctatcagaagctttctaccccaaacccaaggacttacattggttcaggcaaggtttctgaaatcaggagtgccattcacgcccttgacgttgagactgtaattttcgatgatgagctgtcccctggacaactacgtaacttggagaaatcatttggtgggagtgtccgtgtctgtgaccgaactgctcttattctggatatttttaatcaaagggcagcaacacatgaagctgctttacaggtcaccttggcacagatggaatatcaacttcctaggctgacaaagatgtggagtcaccttgaacggcaggctggaggtcaagttaagggtatgggagagaagcaaattgaagtcgacaagcgcattttgagaactcaaataggtgcattgaggaaagaattggaatctgttcgaaaacaccgaaagctgtatcgcaaccgtcgccaatcagttcctattcctgttgtttctctggtagggtatacaaatgctgggaaaagtacactcctgaactgcttaactggagccgatgtacttgcagaggacaagttatttgccacgttagacccaacaacaaggagggttttgatgaagaatgggactgagttccttctaactgatacggtcggattcattcagaagttacccactatgttggtagcagcatttagggcaacattggaggagatatcagaatcagcagttatagttcatcttgttgacatcagccatccattagcccaacagcagatagatgctgttgacagagtattgaaggagttggatgtagagtcaatccccaaattggtcgtgtggaacaagattgacaatactgatgaaccattcagagtgaaagaggaagcagagaaacaagggataatctgcatatcagcaatgaatggtgatggtctggaagaattctgcaacgccatccaagccaagctgaaagactcgatggtgccaatagaagcttttgtcccatatgacaaaggagatctactaaatgacatacataaggttggaatggttgagaaaatggagtacaaggaaaatgggacatttgtaaaagctcatgtgcctctacctctcgcaaggcttctcacacctctacggcagcaggtggtggctggcgtatgatgtgcatgtcatccagcagttcttgatgccaatggcactcacataattagctcatcttgtagattcgcaaaaagaatgtccttgttgtagaaaatttagtcatagattgcctttaccgtttctttttgatctgtggagggcatcaacacatgtgcactgaattagagagctgtatatagccacaacagaattgtaaatattgtcagctgaattttattcttttccc

SEQ ID NO: 28332 - protein, 559 aa, Panicum virgatum
  misc_feature: Ceres CLONE 1882995
  misc_feature (335)..(457): Pfam Name: MMR_HSR1 Pfam Description: GTPase of unknown function
MSAAACLFAGAAASPTPRSTSAPASACAPGARCRRSPGPLLRSSPARRRGPARALDERLLEAAAARDAEETEGEEAGVDVGGGFGDAEGGEVGGQAVVEEEERPPAKAFVKSRRQRQEEEESAAGQDRFKLINGKEIFQEKAYLVGVEFKQKGGNLFGIEESLKELEQLADTAGLVVVGSTYQKLSTPNPRTYIGSGKVSEIRSAIHALDVETVIFDDELSPGQLRNLEKSFGGSVRVCDRTALILDIFNQRAATHEAALQVTLAQMEYQLPRLTKMWSHLERQAGGQVKGMGEKQIEVDKRILRTQIGALRKELESVRKHRKLYRNRRQSVPIPVVSLVGYTNAGKSTLLNCLTGADVLAEDKLFATLDPTTRRVLMKNGTEFLLTDTVGFIQKLPTMLVAAFRATLEEISESAVIVHLVDISHPLAQQQIDAVDRVLKELDVESIPKLVVWNKIDNTDEPFRVKEEAEKQGIICISAMNGDGLEEFCNAIQAKLKDSMVPIEAFVPYDKGDLLNDIHKVGMVEKMEYKENGTFVKAHVPLPLARLLTPLRQQVVAGV

SEQ ID NO: 28333 - DNA, 778 bp, Panicum virgatum
  misc_feature: Ceres CLONE 1883006-R
  misc_feature: Encodes the peptide sequence at SEQ ID NO. 28334
ttcaggttacaaactggaggtcatggagtctcatcaagcaacaaagttggacgtttctggaactgcaaaagctgttatctcttgctttcagaaattgggtgtctcatttgacatggatgaggtaaaactagtaagggatcctgaggagcaggttaaagtggttggtgtcccagaagagcatcttgcaggtcatgcgttccacatgtaccatctcacttcacctgatgggacagtttcgtttgagtatcagcacaatgtatgtggccgttcaatatacgcagaaggaactgttgatgctgctatgtttctttacacaaagataaaatctggagccagcaagaaactgtatgacatgattgatgtcttgagagagggcaacatgagatgagacgagacctgtgcgggcgatagatgtatgcttatgtggccccaattcacaagctgaaattccaccatgaatttggtcgcctttccgatccacccaccctgcatggtaatgctcagaagtatcaatttttgtgttaggcacttttcagtttcggattagcatcttcctttagaggacaaaacgtagtggttaggtgcttgaataaatggatgtttttgcttgaatggtgtccctggtgcttagatatcaggcatggctgcttgtgcttttcctggtgtcctctgcataggagactagcgattatgacacttgcaaagttgcaatgtttctccttgtcgctgtgctgaggtctcgtgggttcagtgcatacttgatgggtattggggatcg

SEQ ID NO: 28334 - protein, 128 aa, Panicum virgatum
  misc_feature: Ceres CLONE 1883006-R
  misc_feature (1)..(122): Pfam Name: DapB_C Pfam Description: Dihydrodipicolinate reductase, C-terminus
  misc_feature: SWISSPROT Homolog: EC 1.3.1.26 Dihydrodipicolinate reductase
SGYKLEVMESHQATKLDVSGTAKAVISCFQKLGVSFDMDEVKLVRDPEEQVKVVGVPEEHLAGHAFHMYHLTSPDGTVSFEYQHNVCGRSIYAEGTVDAAMFLYTKIKSGASKKLYDMIDVLREGNMR

SEQ ID NO: 28335 - DNA, 731 bp, Panicum virgatum
  misc_feature: Ceres CLONE 1883006
attatttttttccaacgaaaatctcgccgctctcgcggaggaggacaccaccgcgcttgcttgcttttgcttgctccccccagtccgcatccaggggcgcctcgcggatcagcgaccaggccaccgccgcgtgcgcgaagccgggcgccgggcggccgccatggacgcggcagcggcgaggcggacgcgggcgctggtgaacctggcggccatcatggagcgcgccgacgaggcgctgctgcccgcggtgtaccaggaggtgggggccgagctgcacgccacgcccatggggctcggcgcgctcacgctctaccgctccctcgtgcaggccgcctgctacccgctcgccgcctacgccgccgagcggtacaaccgcgcccacgtcatcgccgtgggggccgtcctctgggccgccgccaccttcctcgtcggcgtctccgagaccttcgcccaggtagcagtagctagaggattgaatggtattggccttgcgcttgtcacccctgcaatccagtctctagtggcagattgctctgatgacaatacccgtggcgccgcatttggatggcttcaactcacaggcaacgttggttcaattattggtggtatgttttccctgatgttggcatcaaccacagtcatgggtattgcgggttggcgcgctgcatttcacattgttggcttcatcagtgtggtagtcggtgcactggtaggcctatatgcagtggacc

SEQ ID NO: 28336 - DNA, 1916 bp, Panicum virgatum
  misc_feature: Ceres CLONE 1883025
  misc_feature: Encodes the peptide sequence at SEQ ID NO. 28337
aaggaggcagggacctcctccaatggcgacccggcctgccgacctctaccctgatatgtccacgcatatacatatatgcatagccgaatagtgtgcactgtctctcccatgcttcctctctccataggtcctctcttcattcgtcctctcggaattcttgttgcaagtacagcatgatctgctacacgccatggttgctggcatgctgcctcctgctgctcttgtacagcgtcaggctcaggtctggctggagccatggccacgggccgaggagctacccggtgatcgggtgcctggtcgccttttaccagaaccggttccggctgctggactggtacaccgagctgctggcggcgtcgccgacgcagacgatcgtcgtggaccggctgggcgcgcgccggaccgtggtgaccgcgaacccggtgaacgtggagcacatcctcaagggcaacttcggcaactaccccaaggggaagcccttcaccgacatcctcggcgacctgctcggcacggggatcttcaacgtcgacggcgagctgtggtacgcacagcggaagctggtgagccacgagttctcggcgcgcgcgctccgggagctggagttcgccgtgctcgaggacgaggcgcgggaccgcctcgtgccggcgctgggcctcgccgcggcgcgcggcgacgccgtcgacatgcaggacctgctccgccgcttctccttcgacgtcatctgccgggtgtcgctcggcgttgaccccgggtgcctcgacgcggcattgccggcgccgaggctggccgcggcgttcgacgccgcggccgggatcatcgccaggcgcggcgccgcgccggtggccgccgtgtggaaggccaagcgcgcgctggacctcggctccgagcgccgtctgcgcgaggagatcagggtcatccacgaggccgtcatggacctcatccgcacccgcaagaaggagcgggcccttgtcaacggcggcgacgggcggaggagcgacctcctgtcgcggatgatcgaatgcggctacccggacgaagcgatccgcgacatggtgatcagcttcatcatggccggccgcgacacgacgtcgtcggcgctgacgtggttcttctggctgctcacgcgccaccgcgacgtcgagcgggaggtcctgcgggagatcgcgggcggcgcgagccacgccgccggcgggcagggcaagatgcgcgtgctccacgcggcgctgtgcgagacgatgcggctgtacccgccggtggcgtgggactcgaagcacgcggcggcgggcgacgtgctgcccgacggcacccgcgtggagcgcggcgaccgcgtcacctacttccagtacggcatggggcggatggagtccatctggggcgccaacgccgccgacttcagcctgcagcgctggctctccctgccggaggacacctcgccgccggccgccgtcgccggcgtgtcgccgttcaagtaccccgtgttccaggccggcccgcggacatgcctcggcaaggagatggccttcgtgcagatgaagttcgtggccagcaccgtgctccgccggttcgagctcgcccccgtcgacgagggccgcgtgccggtgttcctgccgctgatgacggcgcacatggccggcgggctcaacgtgatggtgaggagcagaggggatcagatcaccgccgcagctgcggcagcaggcagcacacccgttgctgcagctggagctcccaattgagcactccgtccagtagttaacacctcatgtaagtacagaccaattaaaatcaggattatttagttcacatatatacagttacaaattcatgaggattatactattgctgcataaaagtagtgtacactttgtaccataccatgatcaatatgaaagagatacacaacaagcatacaagtttag

SEQ ID NO: 28337 - protein, 519 aa, Panicum virgatum
  misc_feature: Ceres CLONE 1883025
  misc_feature (30)..(491): Pfam Name: p450 Pfam Description: Cytochrome P450
  misc_feature: SWISSPROT Homolog: EC 1.14.14.1 Unspecific monooxygenase
  misc_feature: Functional homolog of the protein sequence given in SEQ ID NO 51170
  misc_feature: Useful for making plants with modulated nitrogen use efficiency
MICYTPWLLACCLLLLLYSVRLRSGWSHGHGPRSYPVIGCLVAFYQNRFRLLDWYTELLAASPTQTIVVDRLGARRTVVTANPVNVEHILKGNFGNYPKGKPFTDILGDLLGTGIFNVDGELWYAQRKLVSHEFSARALRELEFAVLEDEARDRLVPALGLAAARGDAVDMQDLLRRFSFDVICRVSLGVDPGCLDAALPAPRLAAAFDAAAGIIARRGAAPVAAVWKAKRALDLGSERRLREEIRVIHEAVMDLIRTRKKERALVNGGDGRRSDLLSRMIECGYPDEAIRDMVISFIMAGRDTTSSALTWFFWLLTRHRDVEREVLREIAGGASHAAGGQGKMRVLHAALCETMRLYPPVAWDSKHAAAGDVLPDGTRVERGDRVTYFQYGMGRMESIWGANAADFSLQRWLSLPEDTSPPAAVAGVSPFKYPVFQAGPRTCLGKEMAFVQMKFVASTVLRRFELAPVDEGRVPVFLPLMTAHMAGGLNVMVRSRGDQITAAAAAAGSTPVAAAGAPN

SEQ ID NO: 28338 - DNA, 702 bp, Panicum virgatum
  misc_feature: Ceres CLONE 1883034
  misc_feature: Encodes the peptide sequence at SEQ ID NO. 28339
caaccgggcgcgggctcctccaccgcgcccccagcaactcccacccgcggcgggttctagaaccttccagaacccagggcttccgggggactggtggaagcggcgcggagatctctgcggcgcggcccatggcgggcccgtgctgagggcggcgcgcgccggcgtgcgggatccgtggggagggcggtgcgctcgagatcccgatgcagatccgggaggggcccgggcggcggccggcgccgtccgccgtcggggcgctgcggtcgccgatgtctgccatgatgctcgccatggtcgccaccatggcctccttctacgtcgccggccgattgtggcaggatgctcagaacagagtttacctcattaaagagctcgacagacgaacaggccaggggcaatcggctatatctgtggatgataccttgaaggttgttgcatgcaggcagcaagggaagaggttggcatcacttgagatggagctggctgcagcaaagcatgaaggatttgtggggaaatacacccctgagacaaatggaactcattctagaaagaagccactgattgttattggaataatgagtaacttcggccggaaaaactaccgtgatgctgtcaggaaatcatggcttccaacaggttcaatgctgaagaaactagaagaagaaaaaggcattgtagtgcgtttcatagttggaagaagtg

SEQ ID NO: 28339 - protein, 166 aa, Panicum virgatum
  misc_feature: Ceres CLONE 1883034
  misc_feature: Functional homolog of the protein sequence given in SEQ ID NO 51278
  misc_feature: Useful for making plants with altered carbohydrate content
MQIREGPGRRPAPSAVGALRSPMSAMMLAMVATMASFYVAGRLWQDAQNRVYLIKELDRRTGQGQSAISVDDTLKVVACRQQGKRLASLEMELAAAKHEGFVGKYTPETNGTHSRKKPLIVIGIMSNFGRKNYRDAVRKSWLPTGSMLKKLEEEKGIVVRFIVGRS

SEQ ID NO: 28340 - DNA, 776 bp, Panicum virgatum
  misc_feature: Ceres CLONE 1883041
  misc_feature: Encodes the peptide sequence at SEQ ID NO. 28341
atcacactgattgctgaagatgagttcctccacgtccagcgctctcgtgctagcagcagcagtgctcctagcagcactgaccgtagcacagcatggctccctcgccgcagccgccggccccagggtcatcatcgtcggcgccggcatgtccggtcatcatatatatgccatatatcaaccacatctgccctgaccatgttgatgagatcgatatgatgaggaatatatgctgtggatacttgatttttgtgcagggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggacggtggcctctacgatgaagcttacgttcagaagataattgaccgagcggatgccgtggaaagtaaaggagagaagctgtctgccagtttgcccgccagtggaagcgacgacatttcaatccttgcaatgcagcgcctctacgatcaccagccgaacgggccggcgacgccggtggacatggtggtggactacttcaagtacgacttcgagggggcggagccgccgcgcgtgaccagcctgcagaccacccgtccctacccgacggtcgccg

SEQ ID NO: 28341 - protein, 183 aa, Panicum virgatum
  misc_feature: Ceres CLONE 1883041
  misc_feature: SWISSPROT Homolog: EC 1.5.3.11 Polyamine oxidase
MLWILDFCAGISAAKTLSEAGITDLLILEATDRIGGRMHKKNFSGINVEIGANWVEGVNGGKMNPIWPIVNETLKLRNFLTDFSVATNIYKEDGGLYDEAYVQKIIDRADAVESKGEKLSASLPASGSDDISILAMQRLYDHQPNGPATPVDMVVDYFKYDFEGAEPPRVTSLQTTRPYPTVA

SEQ ID NO: 28342 - DNA, 776 bp, Panicum virgatum
  misc_feature: Ceres CLONE 1883043
  misc_feature: Encodes the peptide sequence at SEQ ID NO. 28343
aacgagcggcggctcctctcctctcctgtcctctgctctgctgttcggagcagcctgttccaacccgactcctccatcttccttcgcgcgaggcctggtggccgatcggctggccggttccgatccggcggggcttggtgctcgaggcgatcgcatcgtcgtcatcggccgctcgcgccgttcgattgggggccatatggacaaccccgcgccgccaccgaatgccgcggccggcgcgccgtcgccgtcgccgtcgcggcggctgccggacttccagcagtcggtgcgtctcaagtacgtgaagctggggtaccactacctcatctcccacggcatgtacctgctgctcaccccgctgatggcgctcgtggccgtgcacctctccacgctctccccgcgcgacgtcgccgacctgtgggcgcacctccgcctcaacctcgtctccgtgctcgcctgctccgcgctcctcgtcttcctcgccaccgcctacttcctcacccggccgcgccccgtgtacctggtcgacttcgcctgctacaagccggggcccgagcgccggtgctcgcgcgacaccttcatgcgctgctcccgcctcacgggctccttctctgacgccagcctcgagttccagcgcaagatcctcgagcgctcagggctcggcgaggacacgtacctgccccccgccgtcacgagcgtgccgcccagcccgtccatggacgcggcgcgcgccgaggcgcgggaggtcatgttcggcgccgtggacgagctgctcgccc

SEQ ID NO: 28343 - protein, 193 aa, Panicum virgatum
  misc_feature: Ceres CLONE 1883043
  misc_feature (98)..(193): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MDNPAPPPNAAAGAPSPSPSRRLPDFQQSVRLKYVKLGYHYLISHGMYLLLTPLMALVAVHLSTLSPRDVADLWAHLRLNLVSVLACSALLVFLATAYFLTRPRPVYLVDFACYKPGPERRCSRDTFMRCSRLTGSFSDASLEFQRKILERSGLGEDTYLPPAVTSVPPSPSMDAARAEAREVMFGAVDELLA

SEQ ID NO: 28344 - DNA, 712 bp, Panicum virgatum
  misc_feature: Ceres CLONE 1883047
  misc_feature: Encodes the peptide sequence at SEQ ID NO. 28345
acttttccgcccgcgctgcgtcgccgtttgcgtcgatggcgatggagattccggcggaggtgcgccgctactggctgccgatcctactctgcaccgctggtttcctcttccagcttctcgtcctgccccgccacttcccgcgcacccactacgacgtgctgggaatcgagaggtttgcgccggtggagcgggtcgtcgaggcctacgagcggctatccaaggagtggctaactgaaacgaatcaccaaccaactgttgatattataaagatccgttatgcatacgagctgttgacaaatccaattttaaagagggattatgatctttttggactggatgagcatatggatgtccttgagagagtcaaagagcaatatcaaaaggaacactttctgaaaatagatctcccattgttaaaagactctgcagttagtttgactgatgatgccttcaatgtactcacacatgagtcattcatgtctgctattgctgaagaatacccactaataataatggtatattcaaagggtagtcctcggtgtgctcaatttattgagtactggaagcaaattagcgctcgattagatggtatcgccaaaactgctatggtagaagttggtgattcacaactggctggtcatttcgccgaaaaagggttctccaaacaaccatttttccgtaatggtgtaccagcaattgttgcataccctgc

SEQ ID NO: 28345 - protein, 225 aa, Panicum virgatum
  misc_feature: Ceres CLONE 1883047
  misc_feature (37)..(96): Pfam Name: DnaJ Pfam Description: DnaJ domain
MAMEIPAEVRRYWLPILLCTAGFLFQLLVLPRHFPRTHYDVLGIERFAPVERVVEAYERLSKEWLTETNHQPTVDIIKIRYAYELLTNPILKRDYDLFGLDEHMDVLERVKEQYQKEHFLKIDLPLLKDSAVSLTDDAFNVLTHESFMSAIAEEYPLIIMVYSKGSPRCAQFIEYWKQISARLDGIAKTAMVEVGDSQLAGHFAEKGFSKQPFFRNGVPAIVAYP

SEQ ID NO: 28346 - DNA, 2263 bp, Panicum virgatum
  misc_feature: Ceres CLONE 1883053
  misc_feature: Encodes the peptide sequence at SEQ ID NO. 28347
acacccgcaaagccaccgccgcacggcgactcctcctctcctcacctgcccggctgcccttccccctctctcaattcgaggcgggcgcccctcgtcgccggcgacgaccgaagcggcgcccgtagcatcgcagctccggcgccggcgagcgcgcccgcccggcggaggcggcggccgagatggcgatgcggcacctcgtcacgggccagaacagctgcgccccggacggcgcctcgtcgtccaaccccctcaacgccttcgccaacgccgtcctcggccagtcctccaagactcagtccattaaggaacttcctggctcagtcagtgttccgtctacgtctgagtttggcacagctcctcccttgtcaaccatccccggttcagagaatgagttcaaacaagatcagcgaccccttgcacggggtgcagacttcattcgtgggggtcccgctaatgattggattgaatcttttcgccctccaggggctcctgaatttggaggagcagaatcacaatacgcagaatttgaccaaatctataacaatgcagggacaaccatcagaccacccttggatggtccaccacaaagggtgttgtctggtgtcttgcattcttttcttgcaagtggcagagctggtgtgccgtttcaacctgttccattaccagctcttggtttatctgaaagcgacaaacaatgcatacgtgatcgtagctgcataatggcacgacatattctggctgaccaaccagaggaatatatacaggctcaggtcaatactttgttgcattcgcttgatattgacaaccgaatgagagggcctatgcatggacagtacccagagctggagcagtactggaatcagtcccaaagttctatgggacctgcctcgatgcataatgctgcagataaatggattaccgagtttggcaatcaaaataataacccagaaagttgggcaaattctttcgagcagcaatatggcccgaatggttgggcctctgagtttgaacagcatcaacctcagatggccatgggtcagatgggaggagcgaacatggctaacctggctgctatggagcaatcccgtatgcttgcacaaacattagcaagtaataacgaccccaagtttcagctttcacgaggggcggataaatgggctagcgagttcgctagtaaacataatcagggcgcgttaaatgataactgggttgacgagttttcaaaattaaatgttactgacgaatgggcagaagaattcagtggtggtggttttggtgaaagctctgctgatccatgggcagatgagttccaagaacaattgtcatccttcaaacaaagctcgggtgcttctcgaggggtttatgttttttctgagatgaacccgtatgttggtcaccctaatccaatgcaagaaggacaagagctcttccgcaagggcctcttaagtgaagctgttcttgctttagaggctgaagttttgaagaatcctgataatgctgaaggttggaggttgctaggagtaacacatgcagaaaatgatgatgaccaacaggccatcgctgcaatgatgcgtgcgcaggaagctaatccgacaaaccttgaagttcttctcgctctaggtgtcagtcacacaaacgaattggagcagggagaagcattaagatatctttataggtggcttcagaatcatccaaaatatgggggccttgcccctccacaggcgactgattcaccttatggtccagatgttgttaggttgtttaatgaagctgctcagatgtcacctgaagatgcagacgtccatatagttctgggagtcttatacaacctatcaagagagtatgataaagctatagcttcatttaagacagcactacagctcaaacctcaggactattcactctggaataagcttggtgcaacccaagcaaacagcatccagagtgctgatgcaatattggcatatcagaaggctctagacttgaaaccgaactatgtccgtgcatgggctaatatgggaatcagctatgccaaccagggtttgtacgaagattctattcgatactatgtaagagcagttgcgatgaatccgaaagctgacaacgcctggcagtacttgaggatttctctcagcaatgcgtcacgagctgacatgattgctgcatgtgatgcccgcaacctcgacgctcttcagaaagagtttcctctctgagtcccggtcctgaacatcagctcttgagcagatcctcatccagcaaggga

SEQ ID NO: 28347 - protein, 677 aa, Panicum virgatum
  misc_feature: Ceres CLONE 1883053
  misc_feature (539)..(572): Pfam Name: TPR_1 Pfam Description: Tetratricopeptide repeat
  misc_feature (607)..(640): Pfam Name: TPR_1 Pfam Description: Tetratricopeptide repeat
  misc_feature (440)..(473): Pfam Name: TPR_2 Pfam Description: Tetratricopeptide repeat
MAMRHLVTGQNSCAPDGASSSNPLNAFANAVLGQSSKTQSIKELPGSVSVPSTSEFGTAPPLSTIPGSENEFKQDQRPLARGADFIRGGPANDWIESFRPPGAPEFGGAESQYAEFDQIYNNAGTTIRPPLDGPPQRVLSGVLHSFLASGRAGVPFQPVPLPALGLSESDKQCIRDRSCIMARHILADQPEEYIQAQVNTLLHSLDIDNRMRGPMHGQYPELEQYWNQSQSSMGPASMHNAADKWITEFGNQNNNPESWANSFEQQYGPNGWASEFEQHQPQMAMGQMGGANMANLAAMEQSRMLAQTLASNNDPKFQLSRGADKWASEFASKHNQGALNDNWVDEFSKLNVTDEWAEEFSGGGFGESSADPWADEFQEQLSSFKQSSGASRGVYVFSEMNPYVGHPNPMQEGQELFRKGLLSEAVLALEAEVLKNPDNAEGWRLLGVTHAENDDDQQAIAAMMRAQEANPTNLEVLLALGVSHTNELEQGEALRYLYRWLQNHPKYGGLAPPQATDSPYGPDVVRLFNEAAQMSPEDADVHIVLGVLYNLSREYDKAIASFKTALQLKPQDYSLWNKLGATQANSIQSADAILAYQKALDLKPNYVRAWANMGISYANQGLYEDSIRYYVRAVAMNPKADNAWQYLRISLSNASRADMIAACDARNLDALQKEFPL

SEQ ID NO: 28348 - DNA, 1840 bp, Panicum virgatum
  misc_feature: Ceres CLONE 1883059
  misc_feature: Encodes the peptide sequence at SEQ ID NO. 28349
aaaaagaagaaaatctccgcttctccacgcctctgctcctccgctgcgtatgcgtccctctcgtctcgtgtgaccagctgcggagcaggcgaccaggcataaacgccctgcgcgcgcagcgcggcggcggcaatggcgcccacggcctgcctccggttcccctatctcccggctcgagccccggcccgctccgccaacccggccgccacctacccgtcgccccaccgcccctccctgaaatgcagcgccgccaacggcgacagctccatctccagccccaattccatctccatctccccgatctcgccaccgcgggcgacggtggcggacggcgttgagtcggcggatgccaacgggctgcgccgcccgcccgcgcccgtctccggcctcaccgtccctggcgcccgcgattcccactggttgcctcggccgctcactagtgcgaacgtcttggatgcgaatgggaagggactcaaggttgcttaccagggttgccctggggcgtacagcgaggcagcagcaaaaaaggcatacccgaattgtgagactgtgccctgcgagcacttcgatactgcatttcaggctgttcaaaactgggtggctgatagggctgtactgccacttgagaattcattgggaggtagcattcatcgtaactatgaccttttgcttcggcatagtttgcacattgttggagaagttcgccttgcagttcgtcattgcctgttagccaatcctggcgtgaagattgaaaacctgaaaagtgctatgagtcatccccaggctcttgcgcaatgtgagcacacattgacagagttaggaatcgagcacagagaagctgttgatgacactgctggcgcagcaaagtttgttgcagaagaaatgctccaggacactggtgctattgctagttcattggctgccaaactgtatggactagatgttcttgctgagaatattcaggatgacaaagataatgtcacccgttttatgatgctagctcgagaacccatcatacctcgcactgataaaccattcaagactagtatagtcttttcactagaagaagggcctggacagctcttcaaggctcttgctgtattcgcactgaggcaaatcaatctgacaaagattgaaagtcgtccacacaaggaaaggcctcttcgtgtatccgatgactgtctattaaagaacttcgattacctcttttatgtcgaccttgaggcttcaatggctgatccaaaaactcagaatgctctaggaaatttgaaggagtttgcaacctttttaagagtcctgggaagctatcctacagatgtgaatgaaccttagatagcaagtatctacagatcacatgctggatttgcagaaactgggtgaaatgggcaggcagttggaaagacaggagcaattatcagcctactggtaattttgatggggcaaaatggattatctgcattagaattgtagagcatgggaggcatgcatttggttatgatattgggaagaagatcacatcttttgctgctgatgttcttctatgcaaggaccgaggaggataccttaaagagatgatttcttttatctccaattatgcaggagcctgttagaacgcatatatagatcaagggttggatatttgatttgtgaaaaacagctatagcagaatagttttgtgtgttagtttggttgtttaaaccctcctgctgcctaaaaaagtttatgtgttttaattgaactgttttgtcattgcggcaagcaatgatcctgtcatgtgcactgtagtatcatggcaaaattccaaagaactgttgtgtttccttgttcatttggatgactc

SEQ ID NO: 28349 - protein, 399 aa, Panicum virgatum
  misc_feature: Ceres CLONE 1883059
  misc_feature (116)..(294): Pfam Name: PDT Pfam Description: Prephenate dehydratase
  misc_feature (304)..(381): Pfam Name: ACT Pfam Description: ACT domain
  misc_feature: SWISSPROT Homolog: EC 4.2.1.51 Prephenate dehydratase
  misc_feature: Functional homolog of the protein sequence given in SEQ ID NO 50370
  misc_feature: Useful for making plants with altered lignin content
MAPTACLRFPYLPARAPARSANPAATYPSPHRPSLKCSAANGDSSISSPNSISISPISPPRATVADGVESADANGLRRPPAPVSGLTVPGARDSHWLPRPLTSANVLDANGKGLKVAYQGCPGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCEHTLTELGIEHREAVDDTAGAAKFVAEEMLQDTGAIASSLAAKLYGLDVLAENIQDDKDNVTRFMMLAREPIIPRTDKPFKTSIVFSLEEGPGQLFKALAVFALRQINLTKIESRPHKERPLRVSDDCLLKNFDYLFYVDLEASMADPKTQNALGNLKEFATFLRVLGSYPTDVNEP

SEQ ID NO: 28350 - DNA, 703 bp, Panicum virgatum
  misc_feature: Ceres CLONE 1883060
  misc_feature: Encodes the peptide sequence at SEQ ID NO. 28351
gcatcccagcacgagcagctcgttctcgttcatcaccgaccctcaccgtctcgtctccctgctccgctccccacacgcgctcgcccctccctccctccctctctcccctcctcaccgccgctcgcgccccgtgccgtttccgccatgtgtggcatcttcgccgtgctcgggtgcgccgactgctcccaggcccagagggcgcgcgtcctcgcctgctcccgcagcgtgtgcaggctgaggcaccggggacccgactggtcgggggtgtaccagcacgagggcaacttcctcgcccagcagcggctcgccgtcgtctccccgctgtccggcgaccagccgctcttcaacgaggaccgcaccgtcgtcgtcgtggccaatggggagatctacaaccacaagaagatccggaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgacggtcccgtctggttcgcctccgagatgaaggcgctgaacgaggactgcgtccggttcgagcacttcccgccggggcacctctactccagcg

SEQ ID NO: 28351 - protein, 186 aa, Panicum virgatum
  misc_feature: Ceres CLONE 1883060
  misc_feature (2)..(165): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGIFAVLGCADCSQAQRARVLACSRSVCRLRHRGPDWSGVYQHEGNFLAQQRLAVVSPLSGDQPLFNEDRTVVVVANGEIYNHKKIRKQFTGKHTFTTGSDCEVIIPLYEEYGENFVDMLDGVFAFVLYDTRNKTYMAARDAIGVNPLYIGWGGDGPVWFASEMKALNEDCVRFEHFPPGHLYSS

SEQ ID NO: 28352 - DNA, 657 bp, Panicum virgatum
  misc_feature: Ceres CLONE 1883060-R
  misc_feature: Encodes the peptide sequence at SEQ ID NO. 28353
aaatgatgaacaacgctgccaaatgtaccccctacaacacgccggtcaacaaggaggcctactactacaggatgatcttcgagaggctcttccctcaggactcggcgagggagacggtgccgtggggcccgagcatcgcgtgcagcacgcccgcggccatcgagtgggtggagcagtggaaggcctccaacgacccttccggccgcttcatctcctcccacgacgccgccaccggccacggcgccggaggcgcgcacgctaacggcaacggcgtggcggccgtggcgaacgggcacggcccggccaacggcgcggtcaacggcggcgaggtcgccgtggcgaacggtcacggcgcggcgaacgggaacgaggtcgccgtcgcgatcgcggtgtgactttgttggctcatcagggataaggacgacgagtaggttgcggcgtggcgtgtcagccggtcgccatgacatggtgcggtggcacacgtgctactagcctactattgtttttacgcggtgttgtactgtcactagcgtaagtgcgcgtgtgtgagcgagcgagcgagccatggaggcatgtgtgtgttgtgccgggttgatgtcctcgaactcgatctttctaaagacttgagctacggatcaatctaaagatgttttgttt

SEQ ID NO: 28353 - protein, 130 aa, Panicum virgatum
  misc_feature: Ceres CLONE 1883060-R
  misc_feature: SWISSPROT Homolog: EC 6.3.5.4 Asparagine synthase (glutamine-hydrolyzing)
MMNNAAKCTPYNTPVNKEAYYYRMIFERLFPQDSARETVPWGPSIACSTPAAIEWVEQWKASNDPSGRFISSHDAATGHGAGGAHANGNGVAAVANGHGPANGAVNGGEVAVANGHGAANGNEVAVAIAV

SEQ ID NO: 28354 - DNA, 716 bp, Panicum virgatum
  misc_feature: Ceres CLONE 1883072
  misc_feature: Encodes the peptide sequence at SEQ ID NO. 28355
ctttaccccgatccgcccccaaaccctaaccgtctaaaaccccgggcccctctccgatggccgccgccccgccgccgccctccccaccctccgccaagcgccccaagatgtcttcctcgtccgacccggaggccgacgccgagcccacctcgccctccgtcgccgccgaccccgggcagccccgccgccccaggtacaagcgccgcaaagtcgccatcctcctcgggtactgcggcgccgggtaccagggcatgcagaagaacccgggcgcgcgcaccatcgagggcaacctcgaggaggcgctctaccagtcgggcgccgtgcccgaggccgaccgcgccgcgccgcgccggtacgactgggcgcgcgccgctcgcaccgacaagggcgtcagcgccgcggcgcaggtggtgtccggacgcttctacgtcgacccgccgggcttcatcgaccgcctcaacgcccagctcgcgccgcagatccgcgcctacggctacgtgcgcgtcaccaactcgttcaacgcgaagaagttctgcgaccggaggaggtacctgtacctgctccctgtgttcgcgcttgaccccagcgcgcacccggaccgcgaggccgtcatggcgagcatggggagtgggagcgagctgacgaagtgcctggagtgctctgagagggggaggaaggtgcctggtgtcatgggccgggagggggagcttcctggc

SEQ ID NO: 28355 - protein, 219 aa, Panicum virgatum
  misc_feature: Ceres CLONE 1883072
  misc_feature (54)..(159): Pfam Name: PseudoU_synth_1 Pfam Description: tRNA pseudouridine synthase
  misc_feature: SWISSPROT Homolog: EC 5.4.99.12 tRNA-pseudouridine synthase I
MAAAPPPPSPPSAKRPKMSSSSDPEADAEPTSPSVAADPGQPRRPRYKRRKVAILLGYCGAGYQGMQKNPGARTIEGNLEEALYQSGAVPEADRAAPRRYDWARAARTDKGVSAAAQVVSGRFYVDPPGFIDRLNAQLAPQIRAYGYVRVTNSFNAKKFCDRRRYLYLLPVFALDPSAHPDREAVMASMGSGSELTKCLECSERGRKVPGVMGREGELP

SEQ ID NO: 28356 - DNA, 749 bp, Panicum virgatum
  misc_feature: Ceres CLONE 1883103
  misc_feature: Encodes the peptide sequence at SEQ ID NO. 28357
acacgagccacgagcacgggtcgtcgccgttcgcccgcgtccgcacgcacgcacgcacgctcgctcgctcgccgccagagcagagctctcgggctctccgcccgccccgctcccagaaggtccgaccgcggcggcgggcgatggcgcggaagaagatccgggagtacgactccaagcgcctcctgcgggagcacctcaagcgcctcgccggcatcgacctccagatcctctccgcgcaggtcacacaatcaacggatttcactgagcttgcaaaccaggagccatggctctcatctatgaagttggttgtgaaaccagacatgctgtttggtaaacgtgggaagagtggacttgtggccctcaacctagaccttgcccaagttcgccaatttgttaaggagcggttgggagttgaggttgagatgggtggctgcaaagctccaattacaaccttcatagttgagccatttgtgccccatgatcaagagtactacctttcgattgtatcagacaggcttggctgcaccattagtttctccgagtgtggaggtattgagattgaggagaactgggacaaggttaagacaatctttcttcccacagagaagcaaatgacacctgatgcatgtgctcctttgattgccaccctgccattggaggtccgcacaaaaataggtgatttcattagaggtgtattttctgttttccaagacttggatttctcatttcttgagatgaacccattcacc

SEQ ID NO: 28357 - protein, 202 aa, Panicum virgatum
  misc_feature: Ceres CLONE 1883103
  misc_feature (5)..(202): Pfam Name: ATP-grasp_2 Pfam Description: ATP-grasp domain
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKQMTPDACAPLIATLPLEVRTKIGDFIRGVFSVFQDLDFSFLEMNPF

SEQ ID NO: 28358 - DNA, 3073 bp, Panicum virgatum
  misc_feature: Ceres CLONE 1883129
  misc_feature: Encodes the peptide sequence at SEQ ID NO. 28359
gtaaaaagattgttgcgttagaagccagtttttgcctttccagtccctgttcctgttctcgcttgtcgtccatctccccgagtcattcattgtcctggctgctgctgctgcttcttggatttggatccccactgcaaaattcttgtttgctcccgtggcgttgcttcacctgcgacggcgagggcggcggaattgaagagagcgagggcgacatctgctgatagttgcggtgcacttgttgcggtctgtcctgctcgtcctctcacaaggcaagtcctccaagccgggagaaatcttcgcccgaatactcgcctttctccgctctcgattcggcagcgccgcggcggcgagcatcccgtgcatgggcgcagcacggtgacgcgtgcgcgagagaaggggtcccatggatgcggcggagagcagccgcggcgccgcgggtgcgcgcaagaagtcatggcggtcggagctggtgctggcctaccagagcctcggcgtcgtgtacggcgaggtggtcacgtcgccgctctacgtgtacaagagcgccttcgccggcggcgacatcgagcactcggagggcaacgaggagatctacggcgtgctctcgctcgtcttctggacgctcaccctcatcacgctcctcaagtacgtgctcgtcgtgctgcgcgccgacgacgacggcgagggcggcaccttcgcgctctactccctcatatgccgccgggtcggcgcggggctcctccctggcgccggcgacgacctcaaggggcagcgcggcggcgcggcgccgcctcccgcgtcgagcgtgcgcacggcgctgcagcagcgcagggagctgcagtggctgctcctcctgttcgcccttctcggaacgtccatggtcatcggcgacggcgtgctcacccctgctgtatccgtgctctcggcggtttcagggctcaagctgtcaatggtcgatgaacaacaccaatatgttctgcttccagtaacatgtgtgatactggtaggcttgttcgctttgcaacactacggcacacacagggtcggatttctcttcgcgcctattatttgcctgtggctcctctgcatcagcatcataggggtctacaacatcatcaattggaatccccatgtctacaaagccctttcaccatactacatgtaccgatttctgcagaagacgcaatatggaggctggatgtcactgggtgggatccttttatgtgtaactggttctgaagctatgtatgcagaccttggacatttctcacagtcatcgatcaagttagctttcacgatggtggtttatccgtcactcatactagcctatatgggacaagctgcttacatttcacggcatcacagttttgagaagaaccaccatattggattttacgtatcagttccagaaaaaatcagatggcctgttctggggattgcaatacttgcagctgtagttgggagccaagcagttattactggtacattctcagttataaagcaatgttgttccttaaattgctttccaagggtgaagattgtgcatacatcttccacagtacatggccaaatatatattccagagatcaattggatcttaatgctactgtgcttggctcttacaataggcttcagagatacaaagcacatggcaaacgcacaagggttggcagttataacagttatgattgtcacaacttgcttgatgtcactcgtcattatcctttgctggaataagaatattgtatttgctctttctttccttcttttctttggtgcaatcgaagccatctacttctcagcatcccttgtgaagttccatgaaggagcttgggtacctataattctttccttcattttcttgatggtgatgtgcgtgtggcattatggcactgcaaagaagtacgagtttgatgtagaaaataaggtgtcaataagttggctattgaatctaggcccttcattgggtattgttcgtgtccgaggcattggcctgatatacacagatcttatatctgggattcctgctattttctcccactttgtcaccaatcttcctgcatttcatcaggttctggtctttctatgcattaaatcagtgtctgtaccacatgtccaaccggaggagcgatttttggtgggccgcattggcctgaaacaatacagcctatacagggtagttgttcgatacgggtaccgggatgtgcagcaggacagcctagagtttgagaagaccctggtgagcagcattgcagagttcatccgctctggggattccgacctaaatggtcatctggatggttcagacagtccctatgagaagttatctgtcatcagcaaaggtctaccatttcagaaggacggagagcctgaagcatcacccgaatcatccactcctaaggagacaaacccgaaattggtatcatccaagtcgagaagagtgaggtttgtgctcccagaaaatgcgcagatgaatagtgaggtgcgtagcgagctgcaggagctgactgaggcaagggaggcaggcatgtccttcattatggggcgctcgtatatgagggcaaagagcggatcaagcatgatcaagcggatcgccataaactttatctacgagttcctgatgaggaacagcagaagccctgcttacgcggctaacgtgcctcatgtttccacccttgaggtagggatggtttgccaagtctgatgtagtgaccatcaccatgccaagttgtatagagttagaaacagtttatctcatatacctgtatatatatatcccaacaaaagtgatagatggttggtgaagcagggcatcattggggcctgcaggtgcagatcttggatacatgaagtgtgcatagttttttctttgtattcttgtgattagagttcatccttgatctggctttttttcaactgccgttgtcgtttctatgaactaaggtgacagagcacagtgcaggagggagagcttttttgtgtgcgtgaattggtgtgtgaccaattatttgtactggatcagaatctgaataagttgaagctgaaatagttttatcagacttcagagaggagactg

SEQ ID NO: 28359 - protein, 765 aa, Panicum virgatum
  misc_feature: Ceres CLONE 1883129
  misc_feature (23)..(765): Pfam Name: K_trans Pfam Description: K+ potassium transporter
  misc_feature: Functional homolog of the protein sequence given in SEQ ID NO 50430
  misc_feature: Useful for making plants with modulated biomass
MDAAESSRGAAGARKKSWRSELVLAYQSLGVVYGEVVTSPLYVYKSAFAGGDIEHSEGNEEIYGVLSLVFWTLTLITLLKYVLVVLRADDDGEGGTFALYSLICRRVGAGLLPGAGDDLKGQRGGAAPPPASSVRTALQQRRELQWLLLLFALLGTSMVIGDGVLTPAVSVLSAVSGLKLSMVDEQHQYVLLPVTCVILVGLFALQHYGTHRVGFLFAPIICLWLLCISIIGVYNIINWNPHVYKALSPYYMYRFLQKTQYGGWMSLGGILLCVTGSEAMYADLGHFSQSSIKLAFTMVVYPSLILAYMGQAAYISRHHSFEKNHHIGFYVSVPEKIRWPVLGIAILAAVVGSQAVITGTFSVIKQCCSLNCFPRVKIVHTSSTVHGQIYIPEINWILMLLCLALTIGFRDTKHMANAQGLAVITVMIVTTCLMSLVIILCWNKNIVFALSFLLFFGAIEAIYFSASLVKFHEGAWVPIILSFIFLMVMCVWHYGTAKKYEFDVENKVSISWLLNLGPSLGIVRVRGIGLIYTDLISGIPAIFSHFVTNLPAFHQVLVFLCIKSVSVPHVQPEERFLVGRIGLKQYSLYRVVVRYGYRDVQQDSLEFEKTLVSSIAEFIRSGDSDLNGHLDGSDSPYEKLSVISKGLPFQKDGEPEASPESSTPKETNPKLVSSKSRRVRFVLPENAQMNSEVRSELQELTEAREAGMSFIMGRSYMRAKSGSSMIKRIAINFIYEFLMRNSRSPAYAANVPHVSTLEVGMVCQV

SEQ ID NO: 28360 - DNA, 1941 bp, Panicum virgatum
  misc_feature: Ceres CLONE 1883138
  misc_feature: Encodes the peptide sequence at SEQ ID NO. 28361
atccgaacgacgacgaagcaccagaggtagctagccacaccgaccaggaggatccaccgcgtcgctgctgctacccgagagagaccgtcgagactagccatgtcgtcggggatggagacggccggcggcggcgtcgaggacgcgtacggcgaggaccgcgccaccgaggagcagctcatcacgccctgggcattctccgtcgccagcggctacaccctgctgcgcgacccgcggcacaacaagggcctggccttctcggaggcggagcgcgacgcgcactacctgcgcggcctgctgccccccgcgctggcgtcgcaggagctccaggagaagaagatcatgcacaacctgcgccagtacgaggtgcccctgcaccgctacatcgccatgatggacctgcaggagcgcaacgagcgcctcttctacaagctcctcatcgacaacgtcgaggagctgctccccgtcgtctacacgcccaccgtcggcgaggcctgccagaagtacggcagcatctacaggcgcccccaggggctctacatcagcctcaaggacaagggcaagatccttgaggtgctcaagaactggccggagaggagcatccaggtcatcgtcgtcaccgacggcgagcgcatcctggggctcggggacctgggctgccaggggatggggatccccgtcggcaagctgtcactctacaccgccctcggaggtgttcgcccatctgcttgcctgccgatcacaattgatgttggcacccttgcagaccacacctacctcttcctcggcgccggcgaggcaggaactggcattgctgatctcattgctcttgagatgtcaaaacatacggatactccgatcgacgactgccgcaagaagatctggctggtggactccaagggcctgatcgtggagtcgcgcaaggagtcgctgcagcacttcaagcagccgtgggcgcacgcgcacgagcccctcaagaccctgctggaggccgtggagtccatcaagccgacggtgctgatcggcacctccggcgtggggcgcaccttcaccaaggaggtggtggaggccatggcgtccttcaacgccaagcccgtcatcttcgcgctgtccaacccgacgtcgcactcggagtgcacggccgagcaggcctacagctggtcccagggccgcgccgtgttcgccagcggcagccccttcgaccccgtcgagcacgacggcaaggtgcacgtccccggccagtccaacaacgcctacatcttcccggggttcggcctcggcgtcgtcatctccggcgccatccgcgtccacgacgacatgctgctggccgcgtcggaggcgctggcggagcaggtgaccgacgagcacttcgccaaggggctcatcttcccgcccttcaccaacatccgcaccatctcggcgcgcatcgccgccaaggtggccgccaaggcctacgagctcggcctcgccagccgcctgccgcgccccgacgacctcgtcaagtacgcccagagctgcatgtacaccccaacctaccgcaactaccggtaagcaccattgctgccggcggccgaggaggaaaggaggggcaccatttttgctgctgcagggtcgtcgtgagtgagtcggtgaataaatttgttcagctggagcttgttgctgctgctagaggagtttaaacgttgttttgtagtactgtacttttgtgtatcgtatacggcataccacaccattacaggtcgacagtcatttttttatactttattatgtagtggtcaatcacagcacgggtgtgtttttcgttcattcttctgacaaatttgtggagtctttatactacttctacttatgaaaccagtgtaatgctagagagatacatttgatttgattggtgccaaagttgactcagtttcgcctaattgagatctgcgtcggtttctttac

SEQ ID NO: 28361 - protein, 482 aa, Panicum virgatum
  misc_feature: Ceres CLONE 1883138
  misc_feature (201)..(451): Pfam Name: Malic_M Pfam Description: Malic enzyme, NAD binding domain
  misc_feature (101)..(250): Pfam Name: malic Pfam Description: Malic enzyme, N-terminal domain
  misc_feature (218)..(482): SWISSPROT Homolog: EC 1.1.1.40 Malate dehydrogenase (oxaloacetate-decarboxylating) (NADP(+))
  misc_feature (40)..(228): SWISSPROT Homolog: EC 1.1.1.39 Malate dehydrogenase (decarboxylating)
MSSGMETAGGGVEDAYGEDRATEEQLITPWAFSVASGYTLLRDPRHNKGLAFSEAERDAHYLRGLLPPALASQELQEKKIMHNLRQYEVPLHRYIAMMDLQERNERLFYKLLIDNVEELLPVVYTPTVGEACQKYGSIYRRPQGLYISLKDKGKILEVLKNWPERSIQVIVVTDGERILGLGDLGCQGMGIPVGKLSLYTALGGVRPSACLPITIDVGTLADHTYLFLGAGEAGTGIADLIALEMSKHTDTPIDDCRKKIWLVDSKGLIVESRKESLQHFKQPWAHAHEPLKTLLEAVESIKPTVLIGTSGVGRTFTKEVVEAMASFNAKPVIFALSNPTSHSECTAEQAYSWSQGRAVFASGSPFDPVEHDGKVHVPGQSNNAYIFPGFGLGVVISGAIRVHDDMLLAASEALAEQVTDEHFAKGLIFPPFTNIRTISARIAAKVAAKAYELGLASRLPRPDDLVKYAQSCMYTPTYRNYR

SEQ ID NO: 28362 - DNA, 2717 bp, Panicum virgatum
  misc_feature: Ceres CLONE 1883140
  misc_feature: Encodes the peptide sequence at SEQ ID NO. 28363
aagccacttcctacatgcatggttcctaacttatatataggacaaagggtcattgcagctcatgaagaagccagatgctaatgaagcgcaaacattgaagaatatgtggaatttggtagtagttttcacccctttggttcccggcatggaatttccaaagggggcgcagagaaaggcctcctcctgctcctaagatgttttaagagattacggcctccctgcataaggatttcgacaaaggttttctactgcaaccactcctgtcagctaaacacagtaacaagttgtaatacagcacagttgaagtggagggcaatccggtcatttagcgcgctgtctagtactctagacctctagctgatgtcctctgccggcgcggcatcattgcatcaagcgccagctcgccggcgcggccaacagctgcaccgccgccatgtcaagcgatctctccgcgcgctcgtcgccttcctcctccacagcgtcgccttccggtgacgcgcggcggacacgagaccaagtgcaggcaacgccgccgcagcagggacgactggcgaacaacgccggccgccggggtcggcgtcatcggcgcgggctgccgtggcgcctgggcctccgcgggctcggcgcggcgtgggcgctggacccgcgggcgaggtgggtccgggactggaaccgcgcctacctgctcgcctgcgccgcggggctcatggtggacccgttcttcctgtacaccgtgtccgtgagcggtccgctcatgtgcctcttcctcgacggctggctggccgccgccgtcaccgcgctgcgctgcgccgtggacgccatgcacgtgtggaacgtcgccacgcagctccgcctgtggcgcgacgcggcgcggaacaagcgcgcggtggacggcagctcgggcgacgaggagcagcaggcggccgccgcggaggaggaggacgaggaggagggcgccgaggccgcgcaaaagctcccggcggacgcgaggtccaagaaggccttgatgctggacttcttcgtcatcctccccgtgatgcaggtggtggtgtgggtggcggcgccggcgatgatccgcgcggggctgacgacgccggtgatgacggtgctgctgctggcgttcctggtcgagtacctgcccaagatctgccacgcggtgcgcttcctccggcggatgcaggcccagtccggctacgtcttcggcaccatctggtggggcatcgtgctcaacctcatggcctacttcgtcaccgcccacgccgtgggcgcgtgctggtacatgctcggggtccagcgggccagcaagtgcctcgaggagcagtgccggctgcaggcgggcgggtgcgcgcgcggcgcggtggcctgcgccgcgccgctctactacggcgccgccgcccccgccggcgccggcgagcggctcgcgtgggcccggaacgcgcaggcccggggcacgtgcctgaccagcggcgacggctaccagtacggcgcgtacaagtggacggtgatgctggtgtcaaacccgagccggctggagcgcgtgctgctccccatcttctggggcctgatgacgctgagcacgttcggcaacctggagagcacgaccgagtggctggagatcgtgttcaacatcgtgaccatcacgggcggcctggtcctggtcaccatgctcatcggcaacatcaaggtgttcctgaacgcgaccacctcccggaagcaggcgatgcacacgcggctccgcgccgtggagtggtggatgcagcgcaagggcctgccgcgggcgttccggcaccgggtgcggcagttcgagcggcagcggtgggccgccacgcgcggcgtggacgagtgccagatcgtgcgcgacctccccgagggcctccgccgcgacatcaagtaccacctgtacctggacctcgtccgccaggtcccgctcttccagcacatggacgacctcgtgctcgagaacatctgcgaccgcgtcaagtccctcatcttccccaagggagagacgatcgtgagggagggcgacgtggtgcagcggatgctgttcatcgtgcggggccacctgcggtgcagccaggcgctccggaacggggcgacgagcagctgcacgctggggccaggcaacttcagcggcgacgagctgctgtcgtggtgcctgcggcggccgttccgggagcggctgccgacggcgtcggcgacgctggtgacgctggagagcacggaggcgttcgggctggacgccgcggacgtcaggtacgtgacgcggcacttccggtacacgttcgccaaggacgcggtgcggcgcagcgcgcgctactactcgcccgggtggcgcacctgggccgccgtcgccgtgcagctggcgtggcgccggtacaagcaccgcaagacgctggcgtcgctctccttcatccgcccgcgccgcccgctgtcgcggtgcgcctcgctcggggaggagaagctccgcctctacaccgccatcctcgcctcgcccaagcccacccaggaccacgacttctagctagtcatctatgggccaggccaagccacaggcgccagcgttcgagcttgcctgctgcgtcgtcatgctgcaataatacacgacagagactgttgtattacgaaatggtacatgcatgcatgtcatctactcctactactgcagactcccgtgttcagatgctattggggtgaacaacaacacgtcactgggagcc

SEQ ID NO: 28363 - protein, 695 aa, Panicum virgatum
  misc_feature: Ceres CLONE 1883140
  misc_feature (517)..(615): Pfam Name: cNMP_binding Pfam Description: Cyclic nucleotide-binding domain
MSSDLSARSSPSSSTASPSGDARRTRDQVQATPPQQGRLANNAGRRGRRHRRGLPWRLGLRGLGAAWALDPRARWVRDWNRAYLLACAAGLMVDPFFLYTVSVSGPLMCLFLDGWLAAAVTALRCAVDAMHVWNVATQLRLWRDAARNKRAVDGSSGDEEQQAAAAEEEDEEEGAEAAQKLPADARSKKALMLDFFVILPVMQVVVWVAAPAMIRAGLTTPVMTVLLLAFLVEYLPKICHAVRFLRRMQAQSGYVFGTIWWGIVLNLMAYFVTAHAVGACWYMLGVQRASKCLEEQCRLQAGGCARGAVACAAPLYYGAAAPAGAGERLAWARNAQARGTCLTSGDGYQYGAYKWTVMLVSNPSRLERVLLPIFWGLMTLSTFGNLESTTEWLEIVFNIVTITGGLVLVTMLIGNIKVFLNATTSRKQAMHTRLRAVEWWMQRKGLPRAFRHRVRQFERQRWAATRGVDECQIVRDLPEGLRRDIKYHLYLDLVRQVPLFQHMDDLVLENICDRVKSLIFPKGETIVREGDVVQRMLFIVRGHLRCSQALRNGATSSCTLGPGNFSGDELLSWCLRRPFRERLPTASATLVTLESTEAFGLDAADVRYVTRHFRYTFAKDAVRRSARYYSPGWRTWAAVAVQLAWRRYKHRKTLASLSFIRPRRPLSRCASLGEEKLRLYTAILASPKPTQDHDF

SEQ ID NO: 28364 - DNA, 609 bp, Panicum virgatum
  misc_feature: Ceres CLONE 1883151
  misc_feature: Encodes the peptide sequence at SEQ ID NO. 28365
gttaaccctggtgtctacggccttcctgctccctctccctctccctctccctctcctccggaggtccatgcagacagccatgaagaagctcacggcaccggtggtagtgctagccgcggcggcggcggcagcagctcatgtcctgctgctgactctgccggcggcgcaatgctactggctcaacccggagatctacgacgccggcgggctcagccgccgcgcgttcccggaggggttcgtcttcgggacggccgcgtcggcgtaccaggtcgaggggatggccaagcagggaggccggggggccagcatctgggacgccttcatcgaggtaccagggacgatccctaacaatgccacggctgatgttacggtggacgagtatcatcggtacaaggaagatgtgaacataatgaagaacatgggatttgatgcgtaccggttttcgatctcttggtctaggattttcccaaatggaactggtaaggtgaaccgggaaggagtgaattactacaacaggctcatagattacatgattcagcaaggaatcaccccatatgcaaacctctaccactatgatctcccattggcactccatgagcagtaccttgg

SEQ ID NO: 28365 - protein, 176 aa, Panicum virgatum
  misc_feature: Ceres CLONE 1883151
  misc_feature (45)..(176): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51134
  misc_feature: Useful for making plants with altered cell wall content and/or composition
  misc_feature: Functional homolog of the protein sequence given in SEQ ID NO 50615
  misc_feature: Useful for making plants with modulated biomass
  misc_feature: Functional homolog of the protein sequence given in SEQ ID NO 50586
  misc_feature: Useful for making plants with altered carbohydrate content
MKKLTAPVVVLAAAAAAAAHVLLLTLPAAQCYWLNPEIYDAGGLSRRAFPEGFVFGTAASAYQVEGMAKQGGRGASIWDAFIEVPGTIPNNATADVTVDEYHRYKEDVNIMKNMGFDAYRFSISWSRIFPNGTGKVNREGVNYYNRLIDYMIQQGITPYANLYHYDLPLALHEQYL

SEQ ID NO: 28366 - DNA, 2005 bp, Panicum virgatum
  misc_feature: Ceres CLONE 1883168
  misc_feature: Encodes the peptide sequence at SEQ ID NO. 28367
gtgaacaaacagaccagccgcaccgcgccacccaccattccgccacacttcgccttcctccgccttcgtcgccttcccctaatcccttcccggggcagcagttcccactccccactccacctccttctacaacgcccaccaccgtccaccggtcccccactcccctccgtcgcgcttcccgacccccctcgcgccgtacggagctccccttccggaaggaacgccgacgacatgggggccttcgcgaagaaggagcaccagttcctcaccgagctcggcctcgcgccgcgcaacccgggatccttcgcctgcggggcctggggcggctcgggccccgtcgtcaccaccaccagcccgaccaacaaccaggttatcgcggaggtggtggaggcgtccgtgaacgactacgaggagggcatgcgcgcctgcttcgatgccgctaggacatggatggcgattccagctccgaagcggggagagattgttcggcaaattggcgacgcactgagagcaaagctccacaaccttggcaggcttgtgtcacttgagatggggaaaattcttccggaagggatcggggaggttcaggaaatcatcgacatgtgtgattatgctgtggggctaagtcgccaattaaatgggtccattataccatctgaacgtccaaaccatatgatgatggaggtgtggaatcctcttggagttgttggtgttataacagcatttaatttccctagcgctgtgcttggttggaatgcttgcattgctctggtctgcggaaattgtgttatctggaaaggtgccccgactactccactgatcactattgcaatgactaaaatagtggctagtgtattggagaagaacaacttgccaggcgcaattttcacagctttttgtggtggcactgaaattggccaagcaatagctcttgacactaggatacctttggtttcgttcaccggaagtacaagggctggtctaatggttcagcaacaagttaatgcaagatttggtaaatgccttctcgaacttagcgggaacaatgccataattgttatggatgatgcagatattcagctagctgtgcgttctgtgttgtttgctgctgttggcacagcaggacaacgttgcacaacatgccgtaggctgattcttcatgaaagcatatatcatacttttcttgatcaacttgttgaggtatataaacaagtccgaatcggggacccattggagaagggcaccttattgggaccactgcacactcctgtttcaaaggagaactttttgaaaggtgtccagaccatcaaatctcagggagggaaaatcctttttggaggatctgccatcgaatcagaagggaacttcgtacagccaacgattgtggaaatttcagcttctgcgccagttgtgaaagaagaactctttggccctgtgctttatgtgatgaaattccagaccttgaaggaagcaattgaaatcaataactctgttcctcaaggattgagcagttctatatttacaaagaagccagaaattatttttaagtggcttgggccccatggtagtgactgtggtatagtgaatgtgaacatacctacgaatggtgccgaaatcggtggagcatttggtggagaaaaagcaaccggtggtggacgagaagcaggaagtgattcctggaagcagtacatgaggagggcaacttgtacaatcaactatggaagcgagctacccctagcacagggaatcaattttggttaatccggcaggagggggtgcgcatggatcttggtattttctgcggacgtggatgtcacatgggagaactgatgataccgtgttaagatctctgcatagacaaagtgtctatctgcttcagttgccaaatagtgtctatctgcttcagttgccaaacctaaattggaggacagcagtagtagtgtgtgtacatataataataagatgtttgttgctcgtggtatgattaacggctggtgtcccaagc

SEQ ID NO: 28367 - protein, 509 aa, Panicum virgatum
  misc_feature: Ceres CLONE 1883168
  misc_feature (30)..(491): Pfam Name: Aldedh Pfam Description: Aldehyde dehydrogenase family
  misc_feature: SWISSPROT Homolog: EC 1.2.1.3 Aldehyde dehydrogenase (NAD(+))
MGAFAKKEHQFLTELGLAPRNPGSFACGAWGGSGPVVTTTSPTNNQVIAEVVEASVNDYEEGMRACFDAARTWMAIPAPKRGEIVRQIGDALRAKLHNLGRLVSLEMGKILPEGIGEVQEIIDMCDYAVGLSRQLNGSIIPSERPNHMMMEVWNPLGVVGVITAFNFPSAVLGWNACIALVCGNCVIWKGAPTTPLITIAMTKIVASVLEKNNLPGAIFTAFCGGTEIGQAIALDTRIPLVSFTGSTRAGLMVQQQVNARFGKCLLELSGNNAIIVMDDADIQLAVRSVLFAAVGTAGQRCTTCRRLILHESIYHTFLDQLVEVYKQVRIGDPLEKGTLLGPLHTPVSKENFLKGVQTIKSQGGKILFGGSAIESEGNFVQPTIVEISASAPVVKEELFGPVLYVMKFQTLKEAIEINNSVPQGLSSSIFTKKPEIIFKWLGPHGSDCGIVNVNIPTNGAEIGGAFGGEKATGGGREAGSDSWKQYMRRATCTINYGSELPLAQGINFG

SEQ ID NO: 28368 - DNA, 729 bp, Panicum virgatum
  misc_feature: Ceres CLONE 1883171
  misc_feature: Encodes the peptide sequence at SEQ ID NO. 28369
acatatgatgttaaagttcagatgattgaaatatacaatgaacaagtgagggatttattaatggcagatggtgcaaacagaagattagagatacgcaataattctcatgtaaatggactcaacattccagatgcaaatattgtaccagttaagtgtgcacaagatgttttggatctgatgaaagttggacagagaaaccgagcggttggatcaactgctcttaacgaacgaagtagtcgctcacacagtgtgttgacagttcatgtacaaggaaaggaggtaatgtcgggctcaactctaagagggtgccttcatctggtggatcttgcgggaagtgagagggtagacaaatctgaagcaactggagaaagactaactgaagccaagcacataaataaatcgctatctgcacttggtgatgttatagctgcacttgcccaaaagagttcccatgtcccatacagaaatagcaagttaacacaagtgctgcaggatgccttaggtggccaggcaaaaacattgatgtttgtgcatgtgaaccctgaaacagactcttttattgaaacaatgagcactctcaaattcgctgagcgtgtggccacaatagaacttggtgcggcccgtgctaataaggaagcaggccaggtcaaagacctaaaggaagaggttgccaagctgaaattggcattagatgaaaaggaacgtgaagcagcacagtttaaagatctt

SEQ ID NO: 28369 - protein, 242 aa, Panicum virgatum
  misc_feature: Ceres CLONE 1883171
  misc_feature (1)..(203): Pfam Name: Kinesin Pfam Description: Kinesin motor domain
TYDVKVQMIEIYNEQVRDLLMADGANRRLEIRNNSHVNGLNIPDANIVPVKCAQDVLDLMKVGQRNRAVGSTALNERSSRSHSVLTVHVQGKEVMSGSTLRGCLHLVDLAGSERVDKSEATGERLTEAKHINKSLSALGDVIAALAQKSSHVPYRNSKLTQVLQDALGGQAKTLMFVHVNPETDSFIETMSTLKFAERVATIELGAARANKEAGQVKDLKEEVAKLKLALDEKEREAAQFKD

SEQ ID NO: 28370 - DNA, 1313 bp, Panicum virgatum
  misc_feature: Ceres CLONE 1883177
  misc_feature: Encodes the peptide sequence at SEQ ID NO. 28371
atactactgaagcaaacattgttgaaaaaggtacatcaaggaggggtagaaagagaaaagaggttttaccttctcctgaagtagagacaacagatcatatgcaagactcttattggtctggattgagcttgcataatcacccaattcatgacctcagaaaagatggtccttcaacaaggccaagacgtaggcggagatcttcaagacatacatatgtacctttgtcggaacttggagattcagttcctaagaagcagatacaagtgatggaaaggtcaatcatccatgtcgatgagaagatggttgacgagttgaagcccactgcacttgttttgagctttggcaggtcagcttctattccttcagaattgtatctcattaagatgttcaggcgctatgggcctctgaaagaagcggagacagaagtagacaaggacacaaatactgttaaagttgtctttaagaaacgtatagatgctgaaagggcttttggtgttgctggcaagtatggcacttttggaccttcgcttcgaagctaccgtcttgtgaatatgccattctctctaaagacattatcaacaaataatcctgtgaaacaccctgaagatcatggcacagagattcctggttcgagtacgtctgaaactcctaaggatgacatggaagttgatcaggtgcacaaaacagaggaagcagaagttgcgggagaactttctgttgaacaagcggagaccgtgaagcaaacatctctagtggaatcttcagacgctacattcaccaatcaagttgtggatgagagaactggaaagatggatactgagctgattggccattttaatcaaattggaacagaggcacatgctgcatctgtacctgaaggttcatctgagcaagttggcaatgctgaacaagcttacactcaggagtcagctcaagatgtttcagaagatatgcaaatggatgttgtagctgaagcccccaaacaggatcacatttctggagatagtactgtattcgaagcaatcactgaagcaccaggtgctgcagaagttcgtgagtttggtactgctaatgaagttccagaagagcgcatggtacctcctgtgttacaaagtcaaacctcctgtgaaaatgtggaacaagatgcaactgagcaaaaagtgggatctgaagttccaaagttggaagctgaaacatttgctgcagaacctgttgtaccaagtacaatcgagcaagaagttgaggtgggatccaaaactaccgctgaagtatctggcgaacaagtcaacagtattgagcaaactgttcaagtg

SEQ ID NO: 28371 - protein, 436 aa, Panicum virgatum
  misc_feature: Ceres CLONE 1883177
  misc_feature: SWISSPROT Homolog: EC 2.7.11.1 Non-specific serine/threonine protein kinase
TTEANIVEKGTSRRGRKRKEVLPSPEVETTDHMQDSYWSGLSLHNHPIHDLRKDGPSTRPRRRRRSSRHTYVPLSELGDSVPKKQIQVMERSIIHVDEKMVDELKPTALVLSFGRSASIPSELYLIKMFRRYGPLKEAETEVDKDTNTVKVVFKKRIDAERAFGVAGKYGTFGPSLRSYRLVNMPFSLKTLSTNNPVKHPEDHGTEIPGSSTSETPKDDMEVDQVHKTEEAEVAGELSVEQAETVKQTSLVESSDATFTNQVVDERTGKMDTELIGHFNQIGTEAHAASVPEGSSEQVGNAEQAYTQESAQDVSEDMQMDVVAEAPKQDHISGDSTVFEAITEAPGAAEVREFGTANEVPEERMVPPVLQSQTSCENVEQDATEQKVGSEVPKLEAETFAAEPVVPSTIEQEVEVGSKTTAEVSGEQVNSIEQTVQ

SEQ ID NO: 28372 - DNA, 574 bp, Panicum virgatum
  misc_feature: Ceres CLONE 1883177-R
ggtattacatcaactcagaaacctgtagaggatgccatggttataacactagatgagaggactacagtcggtaagactcttgaggatgccaaggttgagcaaccgaatgagaaaactaccacagctgagacaactgtggatgatgccatggttgagccaccagatacaaatgcctctgaggctgaaaaaactgcggagagtgccacacttcaagcaccagatgagaaaggtacagctgcggagactgccacacttcaagcaccagatgagaaaggtacagcagcagagaagactatagaggataccacggataccacggttgaggcacaacatgtacaagcaggtgctagcgagtaagccagctagggtatgttgcatccctgtcagcttctgttgatatcgatgtagactgctctactgattctcatctggacgatgtggtctgtatagaaaaatgggaacccgctttagcatcagaatgctattaggtattagttactagggcatctaaatctttgccccttctcgtatgaactctagttatattggatgacgcgaatgtgccagtttgtcg

SEQ ID NO: 28373 - DNA, 2675 bp, Panicum virgatum
  misc_feature: Ceres CLONE 1883193
  misc_feature: Encodes the peptide sequence at SEQ ID NO. 28374
ttttttttcttcctctctttcatcgtctcgccgttccgtccctccaaaaccctagacgcgaccctcccccagcgccgctcgccgccgcccgcggccatggatctcctccgctcgcacctccacaaggtccgcatcccggagcccggcagccgcatccacaaggacgagtgctgcgtctccttcgactccccgaggtcggaggggggcctgtacgtggacatgagctcgttcctggggttcgggagggagcatgtggagtggaacttcgagaagaccggcaaccccgtgtacctccacattgtgcagcgccggaagccggagtcggacgaggcggatcgcccgctcaagaagcccaccctccttgcaataggcgtggaaggaggctttggtgatcaagaacctgaatatgatgatacttttgaaatcgtcattttacctgattttatctctcttccattcccctcagttgacttgccagagaaggttaggattgcagttgataaggttatccttgctgaaagtgctgacagaaaacaacaactagctgcttgggtcgctgaaaagaagaatattagtgcatatgctatggatctgcagcagctagaaaatggtgttattgtgcctcctactggatggaagtgcagcaaatgcgataaaactgagaacctctggttgaatttaactgatggtatgatcctttgcgggaggaagctttgggatggaagcggtgggaataatcatgcaattgaacattacgagcagactaaatatcctcttgcagtaaagcttggaacaattactgctgatttggaagcagcagacgttttctcatacccggaagacgatagtgttgaagatccactattagctcgacacttgtcacattttggtatcgatttttcttcacttcaaaagactgagattactactgctgagagagaacttgatgccaacacaaattatgactggaatagaatacaagaaagtggaaaagatgctgaacttctatatggacctggctatactggtcttgcgaacctagggaatagttgctatatggcttcaataatgcaagtcatgttttcgactcatcctttcatatcgagatactttgagaagcagagtttgaaagctgcatttgcaactgcacctgctgatccaacaatggacctaaacatgcagatgacaaaattaggacatggtttgctctctggtaaatattctgcaccaaataaggaggggcaggaattgatacgtcctcgcatgtttaagtcagttattgctgcgaaccattctgaattttcaagtatgaggcaacaggatgcccttgagttcttccttcaccttatcgaccgagttgagcaggcaaacccggggaaccatgagttaaatccttgttcaggttttaagttcattattgaggagagggtccagtgcccttctggaaaagtttcttacaacaagcggtcggacaacatgctttctttgagcataccactgcatgcggcaactaataaagagcagctagaagcttttagtgagaagaaagctgcaatggacttggatgggaaagaagtgtctaatgaggaaattgtgaggcctcgagtcccattggaggcatgcttagcaagtttttcagggccagaggaaattcctgatttttacagcactgctttaaattcaaagacgactgctaccaagactgctggctttaacacctttcctgattacctggtgctgcatatgcgcaagtttgtaatggaggcaggatgggtgccaaagaaacttgatgtttatatagatgtgccagatacaattgatatctcgcatatgcgtagcaagggtatgcagcctggggaagaactgctacctgaaggagcttctagtgacaacaaagctgagcctgctgcacctgttgccagtgaggatattgtgtcccagcttgcaagcatgggattcaattaccttcattgtcagaaagctgctattaacacatctaacaccggagttgaggaggcaatgaattggcttctctcacacatggatgatccagatataaatgatcccatatcaaatgatttgcgtgcttctgaacaatctgttgatgaagccagtgttcaaactctcatttcctttggatttccagaagatgttgccataaaggccctgaaagcttctggtggtaatatcgagcaagctaccgattggattttcagccaccccgaagcatcaagcacagcacctgctgactcttcgaccagcaatgtaaatgctgataacactcatgtttcagatggcagtggcagatacaagctgatggcttttgtcagccatatgggcacctccacccactgcgggcactacgtcgcacatgttctcaaagacgggaggtgggcaatcttcaacgacagcaaggttgctgcatctgtcgacctgcccaaggatatgggctacctttatttctttcagaggattagcggctaggcacatcacaggcaaatatcgtgacagttcatagttcatgcgcccacatcatgaaaagaatggcgagcttgttagaatgctgtcatgctgattttaatgcgactgtctgctctcattcttccatgctggttacagactgatcaactgggatattgcttttcattacattatagagtggcacctccgattac

SEQ ID NO: 28374 - protein, 795 aa, Panicum virgatum
  misc_feature: Ceres CLONE 1883193
  misc_feature (307)..(790): Pfam Name: UCH Pfam Description: Ubiquitin carboxyl-terminal hydrolase
  misc_feature (182)..(259): Pfam Name: zf-UBP Pfam Description: Zn-finger in ubiquitin-hydrolases and other protein
  misc_feature (669)..(705): Pfam Name: UBA Pfam Description: UBA/TS-N domain
  misc_feature: SWISSPROT Homolog: EC 3.1.2.15 Ubiquitin thiolesterase
MDLLRSHLHKVRIPEPGSRIHKDECCVSFDSPRSEGGLYVDMSSFLGFGREHVEWNFEKTGNPVYLHIVQRRKPESDEADRPLKKPTLLAIGVEGGFGDQEPEYDDTFEIVILPDFISLPFPSVDLPEKVRIAVDKVILAESADRKQQLAAWVAEKKNISAYAMDLQQLENGVIVPPTGWKCSKCDKTENLWLNLTDGMILCGRKLWDGSGGNNHAIEHYEQTKYPLAVKLGTITADLEAADVFSYPEDDSVEDPLLARHLSHFGIDFSSLQKTEITTAERELDANTNYDWNRIQESGKDAELLYGPGYTGLANLGNSCYMASIMQVMFSTHPFISRYFEKQSLKAAFATAPADPTMDLNMQMTKLGHGLLSGKYSAPNKEGQELIRPRMFKSVIAANHSEFSSMRQQDALEFFLHLIDRVEQANPGNHELNPCSGFKFIIEERVQCPSGKVSYNKRSDNMLSLSIPLHAATNKEQLEAFSEKKAAMDLDGKEVSNEEIVRPRVPLEACLASFSGPEEIPDFYSTALNSKTTATKTAGFNTFPDYLVLHMRKFVMEAGWVPKKLDVYIDVPDTIDISHMRSKGMQPGEELLPEGASSDNKAEPAAPVASEDIVSQLASMGFNYLHCQKAAINTSNTGVEEAMNWLLSHMDDPDINDPISNDLRASEQSVDEASVQTLISFGFPEDVAIKALKASGGNIEQATDWIFSHPEASSTAPADSSTSNVNADNTHVSDGSGRYKLMAFVSHMGTSTHCGHYVAHVLKDGRWAIFNDSKVAASVDLPKDMGYLYFFQRISG

SEQ ID NO: 28375 - DNA, 1098 bp, Panicum virgatum
  misc_feature: Ceres CLONE 1883198
  misc_feature: Encodes the peptide sequence at SEQ ID NO. 28376
ccagctctctttcagacacggctcgctctcgccgccgccttcctccgtccttccccgtccagactacgtagcaggcaagaagaaggacccggccggttcgtgcctccttgcggctgcttctggattcccctgcagtctcggaccccggcccagcgacctcctcccccgatcaagtccaggcctttttcttccgccaggtcaatcagcccaactaggaaacaccgatctgtgtcagggagtatggctgggggtggcacaggcctcaggaagtacgtcggggctctcaaggacaccacaacagttagcatagcaaaagtgaacagtgattataaggagctggatattgctattgtgaaggccacaaaccatgttgagcgtccagcaaaggagaagtacataagagatcttttttaccatctttctcctggaaggcctcgtgcagatgtagcctactgcatccgtgcccttggtagacgtctttcaaagacacgcaactgggcggttgctctgaagacattagttgtcatacaccgtgctcttcgggaagtagatcctactttccgtgacgagtttataagttatggaagaactagctcccatatgctccatctgtcctactttaaggatgattctagtgcagaagcctgggattactctgcatgggtgcgcaattatgctttatatttggaggagagagtcgaatcattccgtgtactgaagtatgacattgaaaaggatccatcgagaactcgggatcttgatacaattggattgctcgaacagttaccagcattacagcagcttctttttcgtctacttgattgccagccacaagggtcatcatcttataacatcataattcagcatgcactatcaatggttgctctagagagtgttaggatccaaacagccatcaatgatgcaatactcaatcttgttgacaagttttttgagatgcaaagagatgatgctataagggcccttgacatgtataaaagagcgattagccaggcagaacaactttcagaattttatgaagtgtgtaaaagtatacatattgggcgtggtgagagattccttaaaattgaaaagccacct

SEQ ID NO: 28376 - protein, 285 aa, Panicum virgatum
  misc_feature: Ceres CLONE 1883198
  misc_feature (30)..(285): Pfam Name: ANTH Pfam Description: ANTH domain
MAGGGTGLRKYVGALKDTTTVSIAKVNSDYKELDIAIVKATNHVERPAKEKYIRDLFYHLSPGRPRADVAYCIRALGRRLSKTRNWAVALKTLVVIHRALREVDPTFRDEFISYGRTSSHMLHLSYFKDDSSAEAWDYSAWVRNYALYLEERVESFRVLKYDIEKDPSRTRDLDTIGLLEQLPALQQLLFRLLDCQPQGSSSYNIIIQHALSMVALESVRIQTAINDAILNLVDKFFEMQRDDAIRALDMYKRAISQAEQLSEFYEVCKSIHIGRGERFLKIEKP

SEQ ID NO: 28377 - DNA, 604 bp, Panicum virgatum
  misc_feature: Ceres CLONE 1883198-R
ttacacttgacagtctatacaatgaggcgcaccgtcaagcacagcaggcacagcagaatacgagccagaacccttgggagaccgttccagcatcaggtccaatgatgcagcaaccgatgtacgacccgttctacgcctccaactccattgccgcagcccgcaacgtgcagatggtggcgatggcgcagcaacagcatgccttcatgctccagcaggagcagcagcggcagatgatgatggtgatggcacagcagcagcaagcctcttcgaatccgttcgccgacccgtatatgcaccctggtgcagggatgcagctccatgccagaaacgcatacactggaactggtatgatgtagggcgccacagaacatactactctgtttttggcacctttggttcctttccttcccattgtaagaatgacaatatgagcacagccatagaagaattttttgcttctttctggctgttcatgagcaagaaggtcgatgtacacctgggaactgaactactgaaggactagtatccttgcaaaatttagtacgagaaacacagtcattttctgatgtgaatataaaaggctttgttaacgagttgattgggt

SEQ ID NO: 28378 - DNA, 671 bp, Panicum virgatum
  misc_feature: Ceres CLONE 1883207
  misc_feature: Encodes the peptide sequence at SEQ ID NO. 28379
gatatcatgttggtgctaaaggccagtatgctggaagtaaagatgaggaatacttcattcacaaccacttgtcatttacagtgaagtatcacagggatgatgattcggaactttcaagaatagtgggatttgaggtccacccatacagtgtcaagcatcagttcgacgataaatggaacggtgcagacactcgcttgagtacatgtgatcctcatgcgagcaaatttgtaacgaactcagattctcctcaggaggttgaagctggaaaggagatcatattcacatatgatgttcgttttgaggatagtgaaatcaagtgggcctcccgttgggacacctacttgttgatgactgatgatcagattcattggttttctattgtgaactctctcatgattgtgcttttcctatctggtatggtggccatgataatgcttcgcactctctatagagatatctctagatacaatcagcttgaaactcaagaagaagcacaagaggaaactggctggaagcttgttcacggagatgtgttccgccctccaaccaactctgacttactctgtgtttatgttggcactggtgtgcaattctttggcatgctgctagttacaatgatcttcgctgtgttgggtttcctctctccatcaaaccggggaggactgatgact

SEQ ID NO: 28379 - protein, 222 aa, Panicum virgatum
  misc_feature: Ceres CLONE 1883207
  misc_feature (1)..(222): Pfam Name: EMP70 Pfam Description: Endomembrane protein 70
YHVGAKGQYAGSKDEEYFIHNHLSFTVKYHRDDDSELSRIVGFEVHPYSVKHQFDDKWNGADTRLSTCDPHASKFVTNSDSPQEVEAGKEIIFTYDVRFEDSEIKWASRWDTYLLMTDDQIHWFSIVNSLMIVLFLSGMVAMIMLRTLYRDISRYNQLETQEEAQEETGWKLVHGDVFRPPTNSDLLCVYVGTGVQFFGMLLVTMIFAVLGFLSPSNRGGLM

SEQ ID NO: 28380 - DNA, 1345 bp, Panicum virgatum
  misc_feature: Ceres CLONE 1883215
  misc_feature: Encodes the peptide sequence at SEQ ID NO. 28381
aactcgtgccctgcccgagagctgctagggtttcccctgccagacagttgctagggtttcccgagaaattcccccaattctacggccgatcccgcttcccgttggtcgtcctcgcctcgtcgggcgcagcggctctgcaacatcgatcgcatggctcatcgtgcagcggaggagctaggggtgatccaaccgcctccggctagcgccgccgccgtcgatcccgtccgtctccggcggccgcttgccgcgctgccctcttctcctaccggcggcctcgacggcgccatggagaacagcctccccgacgaccccctcgtggaggtcctttcgcgcctccctgccaagtccatctgccgtttcaagtgcgtctccaaaccctggcgcgacctcatcgccgaccgcctccgctgcaggaagttcccccaaaccctacagggattcatctacggcgacggcgaggcccacgccggcgagaactatgggcacttcatcaacccgctgggggaacctgtgcctctcatcgacccttcgttcaccttcctgacgaagcttcctggggttgagaagatcatcctcttgggctcctgcaaggggctcctatttgggcacagacgggtttcagacacatatgactcactgggctacattgtgtgcaaccccgccaccgagcaatgggkggctgtgcccagctcccggtgggccccatgggccaaccgcgagggtgaagaagatgaagaatactataccgaagaagaagtgctcacccctttgattttccatcccgctggctccccgcactttccgttgggccagctggggcagggaagctatatgaacttggcaggggggcacccctactcctctaaaactgggggatggagggcaactaagaaaggggattggaaaccgtggggcttggatgccatcctaagcacctctgccggaagccccttaaatggcatgctacacttgaaagtccatgacctttatgaacgccggaacctcctagttgcgcttgatggggaagggaaaacctcccgatcatccgctgaatagaacagcgtggttttcctggttttggtgggcagtctcctgggcatctggaccgcattagtggggacatagatgactctgatatgataactgaactggctggttgggttcttgaggactaccatatagaagaatgggttctgaagcacagtgggagcatggttcagctggttgggaaaatgaattaccgatttgactcctaccaagtggtcaccattcatcctgattggaatttggtcctctttcctgagtatggggactgcaaactgatatcgtatggggactgcaaact

SEQ ID NO: 28381 - protein, 256 aa, Panicum virgatum
  misc_feature: Ceres CLONE 1883215
  misc_feature (3)..(47): Pfam Name: F-box Pfam Description: F-box domain
  misc_feature (131)..(131): Xaa is any aa, unknown, or other
MENSLPDDPLVEVLSRLPAKSICRFKCVSKPWRDLIADRLRCRKFPQTLQGFIYGDGEAHAGENYGHFINPLGEPVPLIDPSFTFLTKLPGVEKIILLGSCKGLLFGHRRVSDTYDSLGYIVCNPATEQWXAVPSSRWAPWANREGEEDEEYYTEEEVLTPLIFHPAGSPHFPLGQLGQGSYMNLAGGHPYSSKTGGWRATKKGDWKPWGLDAILSTSAGSPLNGMLHLKVHDLYERRNLLVALDGEGKTSRSSAE

SEQ ID NO: 28382 - DNA, 671 bp, Panicum virgatum
  misc_feature: Ceres CLONE 1883215-R
taatctgataaactgatgcattttgctggtgcttggatctggcatggttcaatccttatggctatccaattaatactgcaatgccagttgagacatctgtatgtaagctagctctacagctaatattttgatgaatgcctgtcagattacagttgtgttctctgcaatggaaactttttaattttgagttgtgttgttgatgtttgacaatgggacctctggtattttgtaattcaggacatttggagtgttctctccaaatatccattcagtcagtggtgttgatgtttgacattgggacctctggtattttgtaattttgacatggttcaagatggcagccaaaggttcagttctccaaatatatgtaaggagatcactaattacatggactatgaggtgtcatcgaaacagtatagtatttaatgctgcagttcaatcacttggtaggtattcaaatcagacttttgctctgctgttagcacagagcaaagttaactaagtatctaggggctacattctgattggctgagtgatatttcttaatggtttctcttccctttttctttttttctttttggacctatagtccctgaatccattgaaatggactagttcctttctgtacttcctgatggttgatgaatgaatgctagatcatgatgggtgcc

SEQ ID NO: 28383 - DNA, 2466 bp, Panicum virgatum
  misc_feature: Ceres CLONE 1883252
  misc_feature: Encodes the peptide sequence at SEQ ID NO. 28384
gcgttgcgagataagagggcggcggttctgggtgcgcttgcccggggactgcaattccagcgccggcggttgcctcgctggtcctccaactccatttccattcaaagacgacttgttgcgctcttgactgacccggccgaggagtcgtgggctggccctgcgtgggaaccgagccagcagcgccgacgtctcttctgggttggtggtgaccgccgccgctggactggagagttgggttggggaaagttgctactagtggtttcctcgctggtgatggagtaggcggaccgcggcgcggcagagcaagtgttcgacgaattgctccgcaggccatggcggcaggcgactgggaggacctggtgcgccgcatgttcccgccggggaccaccatcccggagccgcccgccaacctcgactactccatcgcgctcgagtacgacggcccgccggtgtcctacgagctcccaaggatcgaccccgtcaacgtccccgccaacgtccccgccatacccaccgccgagcccgtctccgggcccctcgggctcgccaacggcgccgtgccggtggcgccggtcgtcgggcctgcacggcgcggcgccgacccgccgccgccccgggtcgctcagcgtgcggcgcagcagtcgtcgccggctcgcgatgaggagtactccgacgattccgactcccgctcggctaggagcttgcagagccaaagggctcctgcgaggcctgctgcgccggaggggaggcgggctcaggtggtcaccttcggggtgcccgacgacagcaagtacgacaagagcaaggacttggacgaggtgtcgtccgagcagtacgtcgcggtgacgatggcggagcggaaggggaggacctgccaccggtgcgggaagagcaagtgggagagcaaggagtcctgcatcgtctgcgacgccaggtactgcagccactgcctgctcagggccatgggctccatgccggaagggcgcaagtgcatcacctgcatcggccagccgatcgatgagtccaagcggtccaagctggggaagggatccaggatactgtcccggctgctcagccccttggaggtgaagcagatactcaaggtcgagaaggagtgccaggcgaaccagctccggcctgagcagctcatagtgaacggtttccctcttcacgacgaagagatggcaaacctgcttagttgccaacggcctcctcgaaatctcaagcctggaagatattggtatgacaaggagtcaggattgtgggggaaggaaggtgaaaagccagacaggatgattagcactagcctcaacttcaatggaaagcttcagcctgatgcaagtaatggcaccgctcaggtctttattaatggaagggaaatcacaaagattgaactgagaattctaaagattgcaaaagttcagtgcccccgtgatactcacttttgggtttatcacgatggcggctatgaggaagaagggcaaaacaatatcaaagggaaaatatgggaatcacgtttgacacgtttggtgtgcgctttggtttcactacccgtgcctcctgtraacgctgatgagcccaaagatgatagtcattattcatcaagaagtgttcctaattacttagaccacaaaagagttcaaaagcttcttattctcggatcaccaggagctggaacaagcaccatatttaaacaggctaaattactatacggctctagatttactcatgaagaacttgagagtatcaaactaatgatccaaagcaacatgttcaagtacctggggattctcctcgagggccgtgagcgctttgaggaagaggctttggctgcatcagatcacacaagctcagtggatgaagattctcatcaagataaaaataggcctactagttcaaattcttgcatttactcaatcaatgcaaagctgaagaagttctctgattggcttctggatatcattgcaatgggagacctagatgcattcttccctgcagctacacgtgaatacgctccagttgttgatgagctgtggaaagatcctgccatacaagcaacatataaaagaaaggatgaattgcattttctccctgatgctgctgagtatttcctgagcagggctattgaagtatcaagtaatgaatatgagccttcagaaaaagatgtagtatatgctgaaggagtaacacaagggaatggattgtccttcattgatttcaccctggatgaccgcagccctatgtcagaatcctttggcgacaatcatgaggcatactcgcaaccagtaaacaaataccagctgattagagtaagcgccaagggcatgaatgagggctgcaagtgggtcgaaatgtttgaggatgtccgcatggtgatcttctccgtagcgctcagcgactatgatcagcttgcagcccctggtagtgttggcagtaggtccctggtgaataagatgattcaaagca

SEQ ID NO: 28384 - protein, 711 aa, Panicum virgatum
  misc_feature: Ceres CLONE 1883252
  misc_feature (423)..(711): Pfam Name: G-alpha Pfam Description: G-protein alpha subunit
MAAGDWEDLVRRMFPPGTTIPEPPANLDYSIALEYDGPPVSYELPRIDPVNVPANVPAIPTAEPVSGPLGLANGAVPVAPVVGPARRGADPPPPRVAQRAAQQSSPARDEEYSDDSDSRSARSLQSQRAPARPAAPEGRRAQVVTFGVPDDSKYDKSKDLDEVSSEQYVAVTMAERKGRTCHRCGKSKWESKESCIVCDARYCSHCLLRAMGSMPEGRKCITCIGQPIDESKRSKLGKGSRILSRLLSPLEVKQILKVEKECQANQLRPEQLIVNGFPLHDEEMANLLSCQRPPRNLKPGRYWYDKESGLWGKEGEKPDRMISTSLNFNGKLQPDASNGTAQVFINGREITKIELRILKIAKVQCPRDTHFWVYHDGGYEEEGQNNIKGKIWESRLTRLVCALVSLPVPPVNADEPKDDSHYSSRSVPNYLDHKRVQKLLILGSPGAGTSTIFKQAKLLYGSRFTHEELESIKLMIQSNMFKYLGILLEGRERFEEEALAASDHTSSVDEDSHQDKNRPTSSNSCIYSINAKLKKFSDWLLDIIAMGDLDAFFPAATREYAPVVDELWKDPAIQATYKRKDELHFLPDAAEYFLSRAIEVSSNEYEPSEKDVVYAEGVTQGNGLSFIDFTLDDRSPMSESFGDNHEAYSQPVNKYQLIRVSAKGMNEGCKWVEMFEDVRMVIFSVALSDYDQLAAPGSVGSRSLVNKMIQS

SEQ ID NO: 28385 - DNA, 432 bp, Panicum virgatum
  misc_feature: Ceres CLONE 1883252-R
cagtcgctggcgcagcaggcattctactacgtggccatgaaattcaaggacctgtacgcagcgagcaccggccggaagctcttcgtgtggcaggcgcgcgcccgcgaccggcccaccgtcgacgaggccttccggtacatccgggaggtgctgcggtgggaggacgagcgcgacggcgccgggtactgcccggaggagtcgttcttcagcaccacggagctcagctcgtcccggctcatcgctgcggcggagtgacaggcatagctgtggttaatttgcaggaaaaatttcactagtaattgtatagtgtttgtgtagttgatgatttaacttgcggcttgtgaaattggtgctctcttgcagtgccattttgtactggtaattttcttattctgaacaaatcaaatatagtggaggagaaatcttgtggtg

SEQ ID NO: 28386 - DNA, 1973 bp, Panicum virgatum
  misc_feature: Ceres CLONE 1883256
  misc_feature: Encodes the peptide sequence at SEQ ID NO. 28387
gaaaacagcataagcaaaatccaggccgtttgatccgaaccccacagccgcctccgtacccgtgccctccgccggcgatggcgaaggccccgtcgtcctccgcggcggtggccgccgaaggccgcggcctagcccaccaccggacccggctcctcctcctgctcctcgtggccgtcgccgcctccgcctccacagtggggttcctcctccgcggcgccctgcgcgacccctgcgacgcccatggggaccacgcctctgtcgccgccgcctcggggagtcccctcgagttcatgaggtctaagctcgtgctgctcgtctcccacgagctctccctctccggtggcccacttttgctgatggagttaacgtttcttctgaggcatgttggctcgcaagtggtgtggataacaaaccagagatcagaagaaacaaatgatgttacatatagcttggagcataagatgttgaaccatggggtgcaggttttaccagctagggggcaagaggcagttgatactgctcgaaaagctgatctggttatcttgaacactgctgtagctggcaaatggcttgatcctgttcttaaaaaccatgttcctgaagtccttccgaagattttgtggtggatccatgaaatgcgggggcattactttaagcttgaatacgttaaacatcttcccttcgttgctggagccatgattgattctcatacaacggctgaatattggaagagcaggactagtgaccgtctgaagtatgtgcataattattaatgctctctggatttttttcggtatattattgattgctgggttctatatataacattaaagaggctggtatcataattttgactctattgctgatatgagttacctgtctagaagacaataaattctctgccacctggctatattttgtttttgctatgtatgaacttttatttgtgagcaaaacatcattggcaatggttgatcgtttcttgcatttcatattgattttctaattcattattatgtacctctaattgcttcatatgaagaatacagatgccacaaacttatattgttcacctcgggaatagtaaggaactaatggaagttgctgaagatggcgttgcaagaagagtcctacgggaacatattcgtgagtcccttggagtacggagtgaagatctcctgtttgcaataataaacagtgtatcacgaggaaaaggacaagacttgtttcttcaggcattttatcagagtttgcagctcatcaaacagcagaagttaaaagtgcctacgatgcatgccatagttgtgggaagtgatatgaatgctcagaccaaatttgagacccagttacgtgactttgtggtaaagaatgggattcatgaccgtgtccattttgtgaacaagacattggcagtggctccttatttggcagcaattgatgtgcttgttcagaactcccaggcccgtggcgaatgttttggaagaataacaattgaagcaatggcattcaagttgccagtattgggcacggctgccggagggactacggaaatcgtcgtcgacggctcgaccggcctcctgcacccggccgggaaggagggcgtcgcgcccctcgcgaagaacatcgtgagactcgcgagccgcgccgagcagagggcctccatggggaagaagggctatgacagggtgaaggagagattcatggagcaccacatggcggagaggatcgccgcggtgctgaaggaagttctgcgcaaatcgcggcaacacactcgttcttgaactttgccatgcccaccccccatcgtgctaacattctagatctagaatcctattcggaggtccagactcgaggtaaattgtagattccggcctgttacacctgttgccctgcttcgcggtttactgtattccattcatttctctacggtttcacctactggggacagtaacgacggtttgaatttcacactg

SEQ ID NO: 28387 - protein, 243 aa, Panicum virgatum
  misc_feature: Ceres CLONE 1883256
  misc_feature (29)..(212): Pfam Name: Glycos_transf_1 Pfam Description: Glycosyl transferases group 1
  misc_feature: SWISSPROT Homolog: EC 2.4.1.56 Lipopolysaccharide N-acetylglucosaminyltransferase
MPQTYIVHLGNSKELMEVAEDGVARRVLREHIRESLGVRSEDLLFAIINSVSRGKGQDLFLQAFYQSLQLIKQQKLKVPTMHAIVVGSDMNAQTKFETQLRDFVVKNGIHDRVHFVNKTLAVAPYLAAIDVLVQNSQARGECFGRITIEAMAFKLPVLGTAAGGTTEIVVDGSTGLLHPAGKEGVAPLAKNIVRLASRAEQRASMGKKGYDRVKERFMEHHMAERIAAVLKEVLRKSRQHTRS

SEQ ID NO: 28388 - DNA, 728 bp, Panicum virgatum
  misc_feature: Ceres CLONE 1883267
  misc_feature: Encodes the peptide sequence at SEQ ID NO. 28389
acttcttctcctcctcctcccttgccatgagttttacggtggcgaggccagcaggaacaaccacagcaagagcaagcaacagctagtttgtggcagcactcgtcgggaaggagggggaggagcaagcttcctgtcgattccttttgttgctgtttcagatcaatttgcagccacacacacatatgagatagatagggaggaaagggaagatcgacgacagccctgctagtccaatccagaaataaactaaggctaccaaaagggaaaagattcccttgttcttgagcggtaagtttgtcaaggacaaatctggagggcgcgatggcatccaattcatcggcggcggctgtggcagcgctgtttggaattagggatggcgaccaccaggagcagattaagccgctgcttgcgcagccgcaccagcagctgcctcctgcgccactgctcagcgcggccgcctcgtcgtcggctccagggtccgcccaggcggcggcggcgtcaccgccagtgaagaagaagagaaccctaccagaccctgacgctgaggtgatcgccctgtcgcccaagacgctgctggcgacgaaccggttcgtgtgcgaggtgtgcaacaaggggttccagcgggagcagaacctgcagctgcaccggcgcgggcacaacctgccgtggaagctgaagcagaaggacccgctgcaggcgcggcggcggcgcgtgtacctgtgccccgg

SEQ ID NO: 28389 - protein, 135 aa, Panicum virgatum
  misc_feature: Ceres CLONE 1883267
  misc_feature (90)..(112): Pfam Name: zf-C2H2 Pfam Description: Zinc finger, C2H2 type
  misc_feature: The sequence is a functional homolog of SEQ ID NO 1086 in the 10/666,642 US patent application
  misc_feature: The sequence is a functional homolog of SEQ ID NO 1719 in the 11/479,226 US patent application
MASNSSAAAVAALFGIRDGDHQEQIKPLLAQPHQQLPPAPLLSAAASSSAPGSAQAAAASPPVKKKRTLPDPDAEVIALSPKTLLATNRFVCEVCNKGFQREQNLQLHRRGHNLPWKLKQKDPLQARRRRVYLCP

SEQ ID NO: 28390 - DNA, 628 bp, Panicum virgatum
  misc_feature: Ceres CLONE 1883267-R
ggtgaccaccaggttgctcctggcaggatgtacaacgaccaggccgtgatgctgccgcagatgtccgcgacggcgctgctgcagaaggcgtcgcagatgggctccaactcgagcgcgcacggcggcggcgcgtccgtgtttgggggcctcgtgggctcgtccgtgccctccgccgcgcacggccgggcgcccatgctcgaccagagccagatgcacctgcagagcctgatgaactcgctggccggcggctgcatgttcggcggcggcgccaacagtggcgacatgatcgacccaaggatgtacgacatggatcaagacgtgaagtttagccagggccgtggcggcgctgagatgacgcgcgacttccttggcgtcggcggcggcggcgtcatgagggggatgccggtggcgagaggggagcaccatgacggtgccggtgacatcagctccttggaggccgagatgaagtcggcctcgtcgtccttcactggaagcaggatgcaataaaagcttctccttgcatatatactgagcgagcgagtcctgagcaacctggcattggcatgcatgcaagggtgttatactgaatccgttaaaacaggttgttatagtatacactttacaatgc

SEQ ID NO: 28391 - DNA, 2774 bp, Panicum virgatum
  misc_feature: Ceres CLONE 1883271
  misc_feature: Encodes the peptide sequence at SEQ ID NO. 28392
agaggcctcccgtgtcacagcttcctgctccgtctcctccgtccccctcctccatcgccagcagctcgccggccagggccggccgccggctgcgtggtcaacctcggcggcgccgccgggcatcgtcttctgcctcgacgtccaggcattctctggccagccaggtaccaactggcgcatcttagagcttgatattccccagactccagcatcttaaagaaggcctccgaggtgttcggagatccgaaatgtcgctcgaggtcgagaaccctgagggaaatgagtcggcaaatcggctcagcctcaagcgccatgactcgctcttcggcgatgcagagaaggtctctggtggcaagtaccatggctccgagggtagctgggcccggacgctgcatcttgccttccagagcgtcggcatcatctacggcgacatcgggacgtcgccgctctatgtctactcaagcaccttcccagatggcatcaagtacaacgatgatctgctgggcgtcttgtcgctcatcatctacaccctcatcatcattccgatgctcaagtacgtcttcatcgtgctgtatgcaaacgacaatggagatggtggcacgtttgcactttattcactgatatcgcggtacgcgaagatcaggatgatcccgaatcagcaagcagaggatgccatggtgtccaactacagcatagaagcaccgaactcacagctgaggagggcacagtggttcaagcagaagcttgagtctagcaaggtagccaagattgtgctcttcaccctcacaatccttggcacatccatggtgatgggcgatggaaccttgacaccggcaatatctgtgctatctgcagtgagcgggatacgagagaaagcgccaagcttgactcagacggaagttgtctggatctctgtggcgattctgttcatgctcttctcggtccaacgttttggtactgacaaggtcggctacacatttgctccggtcatctctgtatggttccttctgattgctggtattggaatgtacaacctcgttgtccacgatatcggtgttttgcgggccttcaatccgtggtacatagtacaatacttcaaaaggaatgggaaggatggatgggtttcacttggtggcattatcttgtgtgtcacaggcacagaaggtatgtttgctgacctcggacacttcaacatcagagctgttcagatcagcttcaatggtatcttgttcccgtcagtaacgctatgttacattgggcaggccgcatacctgaggaaatttccagagaacgttggggacaccttctacagatccatcccaggacctttgttctggccaaccttcgtcgttgcaattcttgctgctattattgcaagccaagccatgctctctggtgcatttgccatcctttccaaggcactgtcgcttggttgtcttcccagggttcaagtgatccacacctcaaagaagtatgaggggcaggtttacattcctgaggtgaacttcatgatgggactggcgagcatcatagtcacaattgccttcagaacgaccaccagcatcggcaatgcttatgggatctgtgtcgtgaccacattctccatcaccacccatctggtgacggtcgtaatgctcctcatatggaagaagaacatcatcttcgttcttctgttctatgtcgtgttcagttgcacagaactgatctacctctcttccatactgtccaagttcatccagggcgggtacctcccgttttgcttcgctctggtcctgatgaccctgatggcgtcttggcactacgtccatgtcaagagatactggtatgagcttgaccacattgtgcccaccaaccaaatgacaactctgctcgagaagaacgatgtgcggcggatcccaggggtggggctcctgtacacagagctcgtccagggcatcccaccagtgttccctcggctgatcaagaagataccatcagtgcactccatcttcctgttcatgtcgatcaagcacctgccgatcccacacgtggtaccggcagagaggttcctcttccggcaggttggcccaagggagcaccggatgttccggtgtgtggcaaggtacgggtacagtgactcgctggaggagcccaaggagtttgcagggttccttgtggacagactgaagatgttcatacatgaagaaattgcattcgctcaaaacgacgcggagaatgaagacgagactacctccatcaccgatgtcccagaagcacaggcaaggccaaggcggtccacaaactctgtcgtgcacagtgaggaggcgatcgaaccacgggtgagcagcaactcagggaggatcactgtccatgcgaatcagatagtcgaggaggagaagcagctgattgacagagaggtggagcgaggggtagtgtacctgatgggagaggccaatgtgtcagcagggcccaagtcatcaatcttgaagaagatagttgtcaactacatctacacattcttgaggaagaacttgacagaggggcacaaggccttgtccattccgaaagatcagctgctcaaagttggcatcacatatgaaatatagggattttttttttttgaaactactaggcgtgcctaaccaatcctttcttggcatgtgtgatctcaaagggcgaagtgccgcggttggtttaataaaaggcatgtgtgagttgggtttctttttgttgtctgtatagtgtggttttattatattctgtcaaatgcaagagtgatattggaagttaagcgt

SEQ ID NO: 28392 - protein, 778 aa, Panicum virgatum
  misc_feature: Ceres CLONE 1883271
  misc_feature (49)..(778): Pfam Name: K_trans Pfam Description: K+ potassium transporter
MSLEVENPEGNESANRLSLKRHDSLFGDAEKVSGGKYHGSEGSWARTLHLAFQSVGIIYGDIGTSPLYVYSSTFPDGIKYNDDLLGVLSLIIYTLIIIPMLKYVFIVLYANDNGDGGTFALYSLISRYAKIRMIPNQQAEDAMVSNYSIEAPNSQLRRAQWFKQKLESSKVAKIVLFTLTILGTSMVMGDGTLTPAISVLSAVSGIREKAPSLTQTEVVWISVAILFMLFSVQRFGTDKVGYTFAPVISVWFLLIAGIGMYNLVVHDIGVLRAFNPWYIVQYFKRNGKDGWVSLGGIILCVTGTEGMFADLGHFNIRAVQISFNGILFPSVTLCYIGQAAYLRKFPENVGDTFYRSIPGPLFWPTFVVAILAAIIASQAMLSGAFAILSKALSLGCLPRVQVIHTSKKYEGQVYIPEVNFMMGLASIIVTIAFRTTTSIGNAYGICVVTTFSITTHLVTVVMLLIWKKNIIFVLLFYVVFSCTELIYLSSILSKFIQGGYLPFCFALVLMTLMASWHYVHVKRYWYELDHIVPTNQMTTLLEKNDVRRIPGVGLLYTELVQGIPPVFPRLIKKIPSVHSIFLFMSIKHLPIPHVVPAERFLFRQVGPREHRMFRCVARYGYSDSLEEPKEFAGFLVDRLKMFIHEEIAFAQNDAENEDETTSITDVPEAQARPRRSTNSVVHSEEAIEPRVSSNSGRITVHANQIVEEEKQLIDREVERGVVYLMGEANVSAGPKSSILKKIVVNYIYTFLRKNLTEGHKALSIPKDQLLKVGITYEI

SEQ ID NO: 28393 - DNA, 1198 bp, Panicum virgatum
  misc_feature: Ceres CLONE 1883279
  misc_feature: Encodes the peptide sequence at SEQ ID NO. 28394
ataccgcctcccgggttctctttccgagcggcgagtcggcgacgacagggcgagcggccacccttggccaggtcttcgtcgggcgattcgacgccgacgagcatcagggagcatccttttaaatctcctttgaaggaataattaccgaattaggcaagggctgtttataaaattgaagatgtcagtttctatgaaggacctggacccagccttccgtggctctggacaaaaagacggcttggaaatatggcgtattgagaatttcaagcccgttcctatccctgcatcttcatatgggaagtttttcatgggcgattcttacattatcttgaagacaacagccttgaaaaatggttctcttcgccatgatatccattactggattggtaaagatactagtcaggatgaagctggaactgctgcaattttaacagtagagcttgatgctgcccttggcggacgtgctgttcagtaccgagaagtacaaggcaatgaaacagagaaattcctatcctattttaggccatgcatcatgccacggccaggaggagtgtcatctggattcaagcatgttgatgtcaacgaccaggatcatgagactcgcttatatgtctgccatgggaagcacgtcgttcacgttaaagaggttccttttgctcgatcgtcccttaatcatgatgacatatttattctggatacgaagtccaaaattttccagttcaatggctcaaactcatccatccaagagcgagcaaaagctcttgaagttgtacagtacatcaaagatacatttcacgaggggaagtgtgaaattgcatctgttgaggatggtagaatgatggctgatgcggaagctggtgagttctggggttttttcggtggctttgctcctcttccaaggagggcacctgcagaaggcaatgagaaacatgaggaaactgccatcaaattgctatgttttgaccaaggaaaactggagccagtgaactacgaatccttggcacatgaattactccagacaaacaagtgctacttcttagactgtggtgctgaattgtatgtttggatgggcagaactacatccctgcaggagagaaagggtgctagtgaagctgctgagaaattgctctctgattcaaaccgaacaaaaacacacatcatcaaagtgattgaaggatttgagactgttatgttcaaa

SEQ ID NO: 28394 - protein, 339 aa, Panicum virgatum
  misc_feature: Ceres CLONE 1883279
  misc_feature (28)..(111): Pfam Name: Gelsolin Pfam Description: Gelsolin repeat
  misc_feature (150)..(230): Pfam Name: Gelsolin Pfam Description: Gelsolin repeat
  misc_feature (265)..(338): Pfam Name: Gelsolin Pfam Description: Gelsolin repeat
MSVSMKDLDPAFRGSGQKDGLEIWRIENFKPVPIPASSYGKFFMGDSYIILKTTALKNGSLRHDIHYWIGKDTSQDEAGTAAILTVELDAALGGRAVQYREVQGNETEKFLSYFRPCIMPRPGGVSSGFKHVDVNDQDHETRLYVCHGKHVVHVKEVPFARSSLNHDDIFILDTKSKIFQFNGSNSSIQERAKALEVVQYIKDTFHEGKCEIASVEDGRMMADAEAGEFWGFFGGFAPLPRRAPAEGNEKHEETAIKLLCFDQGKLEPVNYESLAHELLQTNKCYFLDCGAELYVWMGRTTSLQERKGASEAAEKLLSDSNRTKTHIIKVIEGFETVMF

SEQ ID NO: 28395 - DNA, 603 bp, Panicum virgatum
  misc_feature: Ceres CLONE 1883279-R
  misc_feature: Encodes the peptide sequence at SEQ ID NO. 28396
ggctgaattcaaagagaagtttgggatgacaaaagaggcattcagcaagcttccaaagtggaagcagaacaggctaaagattgatcttcaacttttttagtttggtcagcaaagcttcgaatatctcatttaatcctcgggtcaaatagccattcggtgaaagtaattcggttctaggcctcaatagcccatggcaactgagttttgcagaatgcaatcaccatctgcaatgacacatcaattctcacattgtcctggatcagtcccctttttcctagcttgagtttgttttgctatgtttcttttattccttcaattcattggcgtgagtttacttcttcttctttttttttttggtcaagtgccctccattgattcaagggtcacacaggtttgattctgaggcttgcatttttttttgtatcaactgtcttcctgtgttctttttcggttttgagatgagttgcagtttgagggagcaagaagtgtgtacagcagagtgccggcactgtaaagtcacaacaacgttacctttgatcaatacagtttatttccgcgtgtaaattatattatattttatagagcttgttgaatatctgagac

SEQ ID NO: 28396 - protein, 32 aa, Panicum virgatum
  misc_feature: Ceres CLONE 1883279-R
  misc_feature (2)..(32): Pfam Name: VHP Pfam Description: Villin headpiece domain
AEFKEKFGMTKEAFSKLPKWKQNRLKIDLQLF

SEQ ID NO: 28397 - DNA, 2300 bp, Panicum virgatum
  misc_feature: Ceres CLONE 1883302
  misc_feature: Encodes the peptide sequence at SEQ ID NO. 28398
gacgcgcgcgcagggctacgcagtcgtagtagagtaggcaaccagcagcagcaggaagagcacgctagcgccgccgcctaccgctttcccgcccgcttgatttgcctcctccaccagccggcggccgacggccgggagcaacccaaaaagtcagaggggaattggcccacggccgggccgcccgcagcggagccgggacgaggcgaggtgaggtgagcggaggccatcaggggggggccacggggcgtcatggcccagcatatatacgccgccaccaccagcagcgggtgcgcgaccccgctgctctcccccgcgccggccctcctccacctccaccccctcctcccctcgcggttgccgcggcgccggaccagccccatgggcgcgaccggccacctcgcgctgtccgccgccgccgccgccaagccgcggagcggccgcgggccgtgcgcggccgtgctgggcgagccgctgccggcgctcgacgacgccggcctcctcgtccaccccagcgccgacttcgccgcccgcgccctcgtctcctccgagcagcagtaccgggagatgtaccagaggtcgatcgacgaccctgccggattctggtcggagatcgcggaggagttctactgggagcagcggtggaaccctgacgaagtttgctccgagaacctcgacgtgaccaagggaccaatcaagatcgaatggttcaaaggtgggaggaccaacatatgctacaatgcggtggaccgcaatgtggagtctgggaacggggacaagattgccatgtactgggaggggaacgagcccagtcaggacgggaagctcacatactctgagctcttggacaaggtttgccagctggcgaattacctgaaaagcgttggcgttggaaagggtgacgctgtggtgatctacctgccgatgttgatggagctgcccattgcaatgcttgcatgtgctcggattggtgctgttcactcggttgtgtttgctggcttctctgctgatgcactagcacagagaattgttgactgcaagcccaaggctgtgattacctgcaacgctgtgaaaagggggctgaaactcatccctctgaaagatatagttgacacttctctggttgaaagtgcaaagaatggagttaatgtaggtatttgcttgacatatgaaaatcagtcagcgctgaataaagtagacacacaatggaaaccaggaagagatgtttggtggcaggatgttgtacccaatttcccaactaaatgtgatgtggaatgggttgatgcagaggatccattgtttcttctgtacacaagtggcagcacagggaagccaaagggtgtgttgcatacaactgggggctatatggtctactctgctacaacgtttaagcatgcatttgactacaagcccggagatgtatactggtgcactgcagactgtggttggattactggacatagttatgtgacatatggtcctctattgaatggggcctcagttctcattttcgaaggggctccaaattaccctgatcccggtcggagttgggacatcgttgacaaatatggagtgacaatattttatactgcaccaacacttatacgctcactcatgcgtgatggtactgagtatgttgatcggtactctcgcaagtccctccgagtgcttggaagtgtgggtgagccaatcaacccaaccgcatggagatggttctatgatgtagttggtgactcacgatgccccatatcagatacttggtggcagactgaaactggtggattcatgatcactcctttacctggtgcttggcctcaaaaaccaggatcagcaacatttcctttcttcggtgtgcagccagccattgttgatgagaaagggcgggaactggaaggagaatgcagtggatatctttgcataaagaagtcatggcctggggctttccgaactctctatggagataaagacagatatgagacgacatactttaaaccattcgctgggtattatttctcaggtgatggttgcagcagggataaagatggctaccactggctgaccggaagagttgatgatgttatcaatgtgagtggacaccggattgggactgctgaagttgagtctgctctggtttcacatccaaaatgcgccgaggccgctgttgttggcattgaccatgaggttaaaggccagggaatatatgctttcgtgactttggtggatggcgtttcctacagtgatgatctaagaaaaagcctcattatgacagtccgcagccagattggcgcattcgctgctcctga

SEQ ID NO: 28398 - protein, 640 aa, Panicum virgatum
  misc_feature: Ceres CLONE 1883302
  misc_feature (150)..(594): Pfam Name: AMP-binding Pfam Description: AMP-binding enzyme
  misc_feature: SWISSPROT Homolog: EC 6.2.1.1 Acetate--CoA ligase
MGATGHLALSAAAAAKPRSGRGPCAAVLGEPLPALDDAGLLVHPSADFAARALVSSEQQYREMYQRSIDDPAGFWSEIAEEFYWEQRWNPDEVCSENLDVTKGPIKIEWFKGGRTNICYNAVDRNVESGNGDKIAMYWEGNEPSQDGKLTYSELLDKVCQLANYLKSVGVGKGDAVVIYLPMLMELPIAMLACARIGAVHSVVFAGFSADALAQRIVDCKPKAVITCNAVKRGLKLIPLKDIVDTSLVESAKNGVNVGICLTYENQSALNKVDTQWKPGRDVWWQDVVPNFPTKCDVEWVDAEDPLFLLYTSGSTGKPKGVLHTTGGYMVYSATTFKHAFDYKPGDVYWCTADCGWITGHSYVTYGPLLNGASVLIFEGAPNYPDPGRSWDIVDKYGVTIFYTAPTLIRSLMRDGTEYVDRYSRKSLRVLGSVGEPINPTAWRWFYDVVGDSRCPISDTWWQTETGGFMITPLPGAWPQKPGSATFPFFGVQPAIVDEKGRELEGECSGYLCIKKSWPGAFRTLYGDKDRYETTYFKPFAGYYFSGDGCSRDKDGYHWLTGRVDDVINVSGHRIGTAEVESALVSHPKCAEAAVVGIDHEVKGQGIYAFVTLVDGVSYSDDLRKSLIMTVRSQIGAFAAP

SEQ ID NO: 28399 - DNA, 270 bp, Panicum virgatum
  misc_feature: Ceres CLONE 1883302-R
atttatgggctatggagtctgaaatggtcactgcatgcgctacacgttgtgttgaactcaacttgtgtgcggtcaggtcagcgcccgacccacgattctctggtttctttggtgtttgggggaatggcaaccaaagagagatgatgcggtgcgtctgtaaattgttggatcaagtcacagatagtagtagattggtaaataaggaaattaatgtaagtgcaagttttgggttcatcgaaagttatataatggtacaggttggaactttac

SEQ ID NO: 28400 - DNA, 1344 bp, Panicum virgatum
  misc_feature: Ceres CLONE 1883303
  misc_feature: Encodes the peptide sequence at SEQ ID NO. 28401
ctctctctcctctctctagcacatcaaaaaaaaaaaagaattctctctctctcagcagcaacgcagcctccgccttcccgttcacaccgccgctccgctctcctcgctcttcttctcccccagcagcagccgccatgccctagcgccgtcttctccgccccgagctccgtcggctgcgtccagcgcccgccgtggccggacgcgctccccgcatctgggcgggcgggctggccggcggtcggcgcgccccggcagctccgtcgccggtgccattgtactggtattagtcccctgtgatcatcacatcaccatcactagtgatgcattcttcagaaaataaaatggtatgctccaactcaggacggtcatcaaaaaggaggaaagagacctcttcagatttggttcctgtgtcaaacagaccaagtcgacgaaatgcttcccgccggtgtaaatttgattctccttcgaagagatcaccaaggaaagttaggaatgctactctggcaaaaagcataaagaagaaatatcattgtagtcctctaaaacggcggaaggattcagattctgttgctggaaacattgtaagaggactagtaacaaggaggaagaaaaaaagaaaaaggcaaaatattgatgaagcaattcgtttggaaagaagagcaagatattttctaatcaagataaaattggagcagaatttattagatgcttactctggggatggatggaatggccaaagccgagagaaaataaaaccagagaaggaactgcagcgtgccaagaaacagatcataaaatgcaaaattgctatacgggatgttattcgccaactcgatttgtataattccacttggggtgttgatgacccagtgatgcctccagtcgcacctaccaattctgaacatatcatgtgttcgacatgcaagtctcatgaatcatttcccaactataaaattatcctctgcgaaggggcttgcaaaagggcatatcatgagaaatgtttggaacctcctttagaaaaaaatgctcttccaacaagtagccttggatggctttgcaaattctgtttgtgcaaggtgaaaattttagatgctattaatgcacatctaggaacaaattttacggtgaagtgcccttttgaagatgttttcaaggaagcaactgaacaaattgactctgaggatgcactagatgaagattggctttctgagtattcaggtgatgaggactatgatcctgaagaaaacgaggccaacagcagttgcatgaacagcggggaagaaattatgtctgatgattccaatggttcaggaagtccactttattctccaaatgatgatattc

SEQ ID NO: 28401 - protein, 341 aa, Panicum virgatum
  misc_feature: Ceres CLONE 1883303
  misc_feature (197)..(252): Pfam Name: PHD Pfam Description: PHD-finger
MHSSENKMVCSNSGRSSKRRKETSSDLVPVSNRPSRRNASRRCKFDSPSKRSPRKVRNATLAKSIKKKYHCSPLKRRKDSDSVAGNIVRGLVTRRKKKRKRQNIDEAIRLERRARYFLIKIKLEQNLLDAYSGDGWNGQSREKIKPEKELQRAKKQIIKCKIAIRDVIRQLDLYNSTWGVDDPVMPPVAPTNSEHIMCSTCKSHESFPNYKIILCEGACKRAYHEKCLEPPLEKNALPTSSLGWLCKFCLCKVKILDAINAHLGTNFTVKCPFEDVFKEATEQIDSEDALDEDWLSEYSGDEDYDPEENEANSSCMNSGEEIMSDDSNGSGSPLYSPNDDI

SEQ ID NO: 28402 - DNA, 626 bp, Panicum virgatum
  misc_feature: Ceres CLONE 1883303-R
gttgattcaggagacaattcatgctttgttcccttgtctgaaatcatcaatgtgcctacacgattgcaacgaaatcttgagaagaggaagatggaatcaactagcagccctgtgaggcaagcttgttctccaacagaccaagtcaaggagagcatgtcacctacaagcaagtcttgtttgtggacagatttgagccatccaataaacaatgaagtcatcactggatggcaagctgcttcccagatagatagtggtgcctgcgctgaagagcaagctgctcctcatatggatactggtgcctgcgctgaagagcaagctgctcctcatatggatactggtgcctgtgccgaagagcaagctgctcctttggtggatgttggggcctcagattatcagcctttcctggatgtgattgatgagatgtgtggacttgaatgtaggctgcagaagctgaagaagaacatgctgtcatcaggagcagtgggctgtggtaatggtgggagtgacatgaaaaaccaagctgtggtgctcgtgccatccgctgagctcaaggaaaaagcgtagcttggcgctttatctgggcattgcccataggttttatatagcagataactgtatagagaacc

SEQ ID NO: 28403 - DNA, 2534 bp, Panicum virgatum
  misc_feature: Ceres CLONE 1883317
  misc_feature: Encodes the peptide sequence at SEQ ID NO. 28404
agccgccagcagcctagcgcgcgctcctccgctcactggactggtagtcctggcgccgcgcctccgcccacctcgcgccggcgacgaaaggtgtcctccgttcatggttcccggcgccgtggctgggacgacatgccgcccctcgcgctcatccgctccctccccgcgaggctgctcgagcgagtgtgcgatggaatccgggggagcccggccgcggtgcgggacgaggagtccgggggcagcggccggtcgtcggcggcgggcgggcacccggcgggggagtgctacgcgtgcacgcagcccggggtgccggcgttccactccacgacctgcgaccaggtgcacgagcccggctgggacgccgacgcggggtcctcgctagtgccggtccaggcgcagcaggccccgccggcgctggcgtcggcggcgcagcacgcgggcgccgccgcgcggtggctgttcggccccgtgctggacccgcggagcaagcgcgtgcggcgctggaaccggtggatcctgctgggccgggccgccgcgctggcggtggacccgctcttcttctacgccctctccatcggccgcgccggccagccctgcctctacatggacgccggcctcgccgccgcggtcaccgcgctccggacctgcgccgacgccgggcacctcgcgcacgtcctgctccagttccgcctcgcctacgtctcccgcgagtccctcgtcgtcggctgcggcaagctcgtgtgggacgcccgcgccatcgccgcgcactacgcgcgctcggccaagggcttctggttcgacctcttcgtcatcctccccattccgcaggtcattttctggctggttataccaaagttaataagggaagagcaagttaaacttatcatgacaatattgctgctcatgttcatatttcaattcctccccaaggtgtaccacagtattcatatcatgaggaaaatgcagaaggtgactggttacatctttggaacaatatggtggggatttggtctaaatctatttgcctacttcattgcgtctcatatagcaggtggttgttggtatgttcttgcaattcagcgtattgcctcctgccttcaagaggaatgcaagaaaaacaacagttgcgatctaatatcgcttgcttgttcaaatgagatatgttttcaccctccttggtcatcaaatattaatggattcgcatgtgacacaaacacgacctccttcggtcaacaaaacgcgtctacctgtctaagtggaaatgggtcctttgcttatggtatctacttgggggctcttcctgttatatcaagcaattcgcttgctgtcaaaatactctatcctatattttggggcctcatgactctcagtactttcggtaacgatctcgcccctacgagcaatggtctcgaggtgatattcagcataatcaatgtcctcagtggcttgatgctcttcacactgctgatcggaaacatacaggtatttcttcatgccgtgctggcaaggaagcggaagatgcagctgcgtttccgggacatggaatggtggatgagacggaggcaactgccgtcccgcctgaggcagagggtccgcaagtacgagcgcgagcgctgggcggccgtcacgggagacgaggagatggagatgatcaaggacctgcctgaaggactcaggcgagacatcaagcgctacctctgcctcgagctggttaagcaggttccgctgttccatggcatggacgacctgatcctggacaacatctgcgaccggctgcggccgctggtgttctccagcggcgagaaggtgatccgcgagggcgacccggtgcagcgcatggtgttcatccttcagggcaagctccggagcacgcagccgctgaccaagggcgtggtggcgacgtgcgtgctgggcgcgggcaacttcctgggcgacgagctgctgtcctggtgcctgcgccgcccgttcgtggaccggctcccggcctcgtcggcgacgttcgagtgcgtggaggcggcgcaggcgttctgcctcgacgcgccggacctgcgcttcatcaccgagcatttccggtacaagttcgccaacgaaaagctcaagcacacggcgcgctactactcgtccaactggcggacctgggccgccgtcaacatccagctcgcgtggcgccggtacagggccaggaaggtggacgcgacggcgatggcggcgccgccgtcgctagccgccggtcccgacgacggggaccggcggctcaggcactacgcggccatgttcatgtcgctccggccgcacgatcacctcgagtagtaagcaggagggagggagggaccatcctaattcctattcctagctgctgtgccgggcgtgtactgtgtactgtacactgtactatgccgctgtcatcttctggtaaaagtgaataggtgattcgggttcgtcttttgaagaagaagaagatgaataatggagaagtattttcttagttcgttccgattgtcactttgtttgctgatcaagaatcaaaatttctc

SEQ ID NO: 28404 - protein, 725 aa, Panicum virgatum
  misc_feature: Ceres CLONE 1883317
  misc_feature (550)..(648): Pfam Name: cNMP_binding Pfam Description: Cyclic nucleotide-binding domain
MPPLALIRSLPARLLERVCDGIRGSPAAVRDEESGGSGRSSAAGGHPAGECYACTQPGVPAFHSTTCDQVHEPGWDADAGSSLVPVQAQQAPPALASAAQHAGAAARWLFGPVLDPRSKRVRRWNRWILLGRAAALAVDPLFFYALSIGRAGQPCLYMDAGLAAAVTALRTCADAGHLAHVLLQFRLAYVSRESLVVGCGKLVWDARAIAAHYARSAKGFWFDLFVILPIPQVIFWLVIPKLIREEQVKLIMTILLLMFIFQFLPKVYHSIHIMRKMQKVTGYIFGTIWWGFGLNLFAYFIASHIAGGCWYVLAIQRIASCLQEECKKNNSCDLISLACSNEICFHPPWSSNINGFACDTNTTSFGQQNASTCLSGNGSFAYGIYLGALPVISSNSLAVKILYPIFWGLMTLSTFGNDLAPTSNGLEVIFSIINVLSGLMLFTLLIGNIQVFLHAVLARKRKMQLRFRDMEWWMRRRQLPSRLRQRVRKYERERWAAVTGDEEMEMIKDLPEGLRRDIKRYLCLELVKQVPLFHGMDDLILDNICDRLRPLVFSSGEKVIREGDPVQRMVFILQGKLRSTQPLTKGVVATCVLGAGNFLGDELLSWCLRRPFVDRLPASSATFECVEAAQAFCLDAPDLRFITEHFRYKFANEKLKHTARYYSSNWRTWAAVNIQLAWRRYRARKVDATAMAAPPSLAAGPDDGDRRLRHYAAMFMSLRPHDHLE

SEQ ID NO: 28405 - DNA, 734 bp, Panicum virgatum
  misc_feature: Ceres CLONE 1883319
  misc_feature: Encodes the peptide sequence at SEQ ID NO. 28406
gtccactccgtttctcttccccacgaatctcccccgccggttcccgacccgccgccgtcgctcctcctcctcctcctcctggtggttcgccgccatgttggaggagctgctcatcttcacgcggggcggcctcatcctctggtcctcgtgccgggcgctcggcgccgccgccctcaagggctcgcccatcgacgccctcatccgatcctgcctcctcgaggagcgctccgccgacgccagcttctcccaggacaactacgccctcaagtggaccttccacaacgacctcggcctcgtctttgtcgccgtctaccagaagattctgcatcttctctacgtcgatgatctcctcgccgccgtccgcaaggacttctcccagatttatgatcccaagcgcaccaactacgacgacttcaccgacatattccgccagctccatctcgaggcccaggcgcgtgccgaggacatgaagtccaagcaggccatttcgtcccgtacgctgccagccgtctcccacaagactgctcccaaggctcgcggcgctgctgcccgtgctaccagcaagggcaaggatgactctgatggggactcggagcaccacgctttggcaaatggtaccttcacgggccaccagagtgctgcacccaacgacagctctcttgttaagggcaaggagaacggggtccccaaagacaacggggccttttcatgtactaaactacagaggttgcgaa

SEQ ID NO: 28406 - protein, 213 aa, Panicum virgatum
  misc_feature: Ceres CLONE 1883319
  misc_feature (27)..(206): Pfam Name: SRP-alpha_N Pfam Description: Signal recognition particle, alpha subunit, N-terminal
MLEELLIFTRGGLILWSSCRALGAAALKGSPIDALIRSCLLEERSADASFSQDNYALKWTFHNDLGLVFVAVYQKILHLLYVDDLLAAVRKDFSQIYDPKRTNYDDFTDIFRQLHLEAQARAEDMKSKQAISSRTLPAVSHKTAPKARGAAARATSKGKDDSDGDSEHHALANGTFTGHQSAAPNDSSLVKGKENGVPKDNGAFSCTKLQRLR

SEQ ID NO: 28407 - DNA, 2018 bp, Panicum virgatum
  misc_feature: Ceres CLONE 1883336
  misc_feature: Encodes the peptide sequence at SEQ ID NO. 28408
gcaaaagcaaaggggggaaacagaaaagtgagcccccaaaccctagaccccatggaagcgtggccgcctctcgcccccgcggtccctgcctccgacgatgcggccgtccctccgcctccccctcccgccgccggggcgtggggggccgcggccaccgcgcagcggaaggccgtggtgcaggagtcggctgcgcaggcggtgagccggctcgtggcgagctgcgccaactccagcggcgtggccgtggccgtggtggacgccaacgccgtcatcgctggcggctccgcgctctccaccaccgccgggcgcctggtcactgtgccggaggtgctcgaggaggttcgcgacgcggccgcgcgccgccgcctggcgctcctccccatccccgtcgagaccgttgagcctgcgccggagttcgtcaagagagtcaccaaatttgccagggagacaggtgacatccaaacactttcagatgttgatatcaagattattgctttggcttacatgttagaagccgagatccatgggactagccatttgcgggagcaccctcctcctctgcgtgaggtgaatgtcagaaaactgtctgaagctccacttcctggttggggctctaatgtccctaatctgaaagaatgggaagagttggatcaggtgtctgaagcaggtggagatatcaattctcggatacttccactgaaggatcttgagaatcaagatatccccatgagtgagaccaacagtgtttgtgaggcacaagaggacgcagaacaccagcctaataaagatgcacgcactgcatgggaagatgatgagaataacgaaggttggacacctgctgttagccgcagcacacacagaagatatctgcggaggaaggcaaggcgtgacgcccttaaggaatctggacaaagtcttgagacaagttctgttgctccatcaattgatgctgataaggtcctctctgaaaatggtgggtctgagtatgatttgactccaacagatggcccttcttctgcccctgaggaagtcaattcaagtactgacggattggaatgtcaagtagagaatgaacatgaaattgccggagagcatatacattctgatcaactggccaatgatgatgatactgatgaatgcactaaggaattggataacctcgacataaaaagcgagagtgatggaggtgatgatgcgcattctgtggatgatgagagcagtgagcagagttgggccctgaggtccttatctgagtctactgtagcatgtgttactagtgactatgccatgcaaaatgtcatcctgcagattggcctccgtctcttggcaccaggtggcatgcagatacgccaaatgcatagatgggttttgaggtgtcatgcttgctataaggtgacccaagaggttggcaaaatattttgtccaaagtgtggcaatgggggaactttacggaaggtttcagtaactgttggtgaaaatgggatcactatggcctcacgatgcccacgcgttacacttcgcggcacaaagttttccctcccaatgccccaaggtggaagagatgccataactaagaaccccattctacgagaagaccaacttcctcagaaggttcttcatccaaaatcgaagaagtccagcaagcaggaggacgatttcttgggcatcgacgacatattttcacacagcggtgacaagaaggcaccgttgaaacctccagtgaggaaggcacatgcaatgttcagtgggaaaagaaatccaaacgacaaccatttttcccgcaagaagcactaagttgaagcgcatctccctcgtttgttccttttcacaactatgataataccttagccccagtttgcgagttgaagcagagtatgtcatccagacttcattttttgaggttgcggagaaagcatgtaagcttatgcagttttggcaacatctatgtaaggttgttatgatattactacacagttcagctggaatgagttctaatttaaattggttcacatggacac

SEQ ID NO: 28408 - protein, 580 aa, Panicum virgatum
  misc_feature: Ceres CLONE 1883336
  misc_feature (431)..(502): Pfam Name: NOB1_Zn_bind Pfam Description: Nin one binding (NOB1) Zn-ribbon like
MEAWPPLAPAVPASDDAAVPPPPPPAAGAWGAAATAQRKAVVQESAAQAVSRLVASCANSSGVAVAVVDANAVIAGGSALSTTAGRLVTVPEVLEEVRDAAARRRLALLPIPVETVEPAPEFVKRVTKFARETGDIQTLSDVDIKIIALAYMLEAEIHGTSHLREHPPPLREVNVRKLSEAPLPGWGSNVPNLKEWEELDQVSEAGGDINSRILPLKDLENQDIPMSETNSVCEAQEDAEHQPNKDARTAWEDDENNEGWTPAVSRSTHRRYLRRKARRDALKESGQSLETSSVAPSIDADKVLSENGGSEYDLTPTDGPSSAPEEVNSSTDGLECQVENEHEIAGEHIHSDQLANDDDTDECTKELDNLDIKSESDGGDDAHSVDDESSEQSWALRSLSESTVACVTSDYAMQNVILQIGLRLLAPGGMQIRQMHRWVLRCHACYKVTQEVGKIFCPKCGNGGTLRKVSVTVGENGITMASRCPRVTLRGTKFSLPMPQGGRDAITKNPILREDQLPQKVLHPKSKKSSKQEDDFLGIDDIFSHSGDKKAPLKPPVRKAHAMFSGKRNPNDNHFSRKKH

SEQ ID NO: 28409 - DNA, 2111 bp, Panicum virgatum
  misc_feature: Ceres CLONE 1883340
  misc_feature: Encodes the peptide sequence at SEQ ID NO. 28410
aaattaaacgccgacaccccttgccggcgccgccactaccccacgccgccggctggtacacgtctcctccaccgctcctcctcctcgccgccgccgccgccgctgcctcgtgccacgccgcttgccaccatgctgcagagcaagtccttcgtgaagaagacgaagcaaggtcgcatccaaaagtacgtcagggagcactacctccgcgacgatgtctactgcggcttcgtcccctgcacagcctgcgacgccgccgccgagcgcaaactcgacgccgccgcggctgccatcctcgtcgtcgacaccaacgtcgtgctccaccagattgatttgctggagaatccggcgattgaggatgtcgtcctgctgtcggttgtcctggaggaagtgaagaataagaaccttgccgttttcaacaggatcaaggcactatgtaccaacaaagcacggaggttctacgttttcgccaatgagcagcacagggatacttatgtcaaagacatggttggggagagctctaatgatcgtaatgacagagcaattcgtgttgctgcccgttggtaccaaagccatcttggtgggagtgtgaaggttctgctgattacaaatgatagagagaacaaaaggaaagctattgaagaaggccttaatgctgagacagttgagtcatatgtaaggttgcttgcgcagcctagtttgcttgatttggtggtggttccaactagtggagatgttgccatggaagatgtagaagatcatagaccatccaagaagaaagtaatctacaggaagcacaaaccaatgtcggaaattacatctggtctgcggtgtggaatctaccatcaagggaagcttcgagttaatcgttacaatccatttgaagcttatgttggaagtgagagcattggcgatgagattgttatccgcggacggtcaaatatgaacagggcttttgatggtgatatagttgctgttgagctcttgccacaagatcaatggcatgagtcaaagtcatttatagcagatgatgatgaagaagaagaagaagtccatctggtacctaatagtgccgatgatgctcctcggaacaccagttccacacaatcaacagttggatcatctgctccttctttcgctagtcgtccacttggacgtgttgctggtatcattaagagaaattggaattcgtactgtggatccttgcagccaatgcccatgcctgctggtagtgggggcgttgctcatgctttatttgtttcgaaagatcgaagaattcctaaaatccgaattcaaaccagacagcttgagaatcttttgaacaaaagaattgttgttgcggttgattcatgggatgtttcgtctcgctatccgtcaggtcactatgtacgaacgattggagatattggtgacaaagaaactgaaacagaggttgtcttaatagagaatgatatcaacacgagacctttctctacacaagtcctttcttgtttgccaccattaccatggacattatcaccagaagatttggctaatcctaatcgacaagacttgcgtcatgtgagagtctttagtgtggatccaccaggttgtcgagatattgatgatgcactacattgcacgttactcccaaatggaaattttgaagttggagtccatattgctgatgtcactaattttgttcaccctggtacccctctcgatgaggaagctgctcaaaggggcacttctgtttatcttgttgggcagcggattgatatgcttccaaagcccctgactgaagatgtttgttcacttcgtgctgatgttgaaaggctggcattctctgtcatttgggaaatgactcctgatgctgatatcatatccacgagatatacgaagagtgttatcaaatcttgtgctgcaatgtcttatgtggaagcccaggcaagaatggatgacagccgtttagttgatccactaactgtagacttgcggaacttaaattcattggcaaagatcatgcgacaacgacgttgcgaaagaggggctctgactcttgcttctgcagaagtaaaatttgagattgatagtgaaactcatgatcctcttgacataggaatttatcaaatccg

SEQ ID NO: 28410 - protein, 660 aa, Panicum virgatum
  misc_feature: Ceres CLONE 1883340
  misc_feature (471)..(660): Pfam Name: RNB Pfam Description: RNB domain
  misc_feature: SWISSPROT Homolog: EC 3.1.13.1 Exoribonuclease II
MLQSKSFVKKTKQGRIQKYVREHYLRDDVYCGFVPCTACDAAAERKLDAAAAAILVVDTNVVLHQIDLLENPAIEDVVLLSVVLEEVKNKNLAVFNRIKALCTNKARRFYVFANEQHRDTYVKDMVGESSNDRNDRAIRVAARWYQSHLGGSVKVLLITNDRENKRKAIEEGLNAETVESYVRLLAQPSLLDLVVVPTSGDVAMEDVEDHRPSKKKVIYRKHKPMSEITSGLRCGIYHQGKLRVNRYNPFEAYVGSESIGDEIVIRGRSNMNRAFDGDIVAVELLPQDQWHESKSFIADDDEEEEEVHLVPNSADDAPRNTSSTQSTVGSSAPSFASRPLGRVAGIIKRNWNSYCGSLQPMPMPAGSGGVAHALFVSKDRRIPKIRIQTRQLENLLNKRIVVAVDSWDVSSRYPSGHYVRTIGDIGDKETETEVVLIENDINTRPFSTQVLSCLPPLPWTLSPEDLANPNRQDLRHVRVFSVDPPGCRDIDDALHCTLLPNGNFEVGVHIADVTNFVHPGTPLDEEAAQRGTSVYLVGQRIDMLPKPLTEDVCSLRADVERLAFSVIWEMTPDADIISTRYTKSVIKSCAAMSYVEAQARMDDSRLVDPLTVDLRNLNSLAKIMRQRRCERGALTLASAEVKFEIDSETHDPLDIGIYQI

SEQ ID NO: 28411 - DNA, 722 bp, Panicum virgatum
  misc_feature: Ceres CLONE 1883355
  misc_feature: Encodes the peptide sequence at SEQ ID NO. 28412
taggtgctcacactgggcaagggcaacccaacccaccagcgcagccagctcccagagaaatatccacgctactgctacggacagagcgggcacaaaagccctctagctagctagcaaagcagccatttctgaaaggcgatcgatcggagtagtgagcattagtcgatctacgcacggccggggaacagctagctggtgcagcagctccatctccctgctgtttctgcggcggctgtagagtactagagtgtgatctgcttgttggggcttggggtagctggaggatgggctgcgaggaggacgagaggctgctgttcccgtccttcgcattcccggcggagagcttcgcggaggccgacacccccggctccggccgcgagcagaagaaggcgcggcagcggcggaggcggaagcagcggccggcgggggagggcgacggcggcgacgagcagtccaagaagcgccggctcagcgacgagcaggcgcggttcctggagctcagcttccggaaggagcggaagctcgagacgccccgcaaggtgcagctcgccgccgagctcggcctcgacgccgagcaggtggccgtctggttccagaaccgccgcgcccgccacaagagcaagctcatggaggaggagttctccaagctccgcgccgcgcacgacgccgtcgtcctccagaactgccacctcgagaccgagctgctgaggatgaaggatagg

SEQ ID NO: 28412 - protein, 145 aa, Panicum virgatum
  misc_feature: Ceres CLONE 1883355
  misc_feature (58)..(112): Pfam Name: Homeobox Pfam Description: Homeobox domain
MGCEEDERLLFPSFAFPAESFAEADTPGSGREQKKARQRRRRKQRPAGEGDGGDEQSKKRRLSDEQARFLELSFRKERKLETPRKVQLAAELGLDAEQVAVWFQNRRARHKSKLMEEEFSKLRAAHDAVVLQNCHLETELLRMKD

SEQ ID NO: 28413 - DNA, 604 bp, Panicum virgatum
  misc_feature: Ceres CLONE 1883355-R
  misc_feature: Encodes the peptide sequence at SEQ ID NO. 28414
gaggagaggactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaaggccaatcctgtggtgaaggcggagaagcttgaaaagatctgaagggggcaatggggaacgaaatgggttgtgttctgcaagattcaatcatgcatctttgctgctttatcattgaacatcccattcttgtttgctgccacatccctgagtcgttcaacactatgatgctcacgcatcctggcagctgcaagaagtcatcctcagtcgagtccaaaatggtttgcgtgttggctatgttgtgtaagcttattcagttattcatggtggtttcagtcggtattgtggcatttccatttaggtagctctgtaatgtactactgtctcatgcgtgttacattccaatcagtaatagtaatcagcaatggtctgc

SEQ ID NO: 28414 - protein, 91 aa, Panicum virgatum
  misc_feature: Ceres CLONE 1883355-R
  misc_feature (32)..(72): Pfam Name: zf-AN1 Pfam Description: AN1-like Zinc finger
  misc_feature: The sequence is a functional homolog of SEQ ID NO 20 in US patent 7161063
  misc_feature: Functional homolog of the protein sequence given in SEQ ID NO 51279
  misc_feature: Useful for making plants with modulated water use efficiency
  misc_feature: Functional homolog of the protein sequence given in SEQ ID NO 51280
  misc_feature: Useful for making plants with altered lignin content
  misc_feature: Functional homolog of the protein sequence given in SEQ ID NO 51281
  misc_feature: Useful for making plants with modulated nitrogen use efficiency
EERTIVVQPPFVAETSEAAAIIPKAKEGPNRCATCRKRVGLTGFNCRCGNMYCALHRYSDKHDCQFDYQTAARDAIAKANPVVKAEKLEKI

SEQ ID NO: 28415 - DNA, 545 bp, Panicum virgatum
  misc_feature: Ceres CLONE 1883356
  misc_feature: Encodes the peptide sequence at SEQ ID NO. 28416
attgtacttaaagctcaaatgctttttccagagcttgaaaatgcatctcagctgttaaccatctgcagtgtgcactgcgcagcagagttaagggtgaacggagagatagatttctatggaatccttcgagtggaggaaggagcggatgaagccttgataagaaagcagtaccgcaagcttgcattttcacttcatcctgataaaaattgtttcgtgggtgctgaagcagctttcaagttggttgctgaagctcactctgtactatgtgatcccacaaaacgatctcagtatgacctgaaaaggaagaatgtatttagaaatgtgccaaagccagctaagcagcagtcatcaaagaagactgaatcaaacaaacggagcaggcctggacctggtgaagcattttggaccatatgcccacattgtcagatgcgataccagtacctcatcaatatcttgaacaccatggtcctctgtatgagctgcagaaggaatttttttgcatacaatctgtatgagcagcccatacccacttcatcaagcgtacc

SEQ ID NO: 28416 - protein, 181 aa, Panicum virgatum
  misc_feature: Ceres CLONE 1883356
  misc_feature (37)..(98): Pfam Name: DnaJ Pfam Description: DnaJ domain
IVLKAQMLFPELENASQLLTICSVHCAAELRVNGEIDFYGILRVEEGADEALIRKQYRKLAFSLHPDKNCFVGAEAAFKLVAEAHSVLCDPTKRSQYDLKRKNVFRNVPKPAKQQSSKKTESNKRSRPGPGEAFWTICPHCQMRYQYLINILNTMVLCMSCRRNFFAYNLYEQPIPTSSSV

SEQ ID NO: 28417 - DNA, 1639 bp, Panicum virgatum
  misc_feature: Ceres CLONE 1883372
  misc_feature: Encodes the peptide sequence at SEQ ID NO. 28418
accgccgccggggcgcttcgtgcgcaggggcacgactacgaggcgctcgcggcgcgcaagcgcaaggccctcgccgaggaccagccccagagggagggttccaagaggccaaggcaggatgaacttacagaagcggaagcagcaaccatgttcgaccaactgatggaaggctttggccttcggcgcaaaagaaggtcaaaagaaggcaagaagaggggaagaaagaaaggaacaaaaaataagggcagccctgaagttattaaaaagttgggtgatgctactctactttttgctgaagaaaaatttaacaaggcaattcctatactacatgagattgtgcgaattgcaccaaatttgccagattcatattatctacttggtagcatttataataagactggtgaactagataaagccataaacttcttgatgcttgccgcctatgtctccccaaaggatgcatctctgtggaagaaactcattcccttggcaaagaaaaaggaagatgcttctctggcaagacactgcattttaaaagcaatgagagcagacccggaagatgtagatctgaagtatctttgcggtgatatgtatcgtaaccttcgtgactatcaaaaagctgcagagatatatgagcagatagttagaatttatcctgccaatattgccgttcgtaaagtagctgcacagatgtacagagagagtggtcaaattgacaaagctattaatttgttggaagactatgttaatactcaaactaccaacagtgactggactgttctagatttgttgatatccctttatttgagaaataatgctattaatgaagcactaaagcagatcgagaaggcacgcctacagttgcgatctcaacagaaactaccagtacaattgcaggcgaaggaagtaatctgccatgcttatctaggagacatgaaacatgctgagattttccttaatgatgtgcacttggagccatcaaaagatagcactgatgtgactaaggagctcgcaagcaatttagaaactatgggactatatgagtatgcagtgaagttttacctgatgattggaaatgttgctaatcataatgatggcagttcatatattgatcacaaagaattgggtagttcatatgtcaaagtcgctcagtgctacatggtcttaggggacaaaagaaatgccattccttatttttataaagccttacaaagcataaaggacaatatcgatatacgattgaccttatcctcccttcttattgatgaggacaagacagatgaagctatcaccttgctttctcctcccaaaaatccagagttgcagtctgctaacactccagaacaacacaaaccttggtggtgtgatgggagagtaaagatgcagcttgcaaaaatttattacaataaaggcaagctggaagactttgtggatacaatttttcatcctattctagaaacattgaatgttgaatatgctaatcgaaaggtcaagccaatgagaaagcttacaaatactgttctgcatgaaagagttaaagtattgggggaaccacgtccagatagtatatttcaaggattaaggccaatagcatcacctggggagttacaaaaggcaaacagagcaaagaaacttatgg

SEQ ID NO: 28418 - protein, 546 aa, Panicum virgatum
  misc_feature: Ceres CLONE 1883372
  misc_feature (120)..(153): Pfam Name: TPR_1 Pfam Description: Tetratricopeptide repeat
  misc_feature (188)..(221): Pfam Name: TPR_2 Pfam Description: Tetratricopeptide repeat
TAAGALRAQGHDYEALAARKRKALAEDQPQREGSKRPRQDELTEAEAATMFDQLMEGFGLRRKRRSKEGKKRGRKKGTKNKGSPEVIKKLGDATLLFAEEKFNKAIPILHEIVRIAPNLPDSYYLLGSIYNKTGELDKAINFLMLAAYVSPKDASLWKKLIPLAKKKEDASLARHCILKAMRADPEDVDLKYLCGDMYRNLRDYQKAAEIYEQIVRIYPANIAVRKVAAQMYRESGQIDKAINLLEDYVNTQTTNSDWTVLDLLISLYLRNNAINEALKQIEKARLQLRSQQKLPVQLQAKEVICHAYLGDMKHAEIFLNDVHLEPSKDSTDVTKELASNLETMGLYEYAVKFYLMIGNVANHNDGSSYIDHKELGSSYVKVAQCYMVLGDKRNAIPYFYKALQSIKDNIDIRLTLSSLLIDEDKTDEAITLLSPPKNPELQSANTPEQHKPWWCDGRVKMQLAKIYYNKGKLEDFVDTIFHPILETLNVEYANRKVKPMRKLTNTVLHERVKVLGEPRPDSIFQGLRPIASPGELQKANRAKKLM

SEQ ID NO: 28419 - DNA, 162 bp, Panicum virgatum
  misc_feature: Ceres CLONE 1883372-R
taccgtgggctctcagtaatctaggatcaatttagtctatacaggtagaatacttatgtatgtcagtaatgtcaatgaataattagcaaagtgccagatcagcaatcaattacatatgggagagaagagtaagctgggattaaaatgtgttcgacgaattcc

SEQ ID NO: 28420 - DNA, 2446 bp, Panicum virgatum
  misc_feature: Ceres CLONE 1883376
  misc_feature: Encodes the peptide sequence at SEQ ID NO. 28421
attacgctttcttccgctgcctctctccaccaaacccagaagaaaccagcctttgcagtttcgcggatcggccctcgccgaccacttatttgtcaaaagttgccgcttgcctgtattgtccctttccgcgtagccccctgaaagtttccccgcctcgcacacgggcccttcgccggagcttgccatatgaatggtcaaaccccgatggggctcgccgccgccgcagccgcagcagtgaggccctgccgccgccgcctcctctcgtccgcctccgtggcggcgtcaaagacgggggcgggcaccgcgacgccgctcttccccagattgccccacccgccgtatgggcggcgcctccccttcctcgtctccgcggcgtcacagaccggcccggacgccccgccaacccacaccacgggccccgtcccctccgacccccgcgccgccgtttccggcaacctccccttcttcgaccgcgtcctcttcccggactcgttcccgatcgagaccccgcccgccaaggaggacgaggacgcggcggcggcatcggcgccggcgcaggccgatgaggccgtggcgccggcgccgcccgtgagggaggagacggaggctgagagggaggcctggaggctgctgcggagggcggtcgtctgctactgcggcgagccagtggggacggtggcggcggaggaccccgagtccacggagacgctcaactacgatcaggtcttcatcagggatttcgtgccctccgcgctcgccttcctcatgcgcggcgagaccgagatcgtccgcaacttccttctccacaccctccagcttcagagctgggagaaaactgttgactgttacagccctgggcaaggattgatgccagccagcttcaagattaggaccgtaccacttgatgagaacaatgaaggatttgaggaagtcttggaccctgattttggtgaggcagctatcggccgggtagctcctgtggattctggactgtggtggattattttgctgagagcttactgcaagattacaggggactatgatttgctagaaagagttgatgtgcagacaggaattcaactgatactgagtttgtgtttgtctgatgggttcgacatgttcccaactttactagttacagatggatcatgcatgatagacaggaggatgggaatacatggacatcctcttgaaatccaagctttgttctactctgctttacgatgctcacgagaaatgcttgttgtgaatgatgggtcaaaaaacctcatccgtgctgttaacaacaggctcagtgcattgtcctttcacataagagaatattactgggttgacatgaagaagataaatgagatatacagatacaagacagaagaatactcccatgacgcaactaacaaattcaacatttacccggagcaaataccttcctggcttgttgactggattcctgagaaaggaggttaccttattgggaatctgcagccagctcacatggattttaggttcttctctcttggcaacctttgggccatagcttcttctctaactactccaagacaagctgagggaattcttagccttattgaagaaaagtgggatgatcttgtagcaaatatgcccctcaagatatgctatcctgcaatggaagatgatgagtggcgcattattactggcagtgatccaaaaaacaccccatggtcatatcataatggtggatcttggccaaccctgttgtggcagttcacattggcgtgcataaaaatggggagaccagaattggcccggagggctgttgctctggctgaggagaggctctcagacgacaagtggccggaatactacgacacccggtctgggaggttcatcgggaaacagtcacgatcttatcagacatggacaattgctggttttctgacctcaaagatgttgcttgagaacccagagctggcttctattctgacctgcgatgaggaccttgagctgctcgaaggctgtgcttgctgcctgtccaagaagagggctaggtgctcacgccgtgcggccaagtcacatgctgggtaaaactgcaaagcacatgctgttcgttctacagggatgcaccatgtatactacccgttctaggattaaccccgagatggagagactcttcacatgtacattagtataggtttatgttagatacccatccattcatttcctcagtggctactcattctttttttctgagctgccattgatgggaaataccctggctgacaccggtggtcgaaagaagagagcaaaacatatccagagtttgtgctctcatgtacacagaaaaaggaaatttgttcctgttattcgatccgcaagctgctcccttttgttgggagtgctgtcgaagccctaaccattgtatttcttgtcagtactaaaaatagtgtgctgtatcgcttggaaactc

SEQ ID NO: 28421 - protein, 619 aa, Panicum virgatum
  misc_feature: Ceres CLONE 1883376
  misc_feature (127)..(599): Pfam Name: Invertase_neut Pfam Description: Plant neutral invertase
  misc_feature: Functional homolog of the protein sequence given in SEQ ID NO 50740
  misc_feature: Useful for making plants with altered carbohydrate content
  misc_feature: Functional homolog of the protein sequence given in SEQ ID NO 51255
  misc_feature: Useful for making plants with modulated oxidative stress sensitivity
MGLAAAAAAAVRPCRRRLLSSASVAASKTGAGTATPLFPRLPHPPYGRRLPFLVSAASQTGPDAPPTHTTGPVPSDPRAAVSGNLPFFDRVLFPDSFPIETPPAKEDEDAAAASAPAQADEAVAPAPPVREETEAEREAWRLLRRAVVCYCGEPVGTVAAEDPESTETLNYDQVFIRDFVPSALAFLMRGETEIVRNFLLHTLQLQSWEKTVDCYSPGQGLMPASFKIRTVPLDENNEGFEEVLDPDFGEAAIGRVAPVDSGLWWIILLRAYCKITGDYDLLERVDVQTGIQLILSLCLSDGFDMFPTLLVTDGSCMIDRRMGIHGHPLEIQALFYSALRCSREMLVVNDGSKNLIRAVNNRLSALSFHIREYYWVDMKKINEIYRYKTEEYSHDATNKFNIYPEQIPSWLVDWIPEKGGYLIGNLQPAHMDFRFFSLGNLWAIASSLTTPRQAEGILSLIEEKWDDLVANMPLKICYPAMEDDEWRIITGSDPKNTPWSYHNGGSWPTLLWQFTLACIKMGRPELARRAVALAEERLSDDKWPEYYDTRSGRFIGKQSRSYQTWTIAGFLTSKMLLENPELASILTCDEDLELLEGCACCLSKKRARCSRRAAKSHAG

SEQ ID NO: 28422 - DNA, 329 bp, Panicum virgatum
  misc_feature: Ceres CLONE 1883395
  misc_feature: Encodes the peptide sequence at SEQ ID NO. 28423
tctctcctgcgcagcgccgtccctcgcctccgccgccgaatccgaggctccgatctcgggttcaccgcagcgcaccaagcacccccgcggctcgatctgctcctcctcctcctccgcgcttcagccatgtcgggaatggcacctgagggttcccagtttgatgctaagcactatgattctaaaatgcaggagctgctgagcactggtgagactgaggagttcttcacttcctacgatgaagtgtttgagagttttgatgacatgggcctcccaaagaatcttttgagaggcatttatgcttatgggtttgagaagcccgccccccctcc

SEQ ID NO: 28423 - protein, 67 aa, Panicum virgatum
  misc_feature: Ceres CLONE 1883395
  misc_feature: Functional homolog of the protein sequence given in SEQ ID NO 51085
  misc_feature: Useful for making plants with altered alkaloid content
  misc_feature: Useful for making plants with altered lignin content
MSGMAPEGSQFDAKHYDSKMQELLSTGETEEFFTSYDEVFESFDDMGLPKNLLRGIYAYGFEKPAPP

SEQ ID NO: 28424 - DNA, 646 bp, Panicum virgatum
  misc_feature: Ceres CLONE 1883406
  misc_feature: Encodes the peptide sequence at SEQ ID NO. 28425
ctcggctccggctccggctcctgctgctcctctccctcccaccagtcggatcagatgtcacccgacgcggacgccggcggtggggccgcggctgccggcgggggagggggcggggaggctgccggcgcgtcgtcgtcccccgcgtccgcggcggcggcgcggtgggaccagatcctcccgcgccgctcgctccgcgtcctcctcgtcgagcacgacgactccacgcgccaggtcgtcaccgcgctcctccgcaagtgcggctaccgcgtggccgcggtcgccgacgggatgaaggcgtgggaggtcatgcgggggcgcgcctacgccttcgacctcgtgctcaccgaggtcgccatgccctcgctctccggcatccagctgctcgccaggatcgtcgccgccgacgagtgcaagaacatcccagtcatcatgatgtcgtcacaagattctattggtacggtgctcaagtgcatgcagaagggtgcagtggacttccttgtaaaaccagtgagaaagaatgagctgcgtaacttatggcagcatgtatggaggcggcatgcaatgaatagccaaacatatttatcggaaaataatgcagccagcaatcatataagtgccaatgttgctaatggttcaaaggcagggg

SEQ ID NO: 28425 - protein, 197 aa, Panicum virgatum
  misc_feature: Ceres CLONE 1883406
  misc_feature (46)..(162): Pfam Name: Response_reg Pfam Description: Response regulator receiver domain
  misc_feature: SWISSPROT Homolog: EC 3.1.4.17 3',5'-cyclic-nucleotide phosphodiesterase
MSPDADAGGGAAAAGGGGGGEAAGASSSPASAAAARWDQILPRRSLRVLLVEHDDSTRQVVTALLRKCGYRVAAVADGMKAWEVMRGRAYAFDLVLTEVAMPSLSGIQLLARIVAADECKNIPVIMMSSQDSIGTVLKCMQKGAVDFLVKPVRKNELRNLWQHVWRRHAMNSQTYLSENNAASNHISANVANGSKAG

SEQ ID NO: 28426 - DNA, 705 bp, Panicum virgatum
  misc_feature: Ceres CLONE 1883414
  misc_feature: Encodes the peptide sequence at SEQ ID NO. 28427
gcgctctcgtcccccgtcgagccaacgccagccaaacaacgcgaccccgcggcgccccgtcgcgcccccgcagcgccccgcccttgcctgtccgagcctccgatcgactcgcctgtcccgccggcccggatggcggagtccgcggcgcccaagccgccgccggcggcggggaggaagacgcgggtggggccgtacgagctcggcaagaccatcggggagggaagcttcgccaaggtcaagcacgcgcgcgactcccgcaccggcgccgtctgcgccatcaaggtgctcgaccgcaaccacttcctccgccacaagatggtcgagcagatcaaacgggagatttcgactatgaagctaatcaaacatcccaacgtggtccagttgcatgaggttatggctagcaaaacaaagatatacatggttcttgaatttgctgaaggaggggagctatttgataaaattgtcaattctgggaggctaggtgaagatgaagcaaggagatactttcatcaacttataaatgcggttgattactgccatagtcgaggagtttaccatagagacctgaagccagaaaatttgcttcttgattcacatgcatctcttaaagtttcagacttcggactgagtgcctttgcgccacaaacaaaagaggatgggcttctgcatactgcttgtggaacgccaaactatgttgcacctgag

SEQ ID NO: 28427 - protein, 191 aa, Panicum virgatum
  misc_feature: Ceres CLONE 1883414
  misc_feature (22)..(191): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MAESAAPKPPPAAGRKTRVGPYELGKTIGEGSFAKVKHARDSRTGAVCAIKVLDRNHFLRHKMVEQIKREISTMKLIKHPNVVQLHEVMASKTKIYMVLEFAEGGELFDKIVNSGRLGEDEARRYFHQLINAVDYCHSRGVYHRDLKPENLLLDSHASLKVSDFGLSAFAPQTKEDGLLHTACGTPNYVAP

SEQ ID NO: 28428 - DNA, 704 bp, Panicum virgatum
  misc_feature: Ceres CLONE 1883429
  misc_feature: Encodes the peptide sequence at SEQ ID NO. 28429
accacagcagagacaggagcgctcttccccctcgatccttccctttcttctagaaccttccgcggccctccgtcgcagcacagcgcttcctcctgctcatcccaccccgagatggcgaccatggagaacgtgatcgtgctcgtcaaccgcattcagcgcgcctgcaccgtcctcggcgaccacggcggcggggacggcgccgcctccctccccaccctgtgggaagcgctcccgtccgtcgctgtcgttggtggccagagttcggggaaatcatcggtgctggagagcatcgtggggcgagacttcctgccccgaggatcagggatcgtgacgcggaggccgctggtgctgcagcttcacaagacacaggatggggcgcaagagtacgccgagttcctgcacctgcccaaacgccggttcactgatttctctcttgtgcggaaggaaattgaagatgagactgacaggttgacaggaaagacaaagcagatatctcctgttccaattcacctcagcatatattctccacatgtggtcaacttgacattgattgatctgccgggtctaacaaaagttgctatagaggggcagcctgaaagcattgtccaggatatagaaaatatggtgcgctcatatgttgacaaggtatggttgatgcagacatctatagaagtaactatgactttgacatattgtgcatgatg

SEQ ID NO: 28429 - protein, 196 aa, Panicum virgatum
  misc_feature: Ceres CLONE 1883429
  misc_feature (43)..(195): Pfam Name: Dynamin_N Pfam Description: Dynamin family
  misc_feature: SWISSPROT Homolog: EC 3.6.5.5 Dynamin GTPase
MATMENVIVLVNRIQRACTVLGDHGGGDGAASLPTLWEALPSVAVVGGQSSGKSSVLESIVGRDFLPRGSGIVTRRPLVLQLHKTQDGAQEYAEFLHLPKRRFTDFSLVRKEIEDETDRLTGKTKQISPVPIHLSIYSPHVVNLTLIDLPGLTKVAIEGQPESIVQDIENMVRSYVDKVWLMQTSIEVTMTLTYCA

SEQ ID NO: 28430 - DNA, 668 bp, Panicum virgatum
  misc_feature: Ceres CLONE 1883464
  misc_feature: Encodes the peptide sequence at SEQ ID NO. 28431
agagccaaatctcccgcgccgccgccgccgccgtcgccgtcgccggaatcgaccgagtaccaacccccccttctcgccggagaatccgtcccccggagtggtcttcacctcagctacctcaaaaatgtctgcaagcacatcccacacaattgatagctctggaactgatgatgagcatgattcatctcaaccacgtgttaggagatcaaaggtatggcaattctttgagcaagatttggtgatggtagatgacgtttggaaggcagtttgcaagtattgtgggctgagacttggggctcaatcgggcactagtagtcttagaagtcatattgctacaacttgcccggctagggactttcttgctatcccactcagcactgtatcatctgaatcggtttttagttgtggcaataagattcttggggacacaagaggctcgctaacgccacagatgttggaggctttagttagtgcgaaagattggctcactatagtccaagataaagataaggataaggacgatgaaggtacccactgtttcttttaccttcaatgatcaccaaattcttatttgaaatatgcagagatgagaagttgttgttcttaaggcaagttcctctcttttttggatgcagggatcttaagtgaagttgctggggttggtgcag

SEQ ID NO: 28431 - protein, 143 aa, Panicum virgatum
  misc_feature: Ceres CLONE 1883464
  misc_feature (28)..(74): Pfam Name: zf-BED Pfam Description: BED zinc finger
MSASTSHTIDSSGTDDEHDSSQPRVRRSKVWQFFEQDLVMVDDVWKAVCKYCGLRLGAQSGTSSLRSHIATTCPARDFLAIPLSTVSSESVFSCGNKILGDTRGSLTPQMLEALVSAKDWLTIVQDKDKDKDDEGTHCFFYLQ

SEQ ID NO: 28432 - DNA, 727 bp, Panicum virgatum
  misc_feature: Ceres CLONE 1883469
  misc_feature: Encodes the peptide sequence at SEQ ID NO. 28433
gagcccacccagcaccgacgaggagggagaggtttcaaaaccagcgacgcaacggctcgactggttgcttcccccaatccctccccaatcgaatcctgtaatcctgtagtgggtgggtgggcacacgtcccgatgctcccgctcctcctcctcctggccaccgccgccttggcggcggcgcagggcctcccgccgctccccatcggcgtcaactacggcgccaacgccgacaacctcccgtccccggccgccgttgccaccttcctcgccgccaagaccaccgtcaaccgcgtcaagctcttcgacgccaacccggccttcctcgacgccttcgccgccaacgcccccggcatctccatcgccgtctccatccccaacgccgcgctcaccggcttcgccgaccgcgccgcgggcctcgacgccgcgcgcggctgggtccgcgacaacctcgccgcccacgtcgcccgcggcgccaacgtcacgctcctcctcgcgggcaacgagatcctcggccccaccgtcgtgcccgacctcgtcgtcgcgctgctccccgccatgcgccgcctcagccaggcgctccagctcgagggcctcccccaggtgcgcgtcaccacgccgcactacctcggcatcctcgcgccctccgacggcatcccctccaacgcccgcttccgcccgggcctcgacaccgaggtgctcgcccccatgctacgcttccacacgacac

SEQ ID NO: 28433 - protein, 198 aa, Panicum virgatum
  misc_feature: Ceres CLONE 1883469
  misc_feature: SWISSPROT Homolog: EC 3.2.1.39 Glucan endo-1,3-beta-D-glucosidase
  misc_feature: Functional homolog of the protein sequence given in SEQ ID NO 50538
  misc_feature: Useful for making plants with altered carbohydrate content
MLPLLLLLATAALAAAQGLPPLPIGVNYGANADNLPSPAAVATFLAAKTTVNRVKLFDANPAFLDAFAANAPGISIAVSIPNAALTGFADRAAGLDAARGWVRDNLAAHVARGANVTLLLAGNEILGPTVVPDLVVALLPAMRRLSQALQLEGLPQVRVTTPHYLGILAPSDGIPSNARFRPGLDTEVLAPMLRFHTT

SEQ ID NO: 28434 - DNA, 601 bp, Panicum virgatum
  misc_feature: Ceres CLONE 1883469-R
  misc_feature: Encodes the peptide sequence at SEQ ID NO. 28435
agaacaacatcaactacgcttgtggcttcgtggactgtaagccgatccagagcggtggcgggtgctttgaccccaacaacgtgcagtcccatgcttcgttcgtgatgaacgcatattaccaggccaatgggcgccacgactacgactgcgacttcaagggcaccggcatggtcacctccagtgaccccagctacgggggctgcaaatacgtttcctgacggggcgcagcaagtccaggcagcgcggtggcaggggcaccagcctcgagtccacatcgtcctccaggctcgagccacggcaaagctgggaggttgatactgccgggcttgcaccacatacttctgtactcttgtctgacagccatgcttcttgctatgcatacctactagtagttcttagaagagccaccattgttatcccccagcacgagggaggtgtaccccagttattgtagcttaccaatctggtttggccgtgcgttattttcttcttcttgtgtagtggtgaagaacggtgctttaactcgatcattccattccattccattctatgtagaattacaaattacaggaacagagtgaaatgaggccgcctttgtttc

SEQ ID NO: 28435 - protein, 71 aa, Panicum virgatum
  misc_feature: Ceres CLONE 1883469-R
  misc_feature (1)..(69): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50538
  misc_feature: Useful for making plants with altered carbohydrate content
  misc_feature: Functional homolog of the protein sequence given in SEQ ID NO 51282
  misc_feature: Useful for making plants with altered cell wall content and/or composition
NNINYACGFVDCKPIQSGGGCFDPNNVQSHASFVMNAYYQANGRHDYDCDFKGTGMVTSSDPSYGGCKYVS

SEQ ID NO: 28436 - DNA, 2579 bp, Panicum virgatum
  misc_feature: Ceres CLONE 1883471
  misc_feature: Encodes the peptide sequence at SEQ ID NO. 28437
atctgcgctgcgccggcggcgttcctcccctcttttctcaccccatcgccgccaccctctgaccaactcccgatccagagggagcgtcgcgcatccgcctccgcgcgataagtcccgacggccgccgacgaaaccccacgggccacggcggcgcggccagggtttcgtcgagcccacgccgtcggccgctgacgagggccgaaccccgacgatccgcgcatccggcctccacgcgacaagccccaccggctgccgacgaccccccacggcggcgcggccagggtttcctcgagcccacgccgtcggccgccgacgaggcccaaaaccgccaaaccacgacgccgccaacctcgggccgtcctttctctatccgcagctgtttgtacaccgaggttaactatcatattgaagactgaagagcctctttagcatgccaatcatcctcaaaacttaggagtggcattgaatatgtcaagataggaatcaaaccatcggttcaggagtgttaacatgttaaggacaacaaaatcctgattacacataaacggtgcagatgctagctggcaatatgaacaataacgatataattgacttgatctcggatagtgatgacgattttgaccagcagccagcttctacaataacaagatttggtcagaatggtgaagggcgtggtccaatcagttttgaggatgaggattggcagaggggtgctcctgcttcatcttcttcaaggcatactcataataataatggtcaatacaggactctaccaccatcttttacaaatggtagaccgacggagagtactcgttctaaatttggttcaggggacatggctcatccccgtccttcttatatggctgcacgacatgattctgcaagggacctttctgcttcgaacagagttgacagtgtaggggaaagacacgccagttccgctgcagatgcaaatgacaataacaagagggttcttccctcttctttttccaatggcagcacatcaaaatctatgcacgcaaatgttgctagtgtgacacgcaagctcccaccactttctaccgatagaaattcacaagatttgggtgaaaacagaatgggaacaaatatgaccaatggaaatgcgcatccttcatcttcaaggagggcaatgggaagttttaatgtgagcaatacccagagagagaatgatgatgatgatgttattgtttatggaggcccctctagctcacatagggtactgccttcatcgtttggtgtcagcaattctaataacagtgaagttaacggctttggagcacaaggtcgcctgaatccagaaaataggattttggattctgatgagagagcagtatatcaagaagccctgcagcatattagtcgggaaaaaagggaagatgatctgcctgagggagtgctaacagtacctctccttaagcatcagaaaatggcattagcttggatggtttcaaaggagaatagctcacattgtgctggtgggatccttgcagatgaccagggccttggtaaaactgtgtctacaattgcccttatacaaaaggagaggagtcaacagtctaagttcatgtctgttgattcagatcgtttgaaatctgaagcactaaatcttgatgaagatgatgaaggagaacaaactgtgaatgatgaacccaagaaggaccaaggggctatttcatcgtcgacagctgctggtgctagtagtgttgagccatgtgtcagtcaactcaataatgttccggataaaatggacaaaagcaaagctgagcgcaaaaagaaggctaaagccacgtcatccgtatccaccacgcggtccatgacaaggccagctgcaggtactctagttgtatgccctgctagcattcttaagcagtgggctaacgaattgactgacaaggttagtgaaagtgctaaattatctgttctagtctaccatggtggtttgaggaccaaagatccaagtgagctggcaaaatatgatgtggttgtgactacatatacaattgtggccaatgaagtacctaaacagatcgctgatgatgactcagatcaaaagaacagtgaagaaccttcagctggcaataaaagaaaacctccatcaagtgcaaagagcaagtctaagaaaaagaagaagagacttgactcagactttgaccttgacagtggcccaattgcgagggtacggtggtttagggttgtgcttgatgaagctcagacaataaaaaactaccgaactgtagtggccagagcctgttgtgggctaagagcaaaaaggagatggtgcttatcaggaacacctatacaaaatgcaattgatgagctgttcagctattttcgtttcttgaaatatgatccatattccacatttaactcattttgcacaatgataaagcacccaatttccagagatgcagttcatgggtataagaaacttcaagctgtgttgagggtggttctcctgcgtcgtacaaaagaaactctgattgatggagtaccaatcataaatttacctccgaagacaattaatctgaataaagtagatttctcacatgaggagcggt

SEQ ID NO: 28437 - protein, 670 aa, Panicum virgatum
  misc_feature: Ceres CLONE 1883471
  misc_feature (291)..(670): Pfam Name: SNF2_N Pfam Description: SNF2 family N-terminal domain
  misc_feature: The sequence is a functional homolog of SEQ ID NO 148 in the 10/666,642 US patent application
MNNNDIIDLISDSDDDFDQQPASTITRFGQNGEGRGPISFEDEDWQRGAPASSSSRHTHNNNGQYRTLPPSFTNGRPTESTRSKFGSGDMAHPRPSYMAARHDSARDLSASNRVDSVGERHASSAADANDNNKRVLPSSFSNGSTSKSMHANVASVTRKLPPLSTDRNSQDLGENRMGTNMTNGNAHPSSSRRAMGSFNVSNTQRENDDDDVIVYGGPSSSHRVLPSSFGVSNSNNSEVNGFGAQGRLNPENRILDSDERAVYQEALQHISREKREDDLPEGVLTVPLLKHQKMALAWMVSKENSSHCAGGILADDQGLGKTVSTIALIQKERSQQSKFMSVDSDRLKSEALNLDEDDEGEQTVNDEPKKDQGAISSSTAAGASSVEPCVSQLNNVPDKMDKSKAERKKKAKATSSVSTTRSMTRPAAGTLVVCPASILKQWANELTDKVSESAKLSVLVYHGGLRTKDPSELAKYDVVVTTYTIVANEVPKQIADDDSDQKNSEEPSAGNKRKPPSSAKSKSKKKKKRLDSDFDLDSGPIARVRWFRVVLDEAQTIKNYRTVVARACCGLRAKRRWCLSGTPIQNAIDELFSYFRFLKYDPYSTFNSFCTMIKHPISRDAVHGYKKLQAVLRVVLLRRTKETLIDGVPIINLPPKTINLNKVDFSHEER

SEQ ID NO: 28438 - DNA, 521 bp, Panicum virgatum
  misc_feature: Ceres CLONE 1883471-R
  misc_feature: Encodes the peptide sequence at SEQ ID NO. 28439
cgtattttagcgctacaggaggaaaagagagctatggtcagctctgcttttggtgaagacaaatccggtggccacacaactcggctcactgtggaagacctgcggtacctatttaggatatgatttggagggacccttcgatgcctctggtgacagacaacggcggcattctgtaccttgtaatcttaatttggcaaaagcgacgcttgggtcacctttgcgagtatcttggagctgaggcaccgtggcctgtgggtccatatccccttccccaccccctgccacagctccggttttggcctgctcagatggctagatgtgtaattttttagctagatagcccatgtaatataacccccaggcttgtaggagagttcggagagttctgctatactgtcccattctcccggtgataagtctggaggaccagctcggtgtatatattcaccttagtgttgctaactcgctgtgctgtttgacctctgagaaatcagatatgtttgctgttctgcagctacacc

SEQ ID NO: 28439 - protein, 29 aa, Panicum virgatum
  misc_feature: Ceres CLONE 1883471-R
  misc_feature: The sequence is a functional homolog of SEQ ID NO 148 in the 10/666,642 US patent application
  misc_feature: The sequence is a functional homolog of SEQ ID NO 208 in the 10/412,699 US patent application
MVSSAFGEDKSGGHTTRLTVEDLRYLFRI

SEQ ID NO: 28440 - DNA, 1727 bp, Panicum virgatum
  misc_feature: Ceres CLONE 1883474
  misc_feature: Encodes the peptide sequence at SEQ ID NO. 28441
gcttctccgcgcttcccctcgctcgcctcgtctctctgagcctcggcgccgagggggagtcgtcgccgacggcggccagggagcgcgggggcgccagcagagggggcgccagaacgcgagcgacgagctgtttcggaaccccattcaactggtatatctacaggacttttggaagatcatcattatcaaaagactacgttggaccaaacatcaagggaaaaccagcaaaatggacgttccagtaatgaagcatcaaaacataatattggaatctctgaagtccatttctcatgggatgattctagtgcagcgatgaccaatttacatccactcttaccatgtgattatggatcattggttcatacactggcaccttgctgctcagactctgaaactgtgttctcatctaattggaaacagaataatcctcagtcaaaagaaatgtatcacagtggtgaagcaacagatgacaactctgagtttcttcagctaatttttagtgacacttacgaagggaacagttcaagtgaactgcaaatttgggatgttttggacctgtatttccctgaaagcattgctgctgttcaattcaatactctgatgggttttggaaatgatgattgtactccttataatgagtgtgtggatgctgctgatatggtagagatgagcatttctcccccatctccagacagggacgcagatgatgctaattgcagggttccagttgattacactagcttttatcttcaaaataaaccaccagattcagataatgagtgcagctctgcctcttgcatcgtgacaggatatgaatgtactgataatcaagagctacctataggtcttctgaatttaatggacattggatcaccaggcgattcagatgacttatccagaccattattgaccacaaaaaacatcatgcttgtgctggatctggatgaaacccttgtccattcaaagttacaaccctgtgataattttgacttcacccttcaagttttctttaatatggaagatcatactatatatgtgaggcggagacctcacctcgagatgttccttcaccgtgttgctcagatgtttgaggttgtcattttcacagctagtgaaagtgtttatgctgaacctctattagataaactcgacccagaccggaaactgatttcacgccgtttttaccgtgaatcttgtaccttttccaatggtagctacacgaaggacctaacaattttcggagttgacttggcaaaagttgtgatagttgacaatactccacaggtcttccaactgcaggtcaacaatgggatacccataaagagctggtttgatgacccggcagatgttgagttgatggaactgcttcaattccttgcgaccctcgtcgacgcaaaggatgttcgaccaatcatctcgaagaacttcaacaacaaacctgaactggtaggatcagatcagataaagtaaaagtttgctccctgttcgtttgagaacctccatttctgcatccaggtcattctggggttcaggcaattcttgagtaattaggtatagaatctacacacagcgttcatgaatcatgatatgttgttagtagttacagataggatgggaaaagccatagtcactgccatggcattgcatggttccttagtttcatgtattgcagagctacagaaactaaattacgagacattaccttgtgaatcaaattttgattgctc

SEQ ID NO: 28441 - protein, 385 aa, Panicum virgatum
  misc_feature: Ceres CLONE 1883474
  misc_feature (195)..(370): Pfam Name: NIF Pfam Description: NLI interacting factor-like phosphatase
  misc_feature: SWISSPROT Homolog: EC 3.1.3.16 Phosphoprotein phosphatase
MTNLHPLLPCDYGSLVHTLAPCCSDSETVFSSNWKQNNPQSKEMYHSGEATDDNSEFLQLIFSDTYEGNSSSELQIWDVLDLYFPESIAAVQFNTLMGFGNDDCTPYNECVDAADMVEMSISPPSPDRDADDANCRVPVDYTSFYLQNKPPDSDNECSSASCIVTGYECTDNQELPIGLLNLMDIGSPGDSDDLSRPLLTTKNIMLVLDLDETLVHSKLQPCDNFDFTLQVFFNMEDHTIYVRRRPHLEMFLHRVAQMFEVVIFTASESVYAEPLLDKLDPDRKLISRRFYRESCTFSNGSYTKDLTIFGVDLAKVVIVDNTPQVFQLQVNNGIPIKSWFDDPADVELMELLQFLATLVDAKDVRPIISKNFNNKPELVGSDQIK

SEQ ID NO: 28442 - DNA, 703 bp, Panicum virgatum
  misc_feature: Ceres CLONE 1883477
  misc_feature: Encodes the peptide sequence at SEQ ID NO. 28443
attctcccctctctaaagctttgcctcggcccccctcgcgcttcccgagctctcgtcgtcgagagaggcggagggaggggctcgaggacccagcgggcggcggcaaatgacggcggtggcggcggcggggttcaaggcggcgaggcgggtggggctcgcggcggcgctgctgctgctcgtcctcgtcgtggtcgtcgccagcggacccggcggccgggcgctccacgggctccggcaccggagcgcggcggcgacaaccgcggtggcgggcggcgcgaggcggtggctgcgggactcgtcatggccggcggcggcgacgccgagggccgacggtgacgacgacgggccagcgatggccgttcgcggcgcggtggaggacccggaagcggtggtcgacgacgtgcacatgtccatcaggaacagcacggcccggcggaatctcgggtacctgtcgtgtgggacgggcaaccccatcgacgactgctggcgctgcgacccggactggcacaagaaccgccagcgcctggctgactgcggcatcggcttcggccgcaacgccatcggtggccgcgacggcaagatctacgtcgtcactgacccgagcaacgacgacgccgtcaacccgcgcaagggcaccctccgctacgccgtgatccaggacgagccgctctggatcatcttcaagcgggatatggtgatcacc

SEQ ID NO: 28443 - protein, 198 aa, Panicum virgatum
  misc_feature: Ceres CLONE 1883477
  misc_feature: SWISSPROT Homolog: EC 4.2.2.2 Pectate lyase
MTAVAAAGFKAARRVGLAAALLLLVLVVVVASGPGGRALHGLRHRSAAATTAVAGGARRWLRDSSWPAAATPRADGDDDGPAMAVRGAVEDPEAVVDDVHMSIRNSTARRNLGYLSCGTGNPIDDCWRCDPDWHKNRQRLADCGIGFGRNAIGGRDGKIYVVTDPSNDDAVNPRKGTLRYAVIQDEPLWIIFKRDMVI

SEQ ID NO: 28444 - DNA, 664 bp, Panicum virgatum
  misc_feature: Ceres CLONE 1883490
  misc_feature: Encodes the peptide sequence at SEQ ID NO. 28445
cataaagttgcaagaaacaccagatgagataccagaaggtggcaccccacatacagttagtgtcctgatgcatgataagcttgtcgatgctggaaagcctggagatagggttgagatcactggaatatacagggcaatgagtattagagttggacccgctcagaggacagtgaagtctatattcaagacgtatattgattgccttcacataaagaagacagacaagtctaggcttcatgtggaggacactaacaccatggatattgacaatgctgatgcaaacaagtctactgaagaggacttccttagtgataaggttgagaaactaaaagagctttcaaagttgcctgatatctatgatagattgactaggtcattggctccgaacatatgggagttggatgatgttaaaaaaggcctcctttgccagctttttggtggcaatcccttaaggcttccttctggggctagcttccgtggtgacataaatattttacttgtgggtgatcctggaacaagtaaatcccagcttctccaatacatgcataaactgtctcctcggggaatctatacaagtggtagaggaagttctgctgttggtcttactgcttatgttacgaaagatcctgagactggtgatactgttcttgagagtggagcacta

SEQ ID NO: 28445 - protein, 220 aa, Panicum virgatum
  misc_feature: Ceres CLONE 1883490
  misc_feature (105)..(220): Pfam Name: MCM Pfam Description: MCM2/3/5 family
  misc_feature: The sequence is a functional homolog of SEQ ID NO 8 in US patent 7189893
IKLQETPDEIPEGGTPHTVSVLMHDKLVDAGKPGDRVEITGIYRAMSIRVGPAQRTVKSIFKTYIDCLHIKKTDKSRLHVEDTNTMDIDNADANKSTEEDFLSDKVEKLKELSKLPDIYDRLTRSLAPNIWELDDVKKGLLCQLFGGNPLRLPSGASFRGDINILLVGDPGTSKSQLLQYMHKLSPRGIYTSGRGSSAVGLTAYVTKDPETGDTVLESGA

SEQ ID NO: 28446 - DNA, 1713 bp, Panicum virgatum
  misc_feature: Ceres CLONE 1883505
  misc_feature: Encodes the peptide sequence at SEQ ID NO. 28447
gacaagcgcagagcagagaccaccactccagcctcgtgcagtctgccgagagcaaggcggcgggggttttcctagtagctgcagtcgattgcttggcatctttatcagctcgcgatctccctgctaggctgctccctcctatagttatctccagatattgcagcgaaggtggaagcagcacttgagagagagagagagagagagagagagagagagagagttcttggacgaatccatccagggagtggggagcggtcgagggagaagagaagaggaacagaggggatggagacggacagcccgcggagccccgaggcggagatcgggcaccgggtggaggacctctgggaggtggcggagccgcagctctcgccgtccgagaagctcaactcctgcttcgaggacatccccgtcgcgtccttcccccgcacgcacccctcgcaagtaattgagataccctctgatgccagtcttgctgaaactgttgaaatattgtccaaaaacaaaatcctgagtgcacccataagaaacgttgaggctccagaagatgctagttggatggacaaatacatcggtattgtggaatttgctggtattgccatgtggctgctcagtcagtctgatgctgcagctaatgggacggctggttctggaataggatcacctgtctccaatctagtttctaggttgggttccttcacattcagaaggacatcatccggcagggtagaaactgctactgattctgaatcagatgaagctgcatcggttggaggaagttttttcgaaaccctaacttcctctgagttctacaagaatacaaaggttggcgatatctcagggagcttccggtgggcaccatttcttgcactgcagacgtctgacacattccttaccatgttgctgcttctgtctaagtacagaatgaagagcctgccagtagtagaagttggaggagataagattgagaacatcatcacacaatcttctgttatgcacatgcttgcagagtgtgttgggctcccatggtttgagagctggggaactaagaaactttctgagcttgggcttcctatcatgaaaccatccaaacttgtcaaggtaaatgaagatcagccggttctaaaagccttccaactgatgagggaaaaaggagttggtggtctaccagtcatggacacgagtggagcaaaagcaattggtaacatcagtatcagagatgttcaatatcttctaactgcccccaagatatacaaagagcacaggacaatcacaacaaaggattttctcactgcggtgcgacagcatctccaggagcaacatgagacctcaccctttctgcacgatgtgatcacttgcaaaaaggacgatacgatcaaggacattatactgaagctggactctgagaagattcacaggatctacgttgtagatgacaaagggaacactgagggggtcatcacattgagggacataatctccaagctggtgcacgagcctcgccactactttggggatttcttcgatggtgttgttcccctgcctgcaaatagcactgtatgagacaaaatcggggtccaatcgcactgatgtacctgtgcaaatgtatattatgaaccgttctcttcggaggttccttgctgtgtatttcttttcccaacctcctcatgtgaacagagtatgaagaagaaagtaaaaaagaccggattcgct

SEQ ID NO: 28447 - protein, 425 aa, Panicum virgatum; identical to SEQ ID NO: 21009
  misc_feature: Ceres CLONE 1883505
  misc_feature (264)..(402): Pfam Name: CBS Pfam Description: CBS domain pair
  misc_feature (48)..(241): Pfam Name: CBS Pfam Description: CBS domain pair

SEQ ID NO: 28448 - DNA, 2657 bp, Panicum virgatum
  misc_feature: Ceres CLONE 1883509
  misc_feature: Encodes the peptide sequence at SEQ ID NO. 28449
atccggaagcccactctgctttctctgctctgctcggctcggctcccccacccgccgccgcgccatggccgccatggcgccctcctcctccgccccctcgctccccgctcacctccccagcagagctcacgcccgcctgcccggccgcaaggccccgcccgcctccgccccgcgcccgctcctcctctcgttccccgcgcccgcgcgccgccgccgcgccgccgggctccgcgctccagccgcacagcaacgctccgccgagtaccattttgctgaagattatggtgaggaggaggaggaggaggagtacgggtatgacggcgaggaggaggatgaagacgaggtggaggagatggacgtggaggccatggaggaggaggcgcgcggcgccgccgccgacctcgccaagcgcctcgcccgggagctccacatcgatgatgatgtacgggagaaacgaaaaaacatcagggaatccgtgtctaaacatatcccagatagtcttcttccaaaggtggcaattattgggaggccgaatgtcggtaaatctgcactgttcaaccgtcttgttgggggaaacagggctattgttgttgatgaacctggtgtgacaagagatcgcttatatggacgatcatattggggtgatcaggagtttatggttatcgatactggtggggtaattactttatcaaagtctcaagcaggtgtgatggaagaacttgctgtcaccactactgttggtatggatgggattcctctcgccactagagaagctgctattgcgaggatgccatcaatgattgaaaaacaagcagttgcagctgttgatgaagcagccgtcgtactattcgtcgtggatggtcaggctggtcttgtggcagccgatatagagatttctgattggttacgacgcaactactctgacaagtgtgttatacttgctgtcaataagtgtgaatctccacggaaagggcaaatgcaagcattagacttttggtcactagggttttctcctctgccaatttctgctattactgggacaggaaccggagatctccttgatctggtgtgtggagagctgagaaaatttgagggattggacggagttgaagaagagaaaaataaggttcctgctattgccattgtgggaagaccaaatgtggggaaaagtagtattctaaatgctttggttggagaagatagaactatcgtgagcccagttagtgggactacacgtgatgctatcgatactgagtttactacagcagatggagagaagtacaaactcattgacactgctgggatccgacgctgggcagcagttgtttctgctggcagcacaacggaatcactttcggtgaaacgtgcatttcgagcaattcgccgctctgatgtggttgcccttgttattgaagcgatggcctgtgttacagagcaggattataaaattgcagagaggattgagaaagaaggaaaggcttgtgtcattgttgtgaataaatgggatacaatcccaaacaagaaccatgagagtacgacacattatgagcaagatgtaagagaaaaacttcgcatacttgattgggcacctattgtctactgttctgcgacaaatggaaccagtgttgaaaagataatttctgctgctgctttggttgagaaggaaaggtcgagaagactcggtacctctattcttaatcaagttgtcagagaagctatagcattcaaaccaccaccacggacaagaggtggcaaaagaggtcgtgtatattacacaacacaggctgccgtgggtccaccgacatttgttttatttgtgaatgatgcgaagctcttttccgatacataccgccgttacatggaaaagaaactccggtcggatgctggatttccaggcacccctattcggttactgtggcgcagcagaaggcggccggacaaacgaggtaaatctgcagatagtaagttgcagagcccaggagcccctagcagaatggttgtggcggcctgatcgagccaccttcgtttgtagactctgttcggatttgactatatagccttggctgatgcgaaacacgcgggggtggagtttgagattcagaaatgaacttttgggacgtcgaaccgtcagagtgggaggagatgcgggggcaacatagtacggaagtgacagccgcggatgatgaggaagacagtattacacggagggaaggagactagaaagatgagaggaatccagggccagattgttgcttacaaactaactaatcgcctgtagtagtgtggtggtggtggatacgagaatggtgtgtggacacatctcatgcagcacaaggtcaccggctcaccgccgaggatcccaaatattgaaacggatgatggtgtgtcatggcaggtcgcagaacggcttcgcgtttgtttaggagcttgggatgcaagctactgtgttgtgagggacaggttcgttgcagcacgaagctgcgtgttgtcggtctacctctgtgtttgctgaagggttggtctccttagtttgtgtgtgtataaccagccgggagctaaggccctgtttatttacttttcttacagtatctatcacatcgaattttcgaacacatacatgaagcattaaatatattttaaaaaataactaattacac

SEQ ID NO: 28449 - protein, 648 aa, Panicum virgatum
  misc_feature: Ceres CLONE 1883509
  misc_feature (148)..(298): Pfam Name: MMR_HSR1 Pfam Description: GTPase of unknown function
  misc_feature (356)..(481): Pfam Name: MMR_HSR1 Pfam Description: GTPase of unknown function
  misc_feature: SWISSPROT Homolog: EC 2.7.4.8 Guanylate kinase
MAAMAPSSSAPSLPAHLPSRAHARLPGRKAPPASAPRPLLLSFPAPARRRRAAGLRAPAAQQRSAEYHFAEDYGEEEEEEEYGYDGEEEDEDEVEEMDVEAMEEEARGAAADLAKRLARELHIDDDVREKRKNIRESVSKHIPDSLLPKVAIIGRPNVGKSALFNRLVGGNRAIVVDEPGVTRDRLYGRSYWGDQEFMVIDTGGVITLSKSQAGVMEELAVTTTVGMDGIPLATREAAIARMPSMIEKQAVAAVDEAAVVLFVVDGQAGLVAADIEISDWLRRNYSDKCVILAVNKCESPRKGQMQALDFWSLGFSPLPISAITGTGTGDLLDLVCGELRKFEGLDGVEEEKNKVPAIAIVGRPNVGKSSILNALVGEDRTIVSPVSGTTRDAIDTEFTTADGEKYKLIDTAGIRRWAAVVSAGSTTESLSVKRAFRAIRRSDVVALVIEAMACVTEQDYKIAERIEKEGKACVIVVNKWDTIPNKNHESTTHYEQDVREKLRILDWAPIVYCSATNGTSVEKIISAAALVEKERSRRLGTSILNQVVREAIAFKPPPRTRGGKRGRVYYTTQAAVGPPTFVLFVNDAKLFSDTYRRYMEKKLRSDAGFPGTPIRLLWRSRRRPDKRGKSADSKLQSPGAPSRMVVAA

SEQ ID NO: 28450 - DNA, 717 bp, Panicum virgatum
  misc_feature: Ceres CLONE 1883533
  misc_feature: Encodes the peptide sequence at SEQ ID NO. 28451
aaatccagaagcagattgaataaaaaaaatccagaagcagattgaataaaaaaaatccagaagcagaagccgataagaactttcagtcttgtggagagagaacaagagaggaatttgaaaagcaggcgttcgaaatcagggagacttcagctggagccggaatggcgacgcccaagctgtccccggtctcgccggtgcggcgggacgacacgccgcgcgcgcagccgccgtcgtcaccggctgtcctgagggtgcaggacgcgtccgcagcggaggcgtacgagcagtacctgcgcctgccagagctgtcggcgctgcgggagcccgggcgcttcccggggtgggcgggcgaggccctcgtcacgccggcgctgcaggcgctcgaggtcaccttccgcctcgcgtccctcgcgctctcggacccgcgcgggtacgccagccgccgcgagctcgcgctccggctcgagtgcctcgcctcgcgggaggtcgagctggcggccgcgctctgcgagggcgaccggggcgcgccgctcgccgagctgtccgcctccgggggcgtgctcccgcgggagcgcagcgcgtcggaggtctggcagctgcccgggagcgccgccgccgtggtgtgccagcccagcgaggccagcctgctcccgcgcctcgcggtctgggacaagtccgagacgctcgccgccaggatcatgtacgtcatcgagggcc

SEQ ID NO: 28451 - protein, 185 aa, Panicum virgatum
  misc_feature: Ceres CLONE 1883533
  misc_feature (1)..(184): Pfam Name: Hs1pro-1_N Pfam Description: Hs1pro-1 N-terminus
MATPKLSPVSPVRRDDTPRAQPPSSPAVLRVQDASAAEAYEQYLRLPELSALREPGRFPGWAGEALVTPALQALEVTFRLASLALSDPRGYASRRELALRLECLASREVELAAALCEGDRGAPLAELSASGGVLPRERSASEVWQLPGSAAAVVCQPSEASLLPRLAVWDKSETLAARIMYVIEG

SEQ ID NO: 28452 - DNA, 2141 bp, Panicum virgatum
  misc_feature: Ceres CLONE 1883548
  misc_feature: Encodes the peptide sequence at SEQ ID NO. 28453
gcccttcagcaagtcagtcaggaatcccgattgcttccgagtgagagccccacgaggcgacaccccctcgatctgcgcgaccccggcggcgacgagccctctccggcggccgccacgcctgcggctcgccggcgatgatggccggccgcgcccacggccaccggaaccggctccgccgcctcatcccgcgggtccttctcatcgtcttcttcgccgtctacgccgtctccttcgcgatctacctcctccgccagccccaccgcccgtcgccgcccgaccccacccttcgaaccgacgtccgcgacggcttccgggcgccgccgtcctcccagaagccctggccgcgcctcccctccttccttccctgggtcggcggcccctcgccgccgccgccgcctcacacctgcgaggcatacttcggcaacggcttctcccgccgcgtggaggtcctccccgcgcgcggtgggggcggcgggtggttccggtgccaccacagcgagacgctggggagctcgatctgcgagggcgcgcgggtgcggctcgacccggcgctcatcgcgatgtcgcgcggcggggagcccctcgagcaggtgatgggccgtgccgaggaggaggagctgcccaagtacgagcccggcgcgctgctggtggaggggccatcggcggggaggacggcgcccttggtggacacagggttcctcaacaactatgtgcccaccggcgggatcgggatgcacacgatgagggcgctcctcgagtcggcgcgcgttgtgccgcccggtgagctacactgctcccaggtactctttgccttgctagctagttggttcggtggttgatgagaaacggattgttaaaaaaattgtttaccatcaattgaaatccaattagactgggaagagtagagtcagctcagtgtttgttttaggagaatttaatggaagtctgttggatccagggctcatgccagtattgagctacattattttttaaaaaaatagagcaaatggaagacctgtcattaagccttttcagccttgctccagagcaaataattgcccacttctgctcacttacaatactttctttttcctgaaacaactgtaagtcaactatgaggagccctgtggggaatggggtgtagaacaaaccagcaaggtaggattatgaatcatattcagaattaaagtccgaagttatattgattcttgtttgtgtcttaacaagattaagaatagaaatagcacctaaataaataagtcttcgtctaatgcatatccaaaatagaaacctaaatgtcaagaatcatattctaagtgtatcgctgaacaaaaatgagtgtccttggtgataccttttgagatacattagtgtagccttgtaggctcttattaaattagagatttttcatagaggagtgtgtgtgactcctgcagaagatctttagcttcatttctgtattgatcatcgtatagcatgatttaatattgagtcaatgtttacatttcttctcattcctttatctttggaattttagtagttccttcttaactgtgttatggcacttgctattgcagtgggttgaagaaccaacgcttctggtcactcgttttgaatatgcaaaccttttccacacaattacagactggtacagtgcatatgttagttccagagtcacaaatttaccaaaccgtcctaatgttgtttttgtggatgggcattgcaaggcacaattggagcaaacgtgggaagcacttttttcaagtgtgacatatgctaagaacttctctggtcctgtttgtttccggcacgccattctttcaccattgggctatgagactgccatgtttaaggggcttagtgagagcttcagttgtgagggtgcctccgctcagtcccaacaaggaaaaccagattatgataaaacagcaagattatcggaatttggtgagatgattgtagcttcttttggtcttccacaagatgacatcatgtcgtacaaaaaatcaaatgggctcaatgttctctttgttcggagagaagactacttggcccacccacgccacagtggtaaggttgaatccagactaagcaatgagcgggaggtgtatgatgcaattgacaagtgggcaaaaggtctg

SEQ ID NO: 28453 - protein, 234 aa, Panicum virgatum
  misc_feature: Ceres CLONE 1883548
  misc_feature: SWISSPROT Homolog: EC 2.4.2.38 Glycoprotein 2-beta-D-xylosyltransferase
MMAGRAHGHRNRLRRLIPRVLLIVFFAVYAVSFAIYLLRQPHRPSPPDPTLRTDVRDGFRAPPSSQKPWPRLPSFLPWVGGPSPPPPPHTCEAYFGNGFSRRVEVLPARGGGGGWFRCHHSETLGSSICEGARVRLDPALIAMSRGGEPLEQVMGRAEEEELPKYEPGALLVEGPSAGRTAPLVDTGFLNNYVPTGGIGMHTMRALLESARVVPPGELHCSQVLFALLASWFGG

SEQ ID NO: 28454 - DNA, 631 bp, Panicum virgatum
  misc_feature: Ceres CLONE 1883552
  misc_feature: Encodes the peptide sequence at SEQ ID NO. 28455
gaaagcgaccaaatctcgcagcaacgaattcccatttcgcccacctccaccccactttcccttccgcccccttcctcggcgcgatccaaatccggccatggacggcggggcgcagccgccggacacggagatgacggacgccggcgcgtgcggcggcgggcagccgccgcagcagccggcgggcgggggaggcgggatgatggataacatccaggcgacgctgagccacggcgggcgcttcatccagtacaacatcttcggcaacgtgttcgaggtcaccgccaagtacaagccccccatcctccccatcggcaagggcgcctacggcatcgtctgctcggcgctcaactccgagacgggggagcaggtggccatcaagaagatcgccaacgccttcgacaacaagatcgacgccaagcgcacgctccgcgagatcaagctgctccgccacatggaccacgagaatgtcggttgcccgagccaccctcgatccgtccagctctcctcccgaacgatcccagaatttcttcttttactttattctccgcgggaagcacataataggagattcttgtttaatgcttgtttgctggtcgcattaaagttgggggatgttggggttagttacttt

SEQ ID NO: 28455 - protein, 177 aa, Panicum virgatum
  misc_feature: Ceres CLONE 1883552
  misc_feature: SWISSPROT Homolog: EC 2.7.11.24 Mitogen-activated protein kinase
MDGGAQPPDTEMTDAGACGGGQPPQQPAGGGGGMMDNIQATLSHGGRFIQYNIFGNVFEVTAKYKPPILPIGKGAYGIVCSALNSETGEQVAIKKIANAFDNKIDAKRTLREIKLLRHMDHENVGCPSHPRSVQLSSRTIPEFLLLLYSPREAHNRRFLFNACLLVALKLGDVGVSY

SEQ ID NO: 28456 - DNA, 1979 bp, Panicum virgatum
  misc_feature: Ceres CLONE 1883554
  misc_feature: Encodes the peptide sequence at SEQ ID NO. 28457
cttgacggcctctccggagcattcgctccactgcgccggtctcgtgtcgtctcctctctacccctccgatcccaccagcgagtcctgggttcccgcatggacgccggcggaggggcggaggccgccgccaacggcgggatcgagggctccgccgacccctgcagctcagccgccgccggcgggcacaggctctctgtccaccaaatcgccggcggcgggaaaggtccgctgttcctcccccaactccccgtgcccccagggttgcgctaagttccgcgtcctgttgctgcggccgcgcgatttgcttgcgtcgaattggatatcgatttgggtacagcctcgccgttctggattagatcaagcgtcgtgtctgtgctgaacggcggtgggtttacacctgcaaatttaagaaatggtgtctcgtcagttattaggtttctatctgcagggtagcacagcacagccaagcatgcgcgaccattataggggttgtgtgctgtggttcggaagctatattactgtgttgggatgtgggcttgcaatcaaggagtaacaagctgttttaattggaattctagttgttatgaactcaatcaggcttcaaatactcgtcgcactgaattggacctgatgcttggttgctgaaattgggaagccattctgatgaaagattagtaatgtaggagcacgcagcatattgagtttcgggtcctattaggttgtgaagtacactgtggttgtacttcttctcagatgccaggcaatttctatcatcatctcctatacttagttgataatcttaagtgatgtgatatttaatattttcttctgcactgacattcgcccttgccagtcaggctgtctctatagatatttctagattggccaaccattctttctcatagaaatggtgaaaacctttaaagaactgaagaaaacactaggttattcagggttctagagatctttacatttgaatagaaggaatgctagtgtcacaaattagagtgagcaatgatttctgaagaactgtaaaatgtatgtcaatgatgacgacataagtgtgcaaagatgttgatacaaatgtacatggtttcactttatttctgttgttgaatatttaaatgctatatatgctacttctatgtcctaataaagtgcatcaggtcatccatttgtctcattcatgctaatgttaattcctacttttcagctgctgatttcatcttatggaggcgagggcgtgttacatttggtgttatatttggtgctactatggcatggttgttgtttgagaagtctggactgtcattcttgaccatctgctgtgatatatttctcatcttaatacttgtgcagttcctaagggttaaaatagctggattgctaaatagcctaggccactacctgagttagttctatcagaggagatggttagcaacgctgcagcttcattccgtgtcaaagtcaataacatgctaatgatagcgcatgatattactcttggcaaggacttccggctctttttccaggttgtgcttgtcctttggctattatctgtaattggcaatttctgctcttctattactcttgcttacataggaaccattgctttggtcacaatacctgcattgtacaacaaataccaggggcacgttgataggtatgcaggaatggtccaccggaacatatcaaggcattacaagatagttgacgaaaatgtgatcagtagactaccgagaagctttatcagagataaacaagactgatacttggtgaagctagtcaagcaattttgtaccataagcagggagaaagtgaagatttaggacaataggaaaagaaagcctcccgtagataccgttgcaatgtactcttgagcaataaggtttgtgacgaaaaggcatgcagaaatttgtaactcgctgtacagctttcggtgagcttttttgcaacaaactgggtaaaaggttgccatg

SEQ ID NO: 28457 - protein, 112 aa, Panicum virgatum
  misc_feature: Ceres CLONE 1883554
  misc_feature (1)..(110): Pfam Name: Reticulon Pfam Description: Reticulon
MVSNAAASFRVKVNNMLMIAHDITLGKDFRLFFQVVLVLWLLSVIGNFCSSITLAYIGTIALVTIPALYNKYQGHVDRYAGMVHRNISRHYKIVDENVISRLPRSFIRDKQD

SEQ ID NO: 28458 - DNA, 1403 bp, Panicum virgatum
  misc_feature: Ceres CLONE 1883573
  misc_feature: Encodes the peptide sequence at SEQ ID NO. 28459
aagccagccagccaacctacccgccccggacagcaaagcacaggcgcacgagcccccccagctccacgccgcctcctcctccctccccctctcccgccatcctcctccgccgcgcgccttcccgcccgccgagcctttaggagggggtttccggagtcgcggacgcgcgtgcgagaccccttcccctgccgccgagcgcaaatctgccgagctcggcatggggtgaccagatcggggcgcggctcggggctctacggctgaattccgctcggtgaggggggagctggtctcggagaggccggggggatggcgaacgccggcgcggccgtcggtccagggggtgctagcgatgctttgttcagggaactctggcatgcttgtgctgggccgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaagtggtaaatgtagaactcagagctgaaactgattccgatgaagtttatgctcaaattatgctgcaaccagaagcagatcaaaatgagcccactggcccagatcctgagccaccagagccagaaaggtgcaatgtccattccttctgcaagactttgactgcttcagacacgagcacccatggtggtttctctgtcctcaggagacatgctgaagaatgtttgccccaattggatatgactcagaatccaccatggcaagaactggtggctaaagatctccatggaaatgaatggcatttccgtcacatctttcgaggtcaaccaaggaggcatctacttacaacaggctggagtgtttttgttagctcaaaaagattggttgctggtgatgcatttatctttttgagaggtgataatggagagctacgagtcggggtaagaaggctcatgaggcaactaaataacatgccatcatcagttatctcaagccatagcatgcatcttggagtcctcgcaactgcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtgatgaatctcctgaaagaagatttagtgggacaattattggtctgggaagcatgccagctaactcaacatctccgtgggctgactctgattggagatctttgaaggtccaatgggatgagccttctgctgttgtccgtccagatagagtttcaccatgggaactagaaccccttgatgcaactaacacacaacccgcctcagc

SEQ ID NO: 28459 - protein, 365 aa, Panicum virgatum
  misc_feature: Ceres CLONE 1883573
  misc_feature (248)..(333): Pfam Name: Auxin_resp Pfam Description: Auxin response factor
  misc_feature (121)..(226): Pfam Name: B3 Pfam Description: B3 DNA binding domain
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 100 in the 10/666,642 US patent application
  misc_feature: The sequence is a functional homolog of SEQ ID NO 576 in the 10/666,642 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
MANAGAAVGPGGASDALFRELWHACAGPLVTVPRQGELVYYFPQGHMEQLEASTDQQLDQHLPLFNLPSKILCKVVNVELRAETDSDEVYAQIMLQPEADQNEPTGPDPEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGDNGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWADSDWRSLKVQWDEPSAVVRPDRVSPWELEPLDATNTQPAS

SEQ ID NO: 28460 - DNA, 638 bp, Panicum virgatum
  misc_feature: Ceres CLONE 1883573-R
gaacccagacaagttgtcaccggaatctgacatgccgcagagtgactcaaacaacagcgctctggttgctgccgataaggactgatggatgctaacttggcgctctacctttaattcccgttttggatgtttgggaggcaatgcccatgctccttgagactgctgagagttatctgtttgttgcgctgtgggcccgaaggacgttgccccacaatctgcctgactgccttggtttggaatggctgatgtaggaccagtggtggtcctctgccagcaaggtcgactggaatgtaatggcaagcaggccgcattgcgcgccgttccctgtgccaccaacctgtgttttgtttgccgtgtttggtaggaggcatggcgtatcgccggctgcttggttttggagactgccactgactgctgccatctcgcccgcctcacctccagagtaaataggactttatgtacaactattttggtagtagcagtagcggtttatgtatatcagcgtcatgttccttgctacctatataagcatcatcatctgtagctgctgttcccacctgcattgtattctacccccggcttggtaccggatgctctggtgcaaaaatgtctctgcttgctgttccagcggcatgctc

SEQ ID NO: 28461 - DNA, 2582 bp, Panicum virgatum
  misc_feature: Ceres CLONE 1883604
  misc_feature: Encodes the peptide sequence at SEQ ID NO. 28462
gtccgtcacgctgctcctcccggtccctgctcgtccgtccgccgcggggagctcagcgctcatccccaccagctctctccgctccgctcggccgggcgcgggtgccaacgggaagccggccttaaaaaaaaccaaccagcttgccaaagcttatcgcatctccatccctgatccctccggctgctgggttgctcctcttgctacttaaacaaacagatcggtggcctcccggagcgcagctcttgcgatcctcaagggccagcccacagcacgcgaccccaagctagccaggaatcgcttcccacccagacccagcgtccggccaggccaccaccgctctgctctctccctgtcggcaaatccgccctccctccctcccgcccgctcgcaagctcgcaatccccctccctccaaagggatcgattcgccaaatcagttgcgcttcttgctgagcagccggtgagagcaaatgctggtccgggagggagcggcggtcgtcgtcggcgggcacgcgggaggattcccctgtcccctggcggtctgccgaggtagtgggcgtccgagctggagcacctgagatgttgctcgctcgcctggcctgatctcggccgaaagctcccgggttttttgttctcggagagggaggggggcggcgccgcttttggtctctctgattattgcttcctccaccgattcgattcctcgcgggggctcctctcctccaccggtgggtgggtggatcttttacctccgtgtccgggcattcgtgctccgctccttgggcctgtaagttgtctgccgaatcccaaatcttcagaggttctggtggtgatttctgcaaggggggcgagtgagcagtgggagatcaaatcttggcgatggtgtcgagatcctactccaacctcctggagctcgcctccgggggcgggggcggcggcggcggggagccgctgccgtcgctggggcgccgccgggtgccgcgcgtcgtaacggcgcccggcattgtgccgggcctcgacgcctccgacgacgacgacgacgccgcgtccgcggcctccgaccactcctcccacgcgccgcgggagcgcgtcatcatcgtcgccaaccagctccccgtgcgcgccgcgctgcgcccgggcgccggcgccggcggcggcgccgggtgggacttcgagtgggacgaggacagcctcctgctgcaggtcagggacagcctccgcgcgcaccacggccgcggggacgtcgacttcgtctacgtcggcggcctccgcgacgacgtgccccccgccgaccacgaccacgtcgcgcacctcctcctcgagggcttccgctgcgtgccaaccttcctgcccgccgacctccgctccaggttctaccacggcttctgcaagcagcagctctggccactgttccattacatgctgccgctgtcgccggagctcggcggccgcttcgaccgcctgctctggcaggcctacgtctccgtcaacaagatcttcgccgacaagatcctcgaggtcatcagccccgacgaggacttcgtgtgggtgcacgattaccacctcatggtgctgcccacattcctgcgcaagcgcttcaaccgggtcaagctcggcttcttcctgcacagccccttcccctcgtcggagatctacaagactctgcccgtgcgtgaggagctgctccggtcgctgctcaacgccgatctcattgggttccacacctttgattacgccaggcacttcttgtcgtgctgcagcaggatgctcgggctcaagtacgagtcgcagaggggctacattgcactcgagtactatggacgaactgtcacaatcaagatcttgccagtgggggttcacttggagcagttacagtcggttcttaatctcccagagactggagtcaaggtggctgagcttctgaagcagttcaatcatcggagccggctgctgttgcttggtgttgacgatatggatatcttcaagggaattagcttgaagcttttggcgtttgagcagctgctgatacagcatccagagtggcggggaagggtggtactggttcagattgccaatccagcgagggggaagggaaaggatgtgaaagaagtacaggaagagagcgatgcaatggtaaagcgcatcaatgatgcatttgggcagccggattaccagcctgttatactgatcgataagccactgcaattctatgagaggatggcatactatgttgttgccgagtgctgcttggttactgcagtgagggatggcatgaatcttatcccgtatgagtacattattgctcgacaagggaatgagatgatcgacagggtcctaggccttggcccgtcttcaaggaagaagagcatgcttgttgtctcagagttcattggctgctcaccctccctaagcggcgcgatccgggtgaacccttggaacattgattcagtggctgatgcgatggactctgcattggagatgcctgaaggggagaaggtcttgagacacgagaagcatcatagatatgtgagcacgcacgatgttgggtattgggcgaacagcttcctgcaagatcttgacagg

SEQ ID NO: 28462 - protein, 567 aa, Panicum virgatum
  misc_feature: Ceres CLONE 1883604
  misc_feature (69)..(567): Pfam Name: Glyco_transf_20 Pfam Description: Glycosyltransferase family 20
  misc_feature: SWISSPROT Homolog: EC 2.4.1.15 Alpha,alpha-trehalose-phosphate synthase (UDP-forming)
  misc_feature: Functional homolog of the protein sequence given in SEQ ID NO 50801
  misc_feature: Useful for making plants with altered carbohydrate content
MVSRSYSNLLELASGGGGGGGGEPLPSLGRRRVPRVVTAPGIVPGLDASDDDDDAASAASDHSSHAPRERVIIVANQLPVRAALRPGAGAGGGAGWDFEWDEDSLLLQVRDSLRAHHGRGDVDFVYVGGLRDDVPPADHDHVAHLLLEGFRCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTVTIKILPVGVHLEQLQSVLNLPETGVKVAELLKQFNHRSRLLLLGVDDMDIFKGISLKLLAFEQLLIQHPEWRGRVVLVQIANPARGKGKDVKEVQEESDAMVKRINDAFGQPDYQPVILIDKPLQFYERMAYYVVAECCLVTAVRDGMNLIPYEYIIARQGNEMIDRVLGLGPSSRKKSMLVVSEFIGCSPSLSGAIRVNPWNIDSVADAMDSALEMPEGEKVLRHEKHHRYVSTHDVGYWANSFLQDLD

SEQ ID NO: 28463 - DNA, 468 bp, Panicum virgatum
  misc_feature: Ceres CLONE 1883604-R
  misc_feature: Encodes the peptide sequence at SEQ ID NO. 28464
gtccgacgaggacatgttcgaggtgatcaccgcggcggtggcgcggggccccgcctccctgcacccggaggcggaggtgttcgcgtgcacggtggggcgcaagcccagcaaggccaagtactacctggacgaccccgcggacatcgtgcgcctcgtccagggcctcgccaacgtctccgacgaccaggcctcgttgcacggcagcagcagcggcgccaccctgcccgacgacgaagcggccaccgccaccatccggaggtgaaaccgcacctgcccgcccgtgcgcaggtcagctcaagtaggcggcggtatgctcgcttggtcccagatgtacattgttctaggaacgaatgaactcgcgcaagtgcgtgctgtgcttgcgtgtgcgctgctttgtcgaattgtcagccgatgtgtacataaaactcctccggatcatctctccatcgatcgcgcggagttctgttc

SEQ ID NO: 28464 - protein, 86 aa, Panicum virgatum
  misc_feature: Ceres CLONE 1883604-R
  misc_feature: Functional homolog of the protein sequence given in SEQ ID NO 50801
  misc_feature: Useful for making plants with altered carbohydrate content
SDEDMFEVITAAVARGPASLHPEAEVFACTVGRKPSKAKYYLDDPADIVRLVQGLANVSDDQASLHGSSSGATLPDDEAATATIRR

SEQ ID NO: 28465 - DNA, 389 bp, Panicum virgatum
  misc_feature: Ceres CLONE 1883631
  misc_feature: Encodes the peptide sequence at SEQ ID NO. 28466
attccctctccgccccgttccacctgccgccgccgccgccgccgccgccttcgggaatccagatggcgtccgcggccgcgcacccgacctcgctctccatcgcggcccgcgcggccaccagggccgccgccgccgccaccccgctgcgcagggggggcctctcggcggcgtgccagccggcgcggtcgctggcgttcgcgggggccgacgcgcggctcccgctcctcgtcccgccccggcgccgtcgggcgtctcccgcgcgcgggacccgcgcccggcccaccatgcccaacaagagcgcccgggacctcccggaggccgagctccaggggaagcgcgtcctcgtgcgcccccacctccgcctgcccctcgaccagaaccacatcatc

SEQ ID NO: 28466 - protein, 108 aa, Panicum virgatum
  misc_feature: Ceres CLONE 1883631
  misc_feature: SWISSPROT Homolog: EC 2.7.2.3 Phosphoglycerate kinase
MASAAAHPTSLSIAARAATRAAAAATPLRRGGLSAACQPARSLAFAGADARLPLLVPPRRRRASPARGTRARPTMPNKSARDLPEAELQGKRVLVRPHLRLPLDQNHI

SEQ ID NO: 28467 - DNA, 1349 bp, Panicum virgatum
  misc_feature: Ceres CLONE 1883806
  misc_feature: Encodes the peptide sequence at SEQ ID NO. 28468
cgccccccttctccccgtccgttccccatcttcccgctctctccccatgtcgccgccggcggccggcgcggccgccacctccggcgacgggccgccgtcgtctccgcgcgagctctacaccatcccggcctcatccggttggttccggtgggacgggatccacgagacggagcgccgcgcgctgccggagttcttcggcggggccggcggcgccgggttcgggacggccacgcggaacccgcggatctaccgcgagtaccgcgacttcatcatcgccaagtaccgggaggacccggcgcgccggctcaccttcaccgaggtccgcagggcgctcgtcggggacgtcacgctcctccggaaggtcttcgccttcctcgacgcctccggcctcatcaacttctcggcctcctcctcgtcctcggggcccgcgtcgcggcagcaggaggtgggggtcgtcgtggagtcgcccgtggggctgcaggtgacgccgcgcccgccggcgtcctacttcgccgaggagaagcggggaggggcgggcggggagaaggagaacggattccgcttgcccccgctgacctcctacagcgatgtgtttggcgaatgggcgcctgggaaggcccctatatgtgggttttgcggcgaggagtgcaatgatgagaaggttgagacgttgaaggatggttttaaagtatgttcaaaatgttccaaaagcaataatgataacaaggaagaagcgaataaatgtcctggtgacaaaaaggagagtgtggacaaccatgcttctagtccatggacagacgcagagacgttactcctattagaaggagtcctaaaacatggagatgactgggatcttatcgcccagcatgtacgcacaaagaataaatcagaatgcatagcaaggcttattcagttgccttttggtgaacatatgctgggcacaataaatggtaaatctgttagccggctccacatgaaccaggcaactgatggaaaaatgaaccagcaccttatgaatgactcttcaagcaattcaactgaaaaggttgatggcatgcgtattgatggaaatgaagatagtgctgataaatcagtagaagaacatcctacaaaacgcagacggttgttttcttcaatggatgctaccacttcattaatggagcagttagcactcctgaccacatcaacgagcccagatgttgttgctgcagctgctgatgctgcaattaaagctttgggcgatgaaaatccccaagcaaggaaagcctttcgccttagtgaacgagaatttaagactaaggcattcgcttcaaaccatgtccaacagatagatcgcaaagttggcaata

SEQ ID NO: 28468 - protein, 434 aa, Panicum virgatum
  misc_feature: Ceres CLONE 1883806
  misc_feature (24)..(118): Pfam Name: SWIRM Pfam Description: SWIRM domain
  misc_feature (246)..(291): Pfam Name: Myb_DNA-binding Pfam Description: Myb-like DNA-binding domain
MSPPAAGAAATSGDGPPSSPRELYTIPASSGWFRWDGIHETERRALPEFFGGAGGAGFGTATRNPRIYREYRDFIIAKYREDPARRLTFTEVRRALVGDVTLLRKVFAFLDASGLINFSASSSSSGPASRQQEVGVVVESPVGLQVTPRPPASYFAEEKRGGAGGEKENGFRLPPLTSYSDVFGEWAPGKAPICGFCGEECNDEKVETLKDGFKVCSKCSKSNNDNKEEANKCPGDKKESVDNHASSPWTDAETLLLLEGVLKHGDDWDLIAQHVRTKNKSECIARLIQLPFGEHMLGTINGKSVSRLHMNQATDGKMNQHLMNDSSSNSTEKVDGMRIDGNEDSADKSVEEHPTKRRRLFSSMDATTSLMEQLALLTTSTSPDVVAAAADAAIKALGDENPQARKAFRLSEREFKTKAFASNHVQQIDRKVGN

SEQ ID NO: 28469 - DNA, 669 bp, Panicum virgatum
  misc_feature: Ceres CLONE 1883806-R
ctaccgctattggtgtagctgctgcctgtgctaaaatgcttgcggaccaggaggagcgagaaatggagctcctaatggcgtcgataattgaaactcagttaaggaagatgcaatacaagatcaaacactttgaggagctagagtcggtcatggagcaggagtacaccactatgcagcaaatgcagggatccctaatgaatgaatggctaaaggccctggagcaagcattccgggctggagtgtcactgccgagagatgaattgctcataaagctgttcctggacaaggcctccccatgaggaagttggctgtagcccctgatctgcatctcttctgactgtagatgctagatagcttcatgcgtgtatgagggcgcgcgtctgtaaagttgctgattgagcattccgtttctcagaattttgggcccggggttataacagccccctgtaacatcttgctctgttgtaccaactaggttagatggcaaatcgctggcagtttcctgtaattgtccggcatttttttttcgttcatttggatgtgaaaaaaatcttcagttttggagtttcacatgttggttagtcggtgagctgactgcttcggtttgttgcttggtaatgttgtatgtggaaagatgtgctctataaaatgccagcagatgatcgactt

SEQ ID NO: 28470 - DNA, 1264 bp, Panicum virgatum
  misc_feature: Ceres CLONE 1883830
  misc_feature: Encodes the peptide sequence at SEQ ID NO. 28471
gatcccgtccgcctacctcccctggtggatctctcctcccctttcctgatctctacttgcctgcctggggagaggacggcccgccatggcccctcgatctctcgccgctctcctcctgctcctcctcttcgccgccgccgcctacccctccacccgcgccgccaccagcagcagcaaggacgaggaggaggacctccagtacctcatcgacaacgctggtgacatccccggcaacgaccctgacggcgacgacgacggcgactacgacgacctcttcgaggaccaggacctcccggaccagcagccgcagatcgacgagacccacgtcgtcgtcctcaccgccgccaacttctcctccttcctcgccgccacccgccacgtcctggtcgagttctacgccccctggtgcggccactgccaggagctcgccccggactacgccgccgccgcgtcccaccttgcggcccaccacagccagagccacctcgccctctccaaggtcgacgccaccgaggacacggacctcgcccacaagtacgacgtccagggattccccaccatcctcttcttcatcgacggcgtccccaaggactacaacggcgccaggaccaaggatgccatcgtcgagtggatcaacaagaagctcggcccgggggtgcaaaacatcaccgccgtcgaccaggccgagaggatactcacaggggatgacaaggccgtccttgccttcctcgactcgctatctggtgctcaaagtgatgagcttgcggctgcttcaaggctggaagatagcatcaacttttatcagacttcaagtcctgatgttgctaagcttttccacattgacccagaagcaaagcgcccatgcgtagtattgctgaagaaggaggaggagaagttgaccttctttgatggggagtttaaagcatcagtgattgccgattttgtgtctgcaaacaagcttcctttggttactacgctaactcaggaaacttccccttcaatttttggcaattcaatcaagaagcagattttactatttgctattgcaaataagtcctcgaaatttctgcccatctttaaggaagcagcaaagtcattcaagggaaagctattatttatctttgtggagcgagacaatgaggaagtaggtgaaccagttgccaactactttggtattactggacaagagaccactgttcttgcttacactgggaatgaagatgctaggaaatttttccttgatggtgaagtgtcactggactcc

SEQ ID NO: 28471 - protein, 392 aa, Panicum virgatum
  misc_feature: Ceres CLONE 1883830
  misc_feature (80)..(186): Pfam Name: Thioredoxin Pfam Description: Thioredoxin
  misc_feature: SWISSPROT Homolog: EC 5.3.4.1 Protein disulfide-isomerase
MAPRSLAALLLLLLFAAAAYPSTRAATSSSKDEEEDLQYLIDNAGDIPGNDPDGDDDGDYDDLFEDQDLPDQQPQIDETHVVVLTAANFSSFLAATRHVLVEFYAPWCGHCQELAPDYAAAASHLAAHHSQSHLALSKVDATEDTDLAHKYDVQGFPTILFFIDGVPKDYNGARTKDAIVEWINKKLGPGVQNITAVDQAERILTGDDKAVLAFLDSLSGAQSDELAAASRLEDSINFYQTSSPDVAKLFHIDPEAKRPCVVLLKKEEEKLTFFDGEFKASVIADFVSANKLPLVTTLTQETSPSIFGNSIKKQILLFAIANKSSKFLPIFKEAAKSFKGKLLFIFVERDNEEVGEPVANYFGITGQETTVLAYTGNEDARKFFLDGEVSLD

SEQ ID NO: 28472 - DNA, 702 bp, Panicum virgatum
  misc_feature: Ceres CLONE 1883830-R
ttgctgaaagttcttggaagacaagctcacaccattctacaagtctgaaccagtacctgaatctaatgatggtgatatcaaaattgttgtggggaagaatctggatctgatagttttggatgaatcgaaagatatccttctggagatatatgcaccgtggtgtggccattgtcaatctctggagcctacttacaacaaactagctaagcatctacgtggcatcgactcccttgtgatagccaaaatggatggaactagcaatgagcatccacgtgccaagcctgatggataccccacgattctattctatccagcagggaagaaaagctttgaacctatcacttttgagggggaccggaccgttgtagagatgtacaaattcatcaagaagtatgctagcatccctttcaagttgaagcgccaacaatcatcaacggcgagaaccgggagcactcagacagagggtgcgatgagctcgggtacaaatctgaaggacgaattgtagggcatttaagtaccacgcaacttagtgctggctgttagttttgaggtggatcctcctctgcaatcttccctttctggaggagggaataggagaagttatcaatcaagtagaaagtggtcaggttgagggcttggacaattcagacgggaacaattcgggatacaatacaattgaataaaaagcaaatcctttccttt

SEQ ID NO: 28473 - DNA, 1636 bp, Panicum virgatum
  misc_feature: Ceres CLONE 1883834
  misc_feature: Encodes the peptide sequence at SEQ ID NO. 28474
aatcctccaaatccgacgcgattcctccgagccgccgccgccccgatcccgctgcggaggcggcgtatccctgccaacccgtggctccgctcgcctaccgactgaacacacaagaggcaacctttcgattccaaggcgaaaccttggatcttgacgccgaaaaaaaaaacgaatcttttctttgctatccgcgtgcgcttcaaggcctctggtgtgattagaatcgatttcttgttggttcagtgttgggaatggagatccagtcgtccggccggtccatcgacgtgctgatggagaaggtgctgtccgtgaacatcctctcctcggactacttcaaggagctctacaagttcaagacctaccacgaggtggtcgacgaaatctaccaccaggtcgaccacgtcgagccctggatgaccggcaactgccgcgggccctcctccgccttctgcctcctctacaagttcttcaccatgaagctcaccgtcaagcagatgcacggcctgctcaagcacccggactccccctacatcagagctattggatttctctacctgcgatatgttgcagaaccaaaaacactgtggacttggtacgagccctacatcaaggatgacgaggagttttcccctggatcaaatggaaaaatgactacaatgggcgtttacgtgcgtgatctccttcttggccagtactatttcgacagtcttcttccacgagtgcctctcccaattttgcgacaggtcactggccatcttgagaagctgaagcttccaacaaagcagtcaggaatgacaggggattccaataggcatgaatcaaatgatactgcccgaaggcctccgtccgtaaaagcttcgttgtctgtctcgtttggtcagcgtgctccacaccgtgcatccaccagggattcgtccccggtccgaagaacattaccttccaaacaagagaaggacagaagttatgatggtgaccgtgcaagatcaccaccaaggaagcgccgaagccagagccatgagcatgatcatgatgctgagagggaccgttcagatcgtgatcgtggcaggtataaggatagggagcatgatcgacatgctcgtgatcatagagaccaggaccatcatcggtcacgttattcagatagggatggtgagaggcgaggccgtgaaaagagggacagggattctgacagaagtggacgttcaatcacccgcagaagcaggagcaggagtccagtccgtggcagaactgacggtgataaacatcgttccagcccatttggtaaggcgccagagtcatctaacctggcaaagctgaaggatctatatggtgatgcaacaaacacaaagaacgattctggtgatgatcgagctcacagggattctggaaccgaagaggtaatccgactgggaggccaaaggtggaggtgaatctaatgttaaggaacacgacgacattgcatggttgcatctgggcccatgaattcttgtttttactaagataagataaatatactgcgtcagaaatgaccccagaatgatgggccatgccatttccatgatttacctggaagttttttttttcttttctagccattatggtgttaatcttttgttcatggaggctctgttgcttt

SEQ ID NO: 28474 - protein, 392 aa, Panicum virgatum
  misc_feature: Ceres CLONE 1883834
  misc_feature (1)..(169): Pfam Name: PRP38 Pfam Description: PRP38 family
MEIQSSGRSIDVLMEKVLSVNILSSDYFKELYKFKTYHEVVDEIYHQVDHVEPWMTGNCRGPSSAFCLLYKFFTMKLTVKQMHGLLKHPDSPYIRAIGFLYLRYVAEPKTLWTWYEPYIKDDEEFSPGSNGKMTTMGVYVRDLLLGQYYFDSLLPRVPLPILRQVTGHLEKLKLPTKQSGMTGDSNRHESNDTARRPPSVKASLSVSFGQRAPHRASTRDSSPVRRTLPSKQEKDRSYDGDRARSPPRKRRSQSHEHDHDAERDRSDRDRGRYKDREHDRHARDHRDQDHHRSRYSDRDGERRGREKRDRDSDRSGRSITRRSRSRSPVRGRTDGDKHRSSPFGKAPESSNLAKLKDLYGDATNTKNDSGDDRAHRDSGTEEVIRLGGQRWR

SEQ ID NO: 28475 - DNA, 1425 bp, Panicum virgatum
  misc_feature: Ceres CLONE 1883848
  misc_feature: Encodes the peptide sequence at SEQ ID NO. 28476
ccaggcaccaacgccaaatctcgcgacctgtcgaaatgggcgaaaccggaggcagcgcctagcgaggagcgcgagacgaacgccgccccgaatccaaaccctagcgccaggaggaagacggcgaccgaacgcggcagcgatcccggccctccaaaaccctagcccggctgctggatctcggggtagcgaggcatgtcggactcggcgtcgatggcggccgccatcgaggcgcggttcagcagccgcgacctcatcggccgcggctccttcggcgacgtctacaaagggtttgacaaggaattgagtaaggaggttgctataaaagtcattgatctggaagaagctgaggatgacattgaagacatacaaaaggagatatctgttttgtcacaatgccggtgcccttatataactgattattacggctcttatcttcaccagactaaactgtggatagtaatggaatacatggctggtggttctgtggctgatcttcttcaagctggccctcctctggacgaaatgtctatcgcatgcattctgagggacttgttacatgcaattgaatatctgcattctgaaggaaaaatccaccgtgatattaaagcggcaaatatcctcctcactgaaagtggagatgtgaaggttgcagactttggggtttctgcacagctaactaaaacaatgtctaggagaaagacatttgttggaactcccttttggatggcacctgaggtaattcaaaattctgaagggtacaatgagaaggcagatatctggtcgttaggtattactgctattgaaatggcaaaaggtgaaccccctttggcagatattcatcccatgagagttcttttcatgatacctcgtgaaaatcctccacagcttgatgagcatttctctaaaccaatgaaagagtttgtgtcactatgtttaaggaagaatccagcagagaggcctagtgccaaggatcttcttaagcatcgtttcataaaaaatgcacgaaagacttcgaagcttctggagagaataagagagcggccaaaatttgcagcgaaacgcatggatgccacacaaaatggcctgacacatgttgaagaagatgttggtacatgtactatcaaggttgatagggcaaaagatgcagctccaccattgagtcaaggaacagtcagaaaagctacaggctgggatttgcctgatagatcagaaggcacgggaactgtccgagttgtttccaggccccctcagactgcctccaccaaggatagcaggtttgatgtgcctcaaagtccaaatacaccaaaacgtacagctgatcgagaaaatcagtggagggcatcatatactgggtctgaagaatctctgaatgatcgtgggagactagaaagctctactgatgataatgaccaatctgtaagtggg

SEQ ID NO: 28476 - protein, 410 aa, Panicum virgatum
  misc_feature: Ceres CLONE 1883848
  misc_feature (15)..(267): Pfam Name: Pkinase Pfam Description: Protein kinase domain
  misc_feature: SWISSPROT Homolog: EC 2.7.11.1 Non-specific serine/threonine protein kinase
MSDSASMAAAIEARFSSRDLIGRGSFGDVYKGFDKELSKEVAIKVIDLEEAEDDIEDIQKEISVLSQCRCPYITDYYGSYLHQTKLWIVMEYMAGGSVADLLQAGPPLDEMSIACILRDLLHAIEYLHSEGKIHRDIKAANILLTESGDVKVADFGVSAQLTKTMSRRKTFVGTPFWMAPEVIQNSEGYNEKADIWSLGITAIEMAKGEPPLADIHPMRVLFMIPRENPPQLDEHFSKPMKEFVSLCLRKNPAERPSAKDLLKHRFIKNARKTSKLLERIRERPKFAAKRMDATQNGLTHVEEDVGTCTIKVDRAKDAAPPLSQGTVRKATGWDLPDRSEGTGTVRVVSRPPQTASTKDSRFDVPQSPNTPKRTADRENQWRASYTGSEESLNDRGRLESSTDDNDQSVS

SEQ ID NO: 28477 - DNA, 649 bp, Panicum virgatum
  misc_feature: Ceres CLONE 1883848-R
aaggtcgcaaatcacggcagttacctgatggacaatcagcttctcgagcttctagttctgtagcttcacctgcaatctcgtcattgataatcccttctttgaaggaggctactggtgacaagtttgaacgacctgctgttcatgctttccttgattccttgatggatctagaacatgagatacctggatcatgcgaggtactgattgacagattgctacaccggctagggagctcaaaggagtcctcgttgcgaggccttcaagagacggcagcttcagtttttgcaaagaagcctgaacctccctccgaacaagcaagctacaagaaattagctagtacgccaccattggctgctcctaccgtaagcccgctggcaaggttccttctaacaaggtggcaaaaccaagtttcgcaagatctcaattccgtttgattcatgcgatacaaaatgaagagatatttcatctttgatttggtgtataattaattttgagtgtacataatgcaatcttttgaactctttctgctagatggtcccaaccgtctgttgtttcatttgttgtgttcatggtgaataacatttctgcacattttctgatatgacttccaccgctgtacttgtattacatctcaagaacagacatatcc

SEQ ID NO: 28478 - DNA, 2077 bp, Panicum virgatum
  misc_feature: Ceres CLONE 1883895
  misc_feature: Encodes the peptide sequence at SEQ ID NO. 28479
attcccccaaggccccaacgaatccgcggcgagcggcggggccacgcctccgctgctcctccgcatgacgcaagagccgacgtcaatcctgccggcctgggcgcggacgccaacgacgcgacggcccaagtcgcgacgccaccagctacccatctcctcaggcgccatggaggaagccgacgaccacagaccccactcctcagccggccgccccttcctctccggcctctgcgccgcggcgctccgccgcaagcccctcggcgcccacacgtccaccgccgcctccggcgagggcctcgtgcggcagctcggtgtccacgagctggtgctgctcgggatcggggcttccatcggcgccggcatcttcgtcgtcaccggcaccgtcgcccgcgacgccggcccaggtgttacgatcagttttgttcttgctggagctgcgtgtgtgctcaatgccttgtgctatgctgaacttgcatctcgattccctgctgtggttgggggagcatacctgtacacatatgcggcattcaatgagatcactgccttcttggttttcactcagttgatggtggattaccatattggcgcagcaagcattgctcgcagcttagcaagctactttatccaattcttggagcttatcccgttcttgaaggggcacattccaagctggataggacatggagaggagtttttcgggggtgttgtgtcgattaatatattggccccgattcttctcatcctattaactgcgattctgtgctacggtgtgaaggaatcatcagctgtgaacacttttatgactactctgaagatagtcattgtaatagttgttgtatttgccggtgtttttgaggtggatgtatcaaattggtcaccatttatgcctaatggtttcaaatccgttgtgactggagccacagtagtcttttttgcatatgttggatttgatgcagttgctaattctgctgaggaagccaaaaggccacagagggatttgcccatcggtattctaggaagccttctagcatgtgtcttattatatgttgctgtatgcttggtcattactggaatggtgccatatacattacttggtgaagatgctcctttggctgaggctttcgctgctaaggggctcaaatttgttactgtattgatcagcattggtgctgttgttggacttactacaacacttctagttggcttgtatgttcagtcacgtttgtatcttggccttggaagggatgggcttctaccttcaatatttgctagagtacacccaacaaggcatactcctctgcactctcagatctgggttggctgtgttgcggcagtcatggcaggtctctttaatgtgcacatgctctcacatattctttccgttggcacgctgaccggttattcagttgtatcagcttgtgtgatcacattaaggtggaatgacaaagcaactagttgtcgctcccttggaagtatgtcaatctggcaagagggtgctctatgtcttgtcattgttgctctttgtggttttatagtgggactttgctatcgattcaactattctattgcctttatggtagtagctttcctgatagctgttgctgccagttttgctctccagttccgtcaggcctatgtggatccgcctggcttttcttgtcctggggtaccgctggttccagttatctctgttttcttcaacatggtcctgtttgctcagctacatgaagaagcgtggtatagatttgtcatccttagcctcgtcgctgtgggaatttactccggctatggccagtacaacgctggtccttccagctcagatcactcttctgttggttaccacagtgttccttctgaagctccatgagctgtgtgcctgtgtcaagcctccaagttcttcggaaatccagcaccataagatggaatctaatctctctttttttcctcgtgaaatgttgcacagttcgtacgctgtagttacatatgtagacgacgagtttcttagcctgtaaaacgagttgtagtgtccaccgcaccatttgttaaggaattgaatgtgccaagtgaatatactttc

SEQ ID NO: 28479 - protein, 600 aa, Panicum virgatum
  misc_feature: Ceres CLONE 1883895
  misc_feature (86)..(525): Pfam Name: AA_permease Pfam Description: Amino acid permease
MTQEPTSILPAWARTPTTRRPKSRRHQLPISSGAMEEADDHRPHSSAGRPFLSGLCAAALRRKPLGAHTSTAASGEGLVRQLGVHELVLLGIGASIGAGIFVVTGTVARDAGPGVTISFVLAGAACVLNALCYAELASRFPAVVGGAYLYTYAAFNEITAFLVFTQLMVDYHIGAASIARSLASYFIQFLELIPFLKGHIPSWIGHGEEFFGGVVSINILAPILLILLTAILCYGVKESSAVNTFMTTLKIVIVIVVVFAGVFEVDVSNWSPFMPNGFKSVVTGATVVFFAYVGFDAVANSAEEAKRPQRDLPIGILGSLLACVLLYVAVCLVITGMVPYTLLGEDAPLAEAFAAKGLKFVTVLISIGAVVGLTTTLLVGLYVQSRLYLGLGRDGLLPSIFARVHPTRHTPLHSQIWVGCVAAVMAGLFNVHMLSHILSVGTLTGYSVVSACVITLRWNDKATSCRSLGSMSIWQEGALCLVIVALCGFIVGLCYRFNYSIAFMVVAFLIAVAASFALQFRQAYVDPPGFSCPGVPLVPVISVFFNMVLFAQLHEEAWYRFVILSLVAVGIYSGYGQYNAGPSSSDHSSVGYHSVPSEAP

SEQ ID NO: 28480 - DNA, 1471 bp, Panicum virgatum
  misc_feature: Ceres CLONE 1883905
  misc_feature: Encodes the peptide sequence at SEQ ID NO. 28481
atcccatcccaactcattaagcaaagcttcttcctctgtcgcggcgctccagctctgctctcccacactccacgagaccactttcccctcttcccctccagcgccgggcggaaaaccccccaacccccgaaagagaagctcccggctcccaatcgaacttaccctgccttccggcgtcctgccctcgccggcgcggcttttatttccacccaagattattagcctccagctcaataagcccgattcatccagctccgtctcgatggaggccgatggcgccgctgccaagcttcggatcatcaacgacgcggtggaggaggtgcgccgcagaagcgtccgcgagaggggctggaccatcgagcaggcgatggaggacatgcgcagcggggagtgggagcggcgtcgcagggtctaccgcagcgtgcaggccaacgcccggctcgccgaggttgacccatgggatctcccgccgcgattcaccatgccgaaggagccggggagctcgagcctgcggacacattctgggtactggaaagagaaagaagatgagttcatcgggatccgctccgagggaggaggacaaggctcgtcctcggcttccggctcgccgtgctacaaaggggttaggaggaccctggagttttacgagcacaacgacaccaagacggactgggtcatccacgagtacagcgacctcgacgactacacatttgtgcagcctggattttgtggggacttgcagttgcatgacgatatcgtctttcgcaaggtattcaagaaaacacacacaataacagatatcgtcaagctcggccaacaacgatcaccgcgtgcgattgatgctttgatttgtgagatgttgtcaatgtcctttgaatggatggagaagcatacgagtggttgtgaagaagcaggatttgagtgtagggagtttccaaccccgtctgctgatccagatggagaatcatcagacgatgtttggcagcacttcaccagaataaacaccaaacatcccgatgagatgtatgcagtgtgccaccactgtgacagggtgctcaaggctccttccaagaatggcacatctcatctcagaaggcaccgtaagactaagacatgtacatgcaacaacaatccatcatccactcccgaagacctagagatcctgcgtaagctccgtgcaaaccgcgatctctacaagcaggggaagatggagcgatgtgttgaatctgtagtggaaccgtgcgatgttcccaccgcaggctactacacgagcttgctaagcttgaagacccatcaggggtgctggaaggagattaagagtaatgacaagctcatcgccatccgcatcggtcagctgccggtgccgcagtacgccgggctgaagaggaccttccaatttcaccctgacaatggcaccaagatggactgtatcatgctcgagtaccacctggtagatgagtacaacacccac

SEQ ID NO: 28481 - protein, 402 aa, Panicum virgatum
  misc_feature: Ceres CLONE 1883905
  misc_feature (237)..(286): Pfam Name: zf-BED Pfam Description: BED zinc finger
  misc_feature (42)..(145): Pfam Name: NAM Pfam Description: No apical meristem (NAM) protein
MEADGAAAKLRIINDAVEEVRRRSVRERGWTIEQAMEDMRSGEWERRRRVYRSVQANARLAEVDPWDLPPRFTMPKEPGSSSLRTHSGYWKEKEDEFIGIRSEGGGQGSSSASGSPCYKGVRRTLEFYEHNDTKTDWVIHEYSDLDDYTFVQPGFCGDLQLHDDIVFRKVFKKTHTITDIVKLGQQRSPRAIDALICEMLSMSFEWMEKHTSGCEEAGFECREFPTPSADPDGESSDDVWQHFTRINTKHPDEMYAVCHHCDRVLKAPSKNGTSHLRRHRKTKTCTCNNNPSSTPEDLEILRKLRANRDLYKQGKMERCVESVVEPCDVPTAGYYTSLLSLKTHQGCWKEIKSNDKLIAIRIGQLPVPQYAGLKRTFQFHPDNGTKMDCIMLEYHLVDEYNT

SEQ ID NO: 28482 - DNA, 673 bp, Panicum virgatum
  misc_feature: Ceres CLONE 1883905-R
  misc_feature: Encodes the peptide sequence at SEQ ID NO. 28483
ccccacgacctgcttcttgaggggattatggtgtttcgcaaagtcatccaagttttcaaagatgcgattaaagagttggaaaagatgtggaatggggacgatgacgataaagagtgctacattgatgagcgtgaagaagaggtgaaggcgtgcatgagcaccttgctccatgactgcttgcccggtgaggttcctcaaggtgatcaatcaggggttagaaagcgcaagagaactggtggtacggagggtggatcaaaagtttggctgtacttcactaagatttacaccacagatcctaagaaggtgtatgcagtgtgccactgttgtgacaggtgttacaagggtcactcgaagaatggcacctctcacctcaaaaggcacaacgagacatgctcaagcaagcaccggaaagtgtaggggaagatgaagctcagagaacaggagaagagagaatgtaccgaagctaggaacgaaaaggatgaccataagctgtctttctttagtaaaaattgtagtgtcagtaaggcaagtcgtcgagttctatcggaggtctttttatatttaggtacaatgatacctgggccacctaaactatgatttggatattggaggagtaaatcttctgaatgtaaaaggtggaggtgggttttatagtaagatgtatttgatgcgg

SEQ ID NO: 28483 - protein, 138 aa, Panicum virgatum
  misc_feature: Ceres CLONE 1883905-R
  misc_feature (85)..(132): Pfam Name: zf-BED Pfam Description: BED zinc finger
PHDLLLEGIMVFRKVIQVFKDAIKELEKMWNGDDDDKECYIDEREEEVKACMSTLLHDCLPGEVPQGDQSGVRKRKRTGGTEGGSKVWLYFTKIYTTDPKKVYAVCHCCDRCYKGHSKNGTSHLKRHNETCSSKHRKV

SEQ ID NO: 28484 - DNA, 1433 bp, Panicum virgatum
  misc_feature: Ceres CLONE 1883919
  misc_feature: Encodes the peptide sequence at SEQ ID NO. 28485
ccatctccagaccagacgcataaatcccacacgcgccgacggacaccgggctccaacccaattcccatccgcaggcaaattcatctgcccggagacgcgacaggagagcggctctcgttccgattccaccagccatggaggcgacgaagcagctaaggcgggtgcgcacgctgggccgcggcgcgtcgggcgccgtggtgtggctggcctccgacgaggcctcgggcgagctgctggcggtcaagtcggcgcgcgccgcgggggccgcggcgcagctccggcgcgagggccgcgtcctggagggcctctcctcgccgcacatcgtgccctgcctgggcgcccgcgccgcggccggcggcgagtaccagctcctcctcgagttcgcccccggcggctcgctcgccgacgaggccgccaggcgcgccgggggccgcctcgcggagcgcgacatccgggcctacgccggggacgtggcccgcgggctggcctacctccacggccgctcgctcgtgcacggggacgtcaaggcccggaacgtggtcatcggcgcggacggccgcgcccgcctcaccgacttcggctgcgccaggcccgcggactcggcgcggcccctcggcggcaccccggccttcatggcgcccgaggtggcgcgcggggaggagcagggccccgccgccgacgtctgggcgctcgggtgcacgatcgtcgagctggccacggggcgcgcgccctggagcgacatggacgacctcctcgccgccgtgcaccggatcgggtacaccgacgccgtgccggaggtgcccgcgtggctgtccgcggaggccagggacttcgtgtcctgctgcttcgagaggcgcgccagcgcccggcccacggccgcgcagctcgtcgcgcacccgtttgtcgccgccgccacccgcggcccggacgcgcggccggccaagcaggagctcccgtcccccaagagcacgctgcacgacgacgcgttctgggactcggacaccgacgacgaggcggacgagatgtcgacgggcgcggccgagcggatccgcgcattggcgtgcgccgcgtctgccctgcccgactgggactccgacgaaggctggatcgagctgcaggacggccgctcggaaaccgccgacgccgcgccggcgccggcggcggactacttcatctgggcggaaccatcagacgctgagtccgagcagttcttcaccaccgccgccgccgccgccgcagatgtcagcgaccatctccatctccccctcatcgccggagttactgaggccgccaccaccattagccggggcagttacctgctccattgtgaaaacaaaatcccacttgggttcgaccgcgaaggggtcggaaacgtgggacaccaccgtgcttgtaacaggaacagattagtaaaaatgaaacgaattccgccc

SEQ ID NO: 28485 - protein, 432 aa, Panicum virgatum
  misc_feature: Ceres CLONE 1883919
  misc_feature (7)..(257): Pfam Name: Pkinase Pfam Description: Protein kinase domain
  misc_feature: SWISSPROT Homolog: EC 2.7.11.25 Mitogen-activated protein kinase kinase kinase
MEATKQLRRVRTLGRGASGAVVWLASDEASGELLAVKSARAAGAAAQLRREGRVLEGLSSPHIVPCLGARAAAGGEYQLLLEFAPGGSLADEAARRAGGRLAERDIRAYAGDVARGLAYLHGRSLVHGDVKARNVVIGADGRARLTDFGCARPADSARPLGGTPAFMAPEVARGEEQGPAADVWALGCTIVELATGRAPWSDMDDLLAAVHRIGYTDAVPEVPAWLSAEARDFVSCCFERRASARPTAAQLVAHPFVAAATRGPDARPAKQELPSPKSTLHDDAFWDSDTDDEADEMSTGAAERIRALACAASALPDWDSDEGWIELQDGRSETADAAPAPAADYFIWAEPSDAESEQFFTTAAAAAADVSDHLHLPLIAGVTEAATTISRGSYLLHCENKIPLGFDREGVGNVGHHRACNRNRLVKMKRIP

SEQ ID NO: 28486 - DNA, 1176 bp, Panicum virgatum
  misc_feature: Ceres CLONE 1883937
  misc_feature: Encodes the peptide sequence at SEQ ID NO. 28487
tttttccgctcccgaccgcgcaaaaatatcacgatccacacccattccccgctgccgccgccgccgccgcgaacgagatggcggcagccctcctgctccgcggtctccgctcgtcggcgagccgggcacacacccactcgctctcccatgcatcgtccccatcggcgctggggtcatccctcctgcgccggctctactcctccgcggcggcgtccgccgctgcgtcgcctgctttaacacccagcggcgtcatggacccgtcccgcatccgcaacgtggcggtgatagcccacgtcgaccacgggaagactacgctcatggaccggctcctgcggcagtgcggggccgatatcccccacgagcgcgccatggactccatcagcctcgagcgcgagcgcggcatcaccattgcctccaaggttgaacgagttgtgggaatggtggaaggagctgtcttggttgttgatgctggagagggacccttagcacaaactaaatttgtgctttcaaaggctttaaagtatggcttgcgcccaattctcctcctcaacaaggttgataggccttcagtttctgaagaaacttgcaatgaggtagagagcttggtttttgatctttttgcaaaccttggtgctacagaagaacagttagatttcccagttctttatgcatccgctaaagaagggtgggcttccttaactttcaccaagaaccctcctgatgatgcaaagaatatgtcttcgttgctcgattccattatacagcatgttccttcaccaaaagctgatcttgagtccccattccaaatgttggtttccatgatggaacgtgatttttatctaggacgaatactcactgggagagtaagatctggagttctccgtgttggtgacaaagtgcatggtcttcgcagcacagatgatggagttcaaaagattgaagacggaaaggttatcaaactcatgaaaaagagaggcacaagtatggtaacagtagaggctgcaggggctggtgatattatttcaatggctggattggctgctccagcaattggacatactgtggcaaattcagaggtattaactgctctgcctacaattgagttggatcctcccacaatatctatgacatttggtgtgaatgattcaccattggctggtcgtgatggcactcatc

SEQ ID NO: 28487 - protein, 366 aa, Panicum virgatum
  misc_feature: Ceres CLONE 1883937
  misc_feature (62)..(233): Pfam Name: GTP_EFTU Pfam Description: Elongation factor Tu GTP binding domain
  misc_feature (256)..(330): Pfam Name: GTP_EFTU_D2 Pfam Description: Elongation factor Tu domain 2
  misc_feature: SWISSPROT Homolog: EC 2.7.7.4 Sulfate adenylyltransferase
MAAALLLRGLRSSASRAHTHSLSHASSPSALGSSLLRRLYSSAAASAAASPALTPSGVMDPSRIRNVAVIAHVDHGKTTLMDRLLRQCGADIPHERAMDSISLERERGITIASKVERVVGMVEGAVLVVDAGEGPLAQTKFVLSKALKYGLRPILLLNKVDRPSVSEETCNEVESLVFDLFANLGATEEQLDFPVLYASAKEGWASLTFTKNPPDDAKNMSSLLDSIIQHVPSPKADLESPFQMLVSMMERDFYLGRILTGRVRSGVLRVGDKVHGLRSTDDGVQKIEDGKVIKLMKKRGTSMVTVEAAGAGDIISMAGLAAPAIGHTVANSEVLTALPTIELDPPTISMTFGVNDSPLAGRDGTH

SEQ ID NO: 28488 - DNA, 111 bp, Panicum virgatum
  misc_feature: Ceres CLONE 1883937-R
gaaaaacccgaaaacgggaggcacagaaccccggaaaggccaacggcccaagaaaggaaagggaaagaaccaggcccaggaaagggggaggaaccggcggcgaggcggaca

SEQ ID NO: 28489 - DNA, 2015 bp, Panicum virgatum
  misc_feature: Ceres CLONE 1883961
  misc_feature: Encodes the peptide sequence at SEQ ID NO. 28490
ataccttcccctttcccgaccagcaagcagatccgccagcacctaccccgcacgcggcgcgcctcctggatggccaccgtcttccccgcccgcaccggtccgccgtagcatgggcctacccccgtcctccctctccaaatccagcaccaactccccgccgcgccgcagcaggccgctctccccgatggcgccgccgccgccgcagccgcgggcgaccgtgcccgtgatggtcgccgcggggggcagcggcagctcctcctcctcctccccgttggccccgcccgcgcgggactacacgcaggacctgcccgacgacatcctcgcgctcgtcttcgcgtcgctctcgcccgccgaccgcggcgcctgctccctcgcctgcgcgcgctggaaggaggtcgacgccgccacgcgccaccgcctctccctcgacgcgcgggccgggctgggccgcgccgcgcccgcgctcttcgcgaggttcgcggccgtcaccaaggtcgcgctccgcagcgcgcggggctccggcgccgacagcctcgccgacgacggcgccgcggcggtggcggccgcgctgccctcggaccgcctcgccaggctcaagctccgcggcctgcggaagctttctgacaccgggctgtcctcgctcgccgccgctgcaccggcgctccgcaagctctctgttgcttcctgcaccttcgggcctaaggccttcgtcgccgtgcttcaggcctgcccactccttgagggcctctctgtcaagcgcctccgcggcctaccagacgcggccggtgctgctacttccattattgaggagctcaaatttccacaggcgttatctctccgttcggtttgcctgaaggatctatacagcgccctgtgctttgtgccgcttgtggcatcctcgccaaacctccgcacgctcaagatactgcggtgctccggcgcctgggacctgccattggaggtcatcactgcgcgtgctcctggtcttgttgagcttcaccttgagaagctccaggtgggcgaccgtggccttgctgcgctctccgcctgcagaaatctggaggtgctgttccttgtaaagacccctgagtgcactgactcgggcatcatcagtgttgccgagaagtgccacaaactccggaaactgcatattgatggatggcgcacaaatcgaattggggactttagcctcatggctgtggcacaaggatgtctggacctgcaggagctcgtcttgattggggtcaaccccactgtgtcgagcctccggatgcttggtgagcactgtcgtacgttggagcggctcgcgctttgtgggtgcgaaactgtgggggatgctgagatcatttgcttggctgagcgatgtgctgcgctcaagaagctctgcatcaagggatgcccggtgtcagatcgtgggatggaagcactaaatgggggctgccccagtttagttaaggtgaagctgaagagatgccgtggagtgtcctatgagtgcattgagaatctgaaggttaccaggggggattcattttctatcagcttggatattgtgttggagcatgatgctgggagtgctagtgaaaatggtgtccacgagacaggtgaggcacaaatcactgagctgtctgatcagatagctagcatggaccttcctaccaatgctgctagttcacaatcatccacgcatactattaacaggttgaggagtttcgtgtcagcgatccggcgtaggttttgcaacactcaaccacagtgatgtgagaatggcaattttatgaactgttgttatcccttcccattttctaatcacgtattcatgtttcctaaacttatcacattgcctggccagtttgtgcaagataaccgtctatggatgtttcttcatgttgttttatgggctaattgcatcaacgttagggttttgcatacctgttacataaatttgttcctgttggtttgttaattgtgatatgtttctatacatatttaaatcaatcattttctttcttttcttc

SEQ ID NO: 28490 - protein, 548 aa, Panicum virgatum
  misc_feature: Ceres CLONE 1883961
  misc_feature (61)..(107): Pfam Name: F-box Pfam Description: F-box domain
MGLPPSSLSKSSTNSPPRRSRPLSPMAPPPPQPRATVPVMVAAGGSGSSSSSSPLAPPARDYTQDLPDDILALVFASLSPADRGACSLACARWKEVDAATRHRLSLDARAGLGRAAPALFARFAAVTKVALRSARGSGADSLADDGAAAVAAALPSDRLARLKLRGLRKLSDTGLSSLAAAAPALRKLSVASCTFGPKAFVAVLQACPLLEGLSVKRLRGLPDAAGAATSIIEELKFPQALSLRSVCLKDLYSALCFVPLVASSPNLRTLKILRCSGAWDLPLEVITARAPGLVELHLEKLQVGDRGLAALSACRNLEVLFLVKTPECTDSGIISVAEKCHKLRKLHIDGWRTNRIGDFSLMAVAQGCLDLQELVLIGVNPTVSSLRMLGEHCRTLERLALCGCETVGDAEIICLAERCAALKKLCIKGCPVSDRGMEALNGGCPSLVKVKLKRCRGVSYECIENLKVTRGDSFSISLDIVLEHDAGSASENGVHETGEAQITELSDQIASMDLPTNAASSQSSTHTINRLRSFVSAIRRRFCNTQPQ

SEQ ID NO: 28491 - DNA, 1853 bp, Panicum virgatum
  misc_feature: Ceres CLONE 1883999
  misc_feature: Encodes the peptide sequence at SEQ ID NO. 28492
ccttccccaagcgagccgccgccggcctgcccgcccgcctccgcccctccgcaatataaccaccccgaccaccgcgcccgctcactccagtggcgactccgctcctccgtcccagtccccaaccatcaacaatgccgccgcgtccggctcctcgcctcctcccccttctcgtcctcatcctcttccatctcccctcctccctctccgcccgccaccaccaccgcagtaccccgtccccgtcgcctgccgcggcaccggcgtcctccggctcggcgccgctcgccgtcctcctggcctgcaacgccacccgcttccagccggcatgcgtctccacgctctccggcgccgcgcccgacgcctccgcctccgacctcctcggcgccacgctcaccgcgctccgcgcccgcatcccgcccgccgtctccacggccaagtccgtcctcgccgcctcctccaacgtgaacctcaccaacgccgccaccaactgcctcaccttcctgtccctctcctcccgccgcctcgcgccgtccccttcgccgccgctgctctccgcctccaccgcgctgctccacctctacgactgctggtccgcgtacaagtacgtcaacttctcccsggccatctccgacgccatggcgtacctcaacgacaccatcgccgtcaacagtaactacatctccatgctcgccgcgcggcctcggtacggcgactagacctccctctggcgcccgccgcacacggagcgcgacgggtactggccgcccgccgcggtcgcgtcgaaggaggcggagcgcgatgtcgatgcgctcggcgtgccgcgagggctgcccgcgaacgcgacggtttgcgccgcggggtgcgactaccggacggtgcgcgaggcggtggcggccgcgccggactacggcgaggggccgttcgtggtgcgcgtgaaggagggggtgtacagggagacggtgagcgtgccgtgggagaagacgaacgtggtgctcgtgggcgacggcatggggaggacggtgatcaccggcgacctcaacgccgacacgcccggcgtgtccaccttcaacacggccaccgtaggcgtgctggcggacgggttcatggcgcgcgacctgacgatctccaacacggcggggcccgacgcgcaccaggcggtggcgttccgctccacgggcgaccgcacggtgctggacggcgtggagctgctgggccaccaggacacgctgtacgcgcacgccatgcgccacttctacacccgctgccgcgtcgccggcaccgtcgacttcgtcttcggcaactccgcggcggtgctccacgccaccgccctcatcgtcctgccccgccagctgcgcccggacaagggcgagaacgacgccgtcacggcgcagggccgcaccgacccggcccagcccacggggatcgtgctcagcgtctgctccgtcaacggcagcgacgagtacatggcgctctaccgccggaagcccgacgcgcaccgcgtctacctgggccggccgtggaaggagtattcccgaacagtgtacctccggtgcacgctcgcggagatcgtgcagccgcaggggtggatgccctggagcggggacttcgcgctcgacacgctctactacggcgagttcggcagcgccgggcccggcgccgccgccggtaggagggtggcgtggagcagccaggtgcccgaggaccacgtcgacgcgtacagcgtcgccaacttcatccagggccacgagtggatacccaaagcatagaacactagttgcctgtagagaatgtatgatgaacagtcgtgtcgaacaattggcatgctgcccgtgaccttgagcgattttttaaaacct

SEQ ID NO: 28492 - protein, 252 aa, Panicum virgatum
  misc_feature: Ceres CLONE 1883999
  misc_feature (1)..(246): Pfam Name: Pectinesterase Pfam Description: Pectinesterase
  misc_feature: SWISSPROT Homolog: EC 3.1.1.11 Pectinesterase
  misc_feature: Functional homolog of the protein sequence given in SEQ ID NO 51283
  misc_feature: Useful for making plants with altered cell wall content and/or composition
MGRTVITGDLNADTPGVSTFNTATVGVLADGFMARDLTISNTAGPDAHQAVAFRSTGDRTVLDGVELLGHQDTLYAHAMRHFYTRCRVAGTVDFVFGNSAAVLHATALIVLPRQLRPDKGENDAVTAQGRTDPAQPTGIVLSVCSVNGSDEYMALYRRKPDAHRVYLGRPWKEYSRTVYLRCTLAEIVQPQGWMPWSGDFALDTLYYGEFGSAGPGAAAGRRVAWSSQVPEDHVDAYSVANFIQGHEWIPKA

SEQ ID NO: 28493 - DNA, 1822 bp, Panicum virgatum
  misc_feature: Ceres CLONE 1884017
  misc_feature: Encodes the peptide sequence at SEQ ID NO. 28494
tcctcaagcacagcagctgcccgcgccggccggaccggcagaactccacgcggggacgccacccggggagaggccacaccatgggcgcgggcggcaagcgggggcaccctctcctgaggggcgggggcgcgaggacggagcgctacacccacgggttctcggcgtcccagatggccgcgctcacggccctgtgcggcgcgctggtgccgtcgctgccgcccgcgggcggccggagcctgcaggaggaggacggcggccgcggcgggggcgggggcgggggcggcgacaaggtcgtggaggagttcctcctggcctcggccgccgacgcgcccgtgccggacgaggtcgcggagctcatgtcgcggcggtgcctcccggaggcgctggcgctggtgcgcgcggtgctgtggctgctgggcacgcggctgggctccctggcgctgtgcggggcgtccccgtgcctgtcgtggcggttcccgttcgtgcgccgcttcgccgagctgccccccgagcagcgcgaggccgcggcgcggcggtggagccggcaggcgctgctcccgccgctgcgcatgttcttcctcatcaccaaggtcttctgcctctacgtcttctactcgtggaccgatgagaagtcgaagaacccgcactggcgcgccatcggctacaccccgccgctagccgacgaggagccggcggcggaggaggaagcagagcgtcccgagaaccggcccctcgacgacggcatcgtggagacgatcaacgagaccgacgcgtccctgctggcgtcgctcgcggggaaggggctcgcggtgacggaggacgtggcgcggaacgtgtgcagggtcgagtgcgacgtcgtcatcgtcggctccggctgcggcgggggcgtgtcggccgcggtgctcgcgggggcgggctacaaggtggtcgtgatcgagaaagggaactacttcacggcgcgggactacacgtccctcgaggcgccgtccatgaaccatctctacgaggccggcgggttckycagcacgatcagtggcagcgcgctggtgctggccagctcgacggtcggcggcggcacggccgtgaactggtccgcctgcatcaagacccccgacgacgtgcgcggggagtgggcgcgcgatcaggggctcccgctgttcgccaccgacgagtacgccgccgccatggacaaggtgttcgagcggctcggcgtgacgcacgggtgcacggaggaggggctccagaacaaggtgctccgcaaggggtgcgagaagctcgggtacaaggtggagccggtgtcgaggaactcgtcggagggccactactgcggcagctgcgggttcggctgccgcacgggcgacaagcgcggcacggacacgacgtggctggtcgacgcggtgagccgcggcgcggtgatcctgacggggtgcaaggccgagaagctgctgctggagcgtagcggcggcggcggcgacgacgcaggcggcagggcgcagcgatgcgtcggcgtggtggcgaggagcaccaacccggcgatcacgaggacgctggaggtgcgcgccagggcgaccatctcggcgtgcgggtcgctcctgacgccggtgctgctgcgcgggagcgggctcagcaaccggcacatcggcgagaacctccacctccacccgacggcgctggtgtggggctacttcccggacaccgcgccggacctccggggcaagacgtacgagggcggcatcatcacttgcctgcacaagctgggaggcccggggggcgcgccggcccgcgccatcctggagacgccggcgatgggccccgcctccgc

SEQ ID NO: 28494 - protein, 580 aa, Panicum virgatum
  misc_feature: Ceres CLONE 1884017
  misc_feature (304)..(542): Pfam Name: GMC_oxred_N Pfam Description: GMC oxidoreductase
  misc_feature (314)..(314): Xaa is any aa, unknown, or other
MGAGGKRGHPLLRGGGARTERYTHGFSASQMAALTALCGALVPSLPPAGGRSLQEEDGGRGGGGGGGGDKVVEEFLLASAADAPVPDEVAELMSRRCLPEALALVRAVLWLLGTRLGSLALCGASPCLSWRFPFVRRFAELPPEQREAAARRWSRQALLPPLRMFFLITKVFCLYVFYSWTDEKSKNPHWRAIGYTPPLADEEPAAEEEAERPENRPLDDGIVETINETDASLLASLAGKGLAVTEDVARNVCRVECDVVIVGSGCGGGVSAAVLAGAGYKVVVIEKGNYFTARDYTSLEAPSMNHLYEAGGFXSTISGSALVLASSTVGGGTAVNWSACIKTPDDVRGEWARDQGLPLFATDEYAAAMDKVFERLGVTHGCTEEGLQNKVLRKGCEKLGYKVEPVSRNSSEGHYCGSCGFGCRTGDKRGTDTTWLVDAVSRGAVILTGCKAEKLLLERSGGGGDDAGGRAQRCVGVVARSTNPAITRTLEVRARATISACGSLLTPVLLRGSGLSNRHIGENLHLHPTALVWGYFPDTAPDLRGKTYEGGIITCLHKLGGPGGAPARAILETPAMGPAS

SEQ ID NO: 28495 - DNA, 672 bp, Panicum virgatum
  misc_feature: Ceres CLONE 1884056
  misc_feature: Encodes the peptide sequence at SEQ ID NO. 28496
acatactcatcatcagcttactaagcaacacacaagagagccagagagagactagagagagatggcagctaccagcagcacgctctccttcccggtgatcaacatggagaagctccagaccgaggagaagccggcggccatggaggtcatccgcgacgcctgcgagaattggggcttcttcgagctgctcaaccatggcatctcccacgagctgatggacgaggtggagcggctgaccaaggcgcactacaccagctgccgcgagcccaagttccaagagttcgcggcgcggacgctggaagccggcgagaagggcgccgacgtcaaggacgtggactgggagagcaccttcttcgtccgccacctccccgcctccaacatcgccgacctccccgacctcgacgaccactacaggtgcgcctcatcgaagaccttcaccatattattagttggctacaactacaatccaatcagtcgttgataaaccttctgttggcttgatctgaataaaagttgaagcgccatgtcaccagcttttgactcaggttgcaaaaaaccctggggataatctaatcagtttgttaatatggtgatcctcaacttgaatgtgtttggtctaccaagttgaattagtgtaatggcttttacgcaaggctacaaagccaggctgac

SEQ ID NO: 28496 - protein, 139 aa, Panicum virgatum
  misc_feature: Ceres CLONE 1884056
  misc_feature: SWISSPROT Homolog: EC 1.14.17.4 Aminocyclopropanecarboxylate oxidase
  misc_feature: Functional homolog of the protein sequence given in SEQ ID NO 50854
  misc_feature: Useful for making plants with modulated heat sensitivity
MAATSSTLSFPVINMEKLQTEEKPAAMEVIRDACENWGFFELLNHGISHELMDEVERLTKAHYTSCREPKFQEFAARTLEAGEKGADVKDVDWESTFFVRHLPASNIADLPDLDDHYRCASSKTFTILLVGYNYNPISR

SEQ ID NO: 28497 - DNA, 1092 bp, Panicum virgatum
  misc_feature: Ceres CLONE 1884058
  misc_feature: Encodes the peptide sequence at SEQ ID NO. 28498
gtagctcgcgcgcacagactactggtccaaaaggaaaacacgccggaacaactcctccgaccctcgctcgccgcagctgacgcgagctgtcttgaccgggagcgatttctttccttttctcttcccgtgcgccaaccttaactgctccgatcaatcgatcgatcggtcgatcgagttccagccccgcagcacatggcgccgccggcgatggagatgctggggaggtccttcttgccgggcccggcgggcgcggcgggccgggagcggggaggcgggccctgcttcgccgcggtcgggcgggaggggaggaggagggggagggggccgctgcggtcggcggcgccggtgggggcgctggccgagcgggccgtcgtgacgccggcgccggcggagagggccggggcggctgcggccccgccagaggagccgccgcacccgcggaccgtcgcggcgcgggccgtggtcaccgtgcggcggcggcgcaaggaggacgccaagcgccggttcgccgagcagctggacgcctacgccgacagggtcggctggagcgtcctcctcgagctcgtcagcacggagatcgacccaggaaatgggggccccaagaagagcaagccgtcggcgctggtggggtggttcgagaagaaggacgtcaaggcggagcgggtggtgtacacggcggacttcgccgtcgacgcctccttcggcgagcccggcgcggtgaccgtgctcaaccggcaccggcgggagttcttcatcgagagcatcgtggtcgagggcttcccctccggtccggcgcacttcacctgcaactcgtgggtccagcccgaccgcgccccgcgcgtgttcttcaccaacaggccgtacctgccggacgagacgccgccggggctccgggagctccggcggcaggagctcagcgacctcaggggcgagggcgcctccgccgccgcgggcggcgagcgcaggctcaccgaccgggtgtgggagtacgacgtgtacaacgacctcggcaaccccgacaagggcgccgagttcgcgcgccccgtcctcggcggcgaccggctgccgtacccgcgccggatgcggacgggc

SEQ ID NO: 28498 - protein, 294 aa, Panicum virgatum
  misc_feature: Ceres CLONE 1884058
  misc_feature (115)..(214): Pfam Name: PLAT Pfam Description: PLAT/LH2 domain
  misc_feature: SWISSPROT Homolog: EC 1.13.11.12 Lipoxygenase
MEMLGRSFLPGPAGAAGRERGGGPCFAAVGREGRRRGRGPLRSAAPVGALAERAVVTPAPAERAGAAAAPPEEPPHPRTVAARAVVTVRRRRKEDAKRRFAEQLDAYADRVGWSVLLELVSTEIDPGNGGPKKSKPSALVGWFEKKDVKAERVVYTADFAVDASFGEPGAVTVLNRHRREFFIESIVVEGFPSGPAHFTCNSWVQPDRAPRVFFTNRPYLPDETPPGLRELRRQELSDLRGEGASAAAGGERRLTDRVWEYDVYNDLGNPDKGAEFARPVLGGDRLPYPRRMRT

SEQ ID NO: 28499 - DNA, 677 bp, Panicum virgatum
  misc_feature: Ceres CLONE 1884058-R
  misc_feature: Encodes the peptide sequence at SEQ ID NO. 28500
gggtacatccccaaccgcccgccgctgatgcggcggctggtgcccgccgagggcgacccggagtacgcgcacctggtggcggacccgcaccgcttcttcctctcggcgctgcccagcctgacgcaggccaccacgttcatgaccgtcatcgacacgctgtccacgcactcggccgacgaggagtacctcggggagcgccccgacggggcgtggacggcggacccggcggcgctggcggcggcgcgcgagttcgcggaggaggtgaggcgcgccgaggaggagatcgagcgccgcaacgccgacaccggccgccgcaaccgctgtggtgccggcgtgctgccgtacgagctcatggcgcccacgtccgggccagggatcacctgccgcggcgtccccaacagcgtcaccatttagtctccgtacggacagcggcagccatgggcggataataataacagagatgattcggaagtggatttttttcccctggcgaggagaaatctaggcggaagaagcagatgattttagccataattctcccccgttaatttgggtttcggaatccgaataggaggaacttgattttgacatggggtgggaggaattgatattgtagagggagtggggtgtaaataacacaatcaattgaatatagtcctataatatagagttctctc

SEQ ID NO: 28500 - protein, 137 aa, Panicum virgatum
  misc_feature: Ceres CLONE 1884058-R
  misc_feature: SWISSPROT Homolog: EC 1.13.11.12 Lipoxygenase
GYIPNRPPLMRRLVPAEGDPEYAHLVADPHRFFLSALPSLTQATTFMTVIDTLSTHSADEEYLGERPDGAWTADPAALAAAREFAEEVRRAEEEIERRNADTGRRNRCGAGVLPYELMAPTSGPGITCRGVPNSVTI

SEQ ID NO: 28501 - DNA, 1364 bp, Panicum virgatum
  misc_feature: Ceres CLONE 1884069
  misc_feature: Encodes the peptide sequence at SEQ ID NO. 28502
aagttgttagcagaagcacgcaagcaaggatcgcccgcttgctcaacagtcaagacaggcaccatgccatcagcgaaaccatgtcagtgggggatcagaatcataagcaggctttcagtttactgaatggaggcctgacgcgatcgagcagtctctctctaggacctcagctcctacctcagcatcaagagcatcgagattcgagaggttaataattagccccgcggcatcgagaggtccgcgccgccgccggaacatccgcgtcgccgctcggtcccgcccgccctgacccgaccgccgcgccgtcgtcagatccgccgccgacccgcccctggcactcacgccggacgcgacgtccgcgtcgccgctcggccccgcccgccgtgccgtccgcgccctgaccggatcgcgtgctcgatggcgcgtggccaccgccgccgcctctgctcggctgaccggggcagggcggagggaggtcgcgcgcgcggcgacgggcctcggtgacgagctcgcattcgtcgcccgctccaccggtgacccgcgcctcagctctccccccgacccctcccttggatcccatctcacctccgtggctccgtccatcaccaagctccctcccttcctctcccatctcccagatcatctccggccccaagctccctcccgttcgaagtcaagttttctgcaggttcagtgtgcctccacaacttggacgcagaacagttcaaggaatttctatggtgatgaatttgctccttgagtacaaactgtgacgatgagcagagagtgttcttggaatcattcttggaggtggtgcgggactagattgtcccccctgtcaaacaagcgtgccaagcctgcagttccattgggtgccaactacaggctcattgatatccctgtcagcaattgtctcaacagcaacatctcaaagatctatgtgctgacacagtcaagagcctagggaagcaacattggaggttacaagaatgaaggctcagggcacgtcccaatgtggatttgttgaagtgttagccgcgcagtagagtccagataatccaaagtggttccagaatcacatgaatgtcttagtgaggggagatggaggcgatggcgacgacacataggcgacagcggaggcaatggtggtctgggtgctggtggccgctgtgctgggcaccgcgcgcacccctggaccacaagctgctcatggacgcctctacccgcaatcctgcactactgcacaggagatgtcaatacacggcgatggcgctggcggtggcggtggacgcagccaacagccccatgaaggggagggcgtatgcgatgccgctggtaacctctgcaagatggagccagggtga

SEQ ID NO: 28502 - protein, 62 aa, Panicum virgatum
  misc_feature: Ceres CLONE 1884069
  misc_feature: SWISSPROT Homolog: EC 2.7.7.27 Glucose-1-phosphate adenylyltransferase
  misc_feature: The sequence is a functional homolog of SEQ ID NO 37 in US patent 7312378
  misc_feature: The sequence is a functional homolog of SEQ ID NO 38 in US patent 7312378
  misc_feature: The sequence is a functional homolog of SEQ ID NO 39 in US patent 7312378
MSRECSWNHSWRWCGTRLSPLSNKRAKPAVPLGANYRLIDIPVSNCLNSNISKIYVLTQSRA

SEQ ID NO: 28503 - DNA, 737 bp, Panicum virgatum
  misc_feature: Ceres CLONE 1884069-R
ggtcattttccacccgctcagtgtgcaacatgctccacggctaagaaatttcccataggtttgttttgcctataccctgctacgagatgttcatgctggtttggtcaattgatgcgttctttactgtctttgtgcgttcaattagttaggattcaaatcttcaactggattcacaatgttaagtaccagggctttgctttcttttgtgataagtgatctagcgtgcagtgtgcaataacgtttatttgaagcaccgtgatgccatgattttgatggaaattacttctatatatttgccggcgcatgagctgagggccctacggcagctggtcctacatgcctagcgtgtggagggcgattggcgatggagtgccaaggaaggcgccaaggaagctttgtgcgttctgatggatgattggagccagaaggtggacaagaggactggctgggacggagtgatggatgggcaaaacaatggccgtggtttgggtgcgagcaatcaggttgaatcattctatttatcatcgatgttcaaattttggagtggccccgaagaattgtgcgcaatagagaataaggaataattttgagtgaaggtctagattttgcattagttgggagtgttgggtttatgtctaatatcctgtgtcactgtcatctatctcatattaattatactttatattactctttatcctgttatgacataccttgaatatttactattaagattcttg

SEQ ID NO: 28504 - DNA, 1240 bp, Panicum virgatum
  misc_feature: Ceres CLONE 1884081
  misc_feature: Encodes the peptide sequence at SEQ ID NO. 28505
agagagagagagggggaaccgagggcggacagggacagcgcggcaccgagccgctgcgacggacggaaaccgcgagggctctgaaaagtgggaggaggccgacgaggcggcggcccaatccggagggcgcgaccggtccgctccgttcgttgggtcgttcttctcctcctcctcctcctcctcttcctattcctcctcttcctgtgcggaggggagcgaggcggcgacgacgacgagccgacgcccgagggcacgccgccgcccccgtagccgctcgggctgaggccgccggcgtggcgggatggcgcggttcatcctcagactcatggagctcggggtcagcgccacggtgcacctcgtcttcggcttctacgtcttcagcacggccgtggccgccgacatctcgcaggcggccgcggcctccgggtccttcctgctgcgccggccgccgccgcccgccgcgggcgagggggcgctcgtcgacgtcgccgccgcgggggagcgcgacgagcgcaggggcgccgcgcccgtcgtgctcgacggctcgccgccacccatcgtcctcgtccacggcatcttcggcttcggcaaggggaggctcggcgggctctcctacttcgccggcgccgagaagaaggacgaccgcgtgctcgtgccggatttggggtcgctcaccagcatccatgacagggcgcgcgagctgttctactacctcaagggcggccaggtggactatggcgaggatcacagcaaggcttgcgaccacacgcagatcgggagaatctatcctacagggcactatcctgtgtgggacgaacagaaccccgtgcactttgtcgggcactcggcaggcgctcaagttgtgagggtgctgcatcagatgctagccgacaaggctttcccaggccatgatacttctgaagactggattctgagccttacttctttgtcgggcgcacttaacgggacaacgagaacttactatgacggcatgctggtcgaagatggtaagtccatgagacctatctgtcttcttcagctctgccggcttggagtaatagtctacgattggctagatatttcttggctgaagaattactacaattttggttttgaccactatgagatgtctcggaggaaagtaggcttttcaggtttaattgatctgctgctggggcacactggcccatttgccagcggagattggattttacctgatctcacaatacagggatctata

SEQ ID NO: 28505 - protein, 312 aa, Panicum virgatum
  misc_feature: Ceres CLONE 1884081
  misc_feature: SWISSPROT Homolog: EC 3.1.1.3 Triacylglycerol lipase
  misc_feature: Functional homolog of the protein sequence given in SEQ ID NO 51024
  misc_feature: Useful for making plants with modulated cold sensitivity
MARFILRLMELGVSATVHLVFGFYVFSTAVAADISQAAAASGSFLLRRPPPPAAGEGALVDVAAAGERDERRGAAPVVLDGSPPPIVLVHGIFGFGKGRLGGLSYFAGAEKKDDRVLVPDLGSLTSIHDRARELFYYLKGGQVDYGEDHSKACDHTQIGRIYPTGHYPVWDEQNPVHFVGHSAGAQVVRVLHQMLADKAFPGHDTSEDWILSLTSLSGALNGTTRTYYDGMLVEDGKSMRPICLLQLCRLGVIVYDWLDISWLKNYYNFGFDHYEMSRRKVGFSGLIDLLLGHTGPFASGDWILPDLTIQGS

SEQ ID NO: 28506 - DNA, 630 bp, Panicum virgatum
  misc_feature: Ceres CLONE 1884081-R
gtaccaaacgaaacgagtcaatagcagataatcccaaagcaaagtatttctaggttgtagacaggagcaaatgaggaaccacagcgttttcgtaagctctaaattacttgctgatgatgatttgacgagcatttcatacttgatctctcctgttcttggaagggaaaattcgattcatgccaccacaactccgtgaaattgggtttcacgttgaaaatcgtgccactcaatggtatggatttcaacatgaaatccaacttcgtgaaattgtagtggcatggatccaactgacccttcttggaagaggggctcatggaggctggggacttgcatccttgtcggatactccgactgcctagggaacgcttcggctcggccaaccatgtacactccaatgcaaggaagattttggatttgccttccatggaacaaacaggagacaatggatcagacggctgcagttactgattacctaactgcggctgtgataggttcacatgtatgtttaaaaagtgagatgtaaatatcgagggttgcgtggatggtgtaaccttgtactagcagaaggattttgtggcaattatcaggattggatatctttgcttgccctggattcttgcaggcagctag

SEQ ID NO: 28507 - DNA, 1733 bp, Panicum virgatum
  misc_feature: Ceres CLONE 1884089
  misc_feature: Encodes the peptide sequence at SEQ ID NO. 28508
gccggtcacctccactccaccccgttagcccctccacgcctgaaccccctcgctccgggtgctgctgcggttgtagcctgaagctgcaggtgagatccggtgccgcgtcttcagcgcggggaaggggaaggcctgcaatgctcgagcccgcgcccggccccttcggttcgccgcgctgaagtccgcgatggaggccgccaccaagcgcgcccgcgcgggccgctgctcggcgcccgaccggctgagcgccctgccggacgagctcctccgccacgtcctctccttcctcccttcgcggcaggccgtgcagaccaccgtgctgtccaagaggtgggtagatctttggcgttgggtgcccgccatcaacctcgacatcagggatttccgagacaccgacaggagcctcggcgactgggaaaagatgaaggatttcaccaacaatctgctgatgctacacaatgccccgcgcttggaggcaatacgcctagggttatatataattagttttcggtcttatccgggtccaggtccaggtccagttgtggatagatgggttaggcgtgtcatcaagcaccatcctttggtactggatatctttgtctgcagaagctttacgcacatcttccagattccccttattggctccgctttttgtcgcctcaaaacgctgaagcttcagggtgtctctttggataattgtttcaccgatcggctcaattctgggtgcccagtcctggaagatttggttctcaattattgtcgcaatgaatttgatgccattcaatctgacacactgaagaacttggtggttgagacttgttcgagtcgcattgcagatgtattggtcatcagggctccttgtctcacttccctctccctgaattttccttatatccgctatagaaatggtctttcattagaggcaggaaattcccttgtgatggcatcaatttctgtagaaagtgatggatcatctcaaagttatcagacaatgattctgggaaacctatggaatgtgacaagcttggacttgaagggttttggtgcaatggcattccttgataaggaattagataaattcccaatatttgacaacttgagaaccttgtccctcagctggtgttttctcagtgaacatgatgtgcacacattcaaggcccttggaagatttctgcagaagtctcctaatctggagaagcttagtttgcaggatttctgggtgaggccagttgtaggaccaattgaattccccatgctcaacaacctgagaaccttatttctggatgaatgcgatttgcgtgataacttcaggatattgcgtcaccttctacggaggtctcctaatttggaaaagctcagtgtacggtgttgcaagctcccagaaggttctgtgggagggaaagggaaggcgagaaagacccatctctggtcccggaacctggtgcgcttccagtgccacaagctaaaatctactgagatcatatacgaaaagggtgacaaaatccaggaactggtctgtttgttgctggacatctcagaatgtgcaccaatggatactgtaacgcttaccaaagtatgaagaagagaacaagctctagctcggctccaggtggtctagctctagcttggtaacctctccttgtaatgcctctttggacagaagcagcgcggcatgctgaacatgtttttatactgtttcccgtttgcctaattcagacgctcttcctacgctg

SEQ ID NO: 28508 - protein, 463 aa, Panicum virgatum
  misc_feature: Ceres CLONE 1884089
  misc_feature (17)..(64): Pfam Name: F-box Pfam Description: F-box domain
MEAATKRARAGRCSAPDRLSALPDELLRHVLSFLPSRQAVQTTVLSKRWVDLWRWVPAINLDIRDFRDTDRSLGDWEKMKDFTNNLLMLHNAPRLEAIRLGLYIISFRSYPGPGPGPVVDRWVRRVIKHHPLVLDIFVCRSFTHIFQIPLIGSAFCRLKTLKLQGVSLDNCFTDRLNSGCPVLEDLVLNYCRNEFDAIQSDTLKNLVVETCSSRIADVLVIRAPCLTSLSLNFPYIRYRNGLSLEAGNSLVMASISVESDGSSQSYQTMILGNLWNVTSLDLKGFGAMAFLDKELDKFPIFDNLRTLSLSWCFLSEHDVHTFKALGRFLQKSPNLEKLSLQDFWVRPVVGPIEFPMLNNLRTLFLDECDLRDNFRILRHLLRRSPNLEKLSVRCCKLPEGSVGGKGKARKTHLWSRNLVRFQCHKLKSTEIIYEKGDKIQELVCLLLDISECAPMDTVTLTKV

SEQ ID NO: 28509 - DNA, 659 bp, Panicum virgatum
  misc_feature: Ceres CLONE 1884124
  misc_feature: Encodes the peptide sequence at SEQ ID NO. 28510
atcacaaccgacctccgatccacttctgctcaccagacactgctaagctagctagctgctttacacttcactcactagtcactagcagcttgatcattcgacgatcagtgagtgttatcatatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatcccaagcaagtgcggcgtcaacgtcggcgtgccaatcagcccaaacgtcgactgcgccaagattaactgataagatgctatggatggatgctcagctctttccttctctttgggtcaggcagctctccgctcaatcaataaactttttttctgtatacctacatgcatatatgtgcgtcatgcatctttttatttccatccacgcacgctttc

SEQ ID NO: 28510 - protein, 117 aa, Panicum virgatum; identical to SEQ ID NO: 12304
  misc_feature: Ceres CLONE 1884124
  misc_feature (28)..(113): Pfam Name: Tryp_alpha_amyl Pfam Description: Protease inhibitor/seed storage/LTP family

SEQ ID NO: 28511 - DNA, 718 bp, Panicum virgatum
  misc_feature: Ceres CLONE 1884126-R
  misc_feature: Encodes the peptide sequence at SEQ ID NO. 28512
caagaatacctctgagcaggcaggagggacctgatcgtctggatgcgaaccgcggcgctgccaacgttccggaagctgtacgggaggatcgaggtggacctccacgccgacgagctcaccgtgactctgcagaacaactacaacacgtacagcttcggcgggaagaagacgctggtgctgtcgaccgccggcgtgctgggaggcaagagcgacttcctcggccgcgggtacgtggtcatcggcatcgcctgcctcgcgctggcgatgctcctgactctgctctgcctcgccttcccactgaaagaggagcatctggcgctgcggtaccctttgtccggcagacctgcacggtgaccacgcatgcctagatcacgtacagattgaagccgtttctttttcaggcttggattcggttggtgattccttgcagggatccaacgaagaataacagctacagagctgcgtcgtgtatatatgcatccgacagtatatttacatgccactgccgcgcgtgcggtttgtacatgtctgaagttggtttgcttcccgtacattcagattcagacatgttggctgcctgcttacatatttcagattgagcagattcaaatgcatcaagcagtatacagattcaatcgacacatgttttgtgttgagagagagagagagagagagagagagaaactaaactgatgtctctttaccgatctcgccgtgt

SEQ ID NO: 28512 - protein, 103 aa, Panicum virgatum
  misc_feature: Ceres CLONE 1884126-R
  misc_feature: Functional homolog of the protein sequence given in SEQ ID NO 50291
  misc_feature: Useful for making plants with modulated nitrogen use efficiency
MRTAALPTFRKLYGRIEVDLHADELTVTLQNNYNTYSFGGKKTLVLSTAGVLGGKSDFLGRGYVVIGIACLALAMLLTLLCLAFPLKEEHLALRYPLSGRPAR

SEQ ID NO: 28513 - DNA, 632 bp, Panicum virgatum
  misc_feature: Ceres CLONE 1884126
gtactgttgcaagaaatatctcaaactcctctctctctctcgctctctctctcaacggcggggctgagcggcggcagcggtggggcctccactgctcctccctctctggcccttgcctccccggagctccctcctcccggcgccaacagatccaggcgccgcccctcccttcctctccgtgtcgggtaccctgcacgagctcgccagccagatcccgcggcggggcggagcctccaccgcgcggcctccggcatcccctgttccctccttgccgggtcggcgggtgatgaggagctgcggtggcctcccctgcgccctccgcgccgcccctcccctgctccgagcggcacggatccgcggatccgggttgcggggaaggactggcggcgagcaaggctcccttcttggcatatggctgcgcggcctcctccggcgcggctgcagcgtccgcgatggcctccctgataccggcggtaaaagtggtgcgcggcggcggcatctggccaggcgcggtgaatccccacggtggcgtccgctcgtctccatctcctcctcttcctcctcctctctctctctctcgtgcgtggggcagcaacggccctgctcctggcgctcccgccagccgtggcgag

SEQ ID NO: 28514 - DNA, 654 bp, Panicum virgatum
  misc_feature: Ceres CLONE 1884152
  misc_feature: Encodes the peptide sequence at SEQ ID NO. 28515
caccgccgcgcacgtcacgctctacgacttcaacatcgacctcaaccagtggagccgcaaagacgtggaggggtcgctgttcgtcgtcaagaggaactcgcagccgaggttccaattcattgtcatgaacaggcgcaacactgataatctggtggaggatcttttaagcgattttgaatatgaacttcagcctccatatttgttgtatcggaatgctgcacaagaagtaaatggtatttggttttataaccaacatgactgtgaagctgttgctagcctttttggaaggtaaatttccacgctgaagtggctggcctgatcttgccatcactcaacatatggatggatggtaactatctaggactgaacaatgccaacagaaggcaatttctctaggtggaaccacactgtgaactatacatgttgtagggcttaacttgggatgggatcttttggaacttgctaataaaaattgtttattactcggtttgataatatcaagtagctataatcttaataaccagttaatcccttctctaaaaaccattttctgtacatttgttgattgttccttcccaaagagctataacccatctcaaaagaagaggggagggggttggaaatgaaaagaaatgcaatgatctaagtcctgaa

SEQ ID NO: 28515 - protein, 96 aa, Panicum virgatum
  misc_feature: Ceres CLONE 1884152
  misc_feature (1)..(96): Pfam Name: DCP1 Pfam Description: Dcp1-like decapping family
TAAHVTLYDFNIDLNQWSRKDVEGSLFVVKRNSQPRFQFIVMNRRNTDNLVEDLLSDFEYELQPPYLLYRNAAQEVNGIWFYNQHDCEAVASLFGR

SEQ ID NO: 28516 - DNA, 1463 bp, Panicum virgatum
  misc_feature: Ceres CLONE 1884186
  misc_feature: Encodes the peptide sequence at SEQ ID NO. 28517
acactgcaagtccgcacgaccacacccattggcaaaacacaacacctccaaataacggttcagctcgagctgaaatgccttcacaaacaccaagagtagcagtagtgttcgtcctcactctcctcgtgctcgcgtcctcctcgctggccgtcgcggccgctgcgcaagccgagcccgaagcggcggcaccgccggcccacggcgtgtgcggcggcggcggcgcggacgcgggcgggggatgccacagcgtccccagggcgctgcggctgaagctgatcgccatcccggcgatcctcctcgccagcacggtcggcgtgagcctgccgctcgcctcccgctccgtgccggcgctccgccccgacggcgacctcttcgccgtcgtcaaggccttcgcgtcgggggtcatcctcggcacgggctacatgcacgtgctcccggactccttcaacgacctcacctcgccctgcctgccgcggaggccctgggcggagttccccttcacggcgttcgtcgccatgctcgccgccgtgctcacgctcatggtggactcgctcatgctcacgttccacagccggggcaaggccagcgccgcggtcgcgcaccaccacggccgccatggcagccctcctccgcaggagctcgtgaaccgccatggtcacgggcatctggacgacatgagtgagccggcggcgagctcggaggacgacgtggaggctggcagaacgcagctgctcaggaaccgcgtcattgttcaggttctggagatgggcatcgtggtgcactcggtggtgatcggcctcgggatgggcgcgtcgcagaacgtgtgcacgatccggccgctggtggcggcgctctgcttccaccagctgttcgaggggatggggctcggcggctgcatcctgcaggcggagtacggcgcccggacgaggtcggtgctggtcttcttcttctcgacgacgacgccgctcgggatcgcgctggggctcgcgctcaccagggtgtacagcgacagcagcccgacggcgctggtcgtggtcggcctgctcaacgcggcgtcggcggggctgctccactacatggcgctcgtggacctcctcgccgccgacttcatggggcccaggctgcagggaagcgtcaggctccagctcgtctgcttcctcgccgtcctcctcggcgccggcggcatgtccgtcatggccaagtgggcgtgatgtgtccgtcggagacgcgcagacagtaacacggcaattacgttaggtacaggtacttgtacgtgtgtgtatatatatgctcatgcatgctgtatgggctcccgcctcctgctatcaattttaccttctctgacgcggtagcggatttgaggtgtgaatattagaagtagtagtactgtactgtgttggaagatgatctacttgtaaagtgtaaatttgtgcgatgaataagataccaaaagccatgtacag

SEQ ID NO: 28517 - protein, 378 aa, Panicum virgatum
  misc_feature: Ceres CLONE 1884186
  misc_feature (63)..(375): Pfam Name: Zip Pfam Description: ZIP Zinc transporter
MPSQTPRVAVVFVLTLLVLASSSLAVAAAAQAEPEAAAPPAHGVCGGGGADAGGGCHSVPRALRLKLIAIPAILLASTVGVSLPLASRSVPALRPDGDLFAVVKAFASGVILGTGYMHVLPDSFNDLTSPCLPRRPWAEFPFTAFVAMLAAVLTLMVDSLMLTFHSRGKASAAVAHHHGRHGSPPPQELVNRHGHGHLDDMSEPAASSEDDVEAGRTQLLRNRVIVQVLEMGIVVHSVVIGLGMGASQNVCTIRPLVAALCFHQLFEGMGLGGCILQAEYGARTRSVLVFFFSTTTPLGIALGLALTRVYSDSSPTALVVVGLLNAASAGLLHYMALVDLLAADFMGPRLQGSVRLQLVCFLAVLLGAGGMSVMAKWA

SEQ ID NO: 28518 - DNA, 512 bp, Panicum virgatum
  misc_feature: Ceres CLONE 1884206
  misc_feature: Encodes the peptide sequence at SEQ ID NO. 28519
atccagttcccaatccgtcgagaagttcctgccggagccgtcgaatgctaatgcaactgaagcggcctcccccgatcctctcaagatgcaaatctttgttaagaccctcaccggctagaccatcactttggaggttgagtcgtctgacatcgttgacaatgtgcatgcctaaatccagggccaggagggcatccctccggaccagcagcggctgatcttccctggccaactccttgaggatgggcgcaccctaccacactagcacatcaagaaggaggccaccctccacctggtgctccgcctgcgtggtggtatgcagatatttgggaaaaacctcactggtcagacaatcaccctggaggtggagacttccgacgccgtcgacaatgtggaggcgaagatccaggacaaggagggcgtccccccggagcagccgcgtctgattttcgccggccagcagctggaggatggacgcaccctggtggactgcaacatccacaaagagtccaccc

SEQ ID NO: 28519 - protein, 66 aa, Panicum virgatum
  misc_feature: Ceres CLONE 1884206
  misc_feature (6)..(66): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50597
  misc_feature: Useful for making plants with modulated cold sensitivity
MQIFGKNLTGQTITLEVETSDAVDNVEAKIQDKEGVPPEQPRLIFAGQQLEDGRTLVDCNIHKEST

SEQ ID NO: 28520 - DNA, 695 bp, Panicum virgatum
  misc_feature: Ceres CLONE 1884220
  misc_feature: Encodes the peptide sequence at SEQ ID NO. 28521
aattaattttccgcgcttcgcttgtagacatctatccagcagagcgcagcaggatggtgtacgcgctcctgctggtcgccttggcggccgtcgccgccgcagcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgccaccgccagatccggagcatgttcctcgccctcgtcgcctccacggggctcaaggcctcctacgtcgccagcgtcgacgagtccgcgcgctccctcatcgcgtcctggcgcggccgcaagaccatcagcttctgcgaggaggcgaggaagttcccctacaaggtgatcatggagcaggttctgggcctgccgccggacggcccggtggccctccggatcctggaagagtaccagatcttcatgaaggggatcatctccctccctatcaccctccccgggacagcattttccaagggcgtcaaggcaaggaagaggatatccgagaccatggagaagttcatcgaggacagg

SEQ ID NO: 28521 - protein, 213 aa, Panicum virgatum
  misc_feature: Ceres CLONE 1884220
  misc_feature: SWISSPROT Homolog: EC 1.14.13.77 Taxane 13-alpha-hydroxylase
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERHRQIRSMFLALVASTGLKASYVASVDESARSLIASWRGRKTISFCEEARKFPYKVIMEQVLGLPPDGPVALRILEEYQIFMKGIISLPITLPGTAFSKGVKARKRISETMEKFIED

SEQ ID NO: 28522 - DNA, 540 bp, Panicum virgatum
  misc_feature: Ceres CLONE 1884221
  misc_feature: Encodes the peptide sequence at SEQ ID NO. 28523
cgtcacgctctactccgtgctcctctcctaccccgtcccccgctccctctccctctccgcgccgggccgcggcgccacctccttcgccctgaggcaggagacctaccggcgcgacccctacgcggccgccgcggcggaggccatcccgacgttctacgcgtacgccgcgtccgggtcggtctccgcggaggccgtgtacgccaactacggccgcgaggaggacttcgcctacctcgccgcccgcggcgtccacgtcgcgggcaaggtcgcgctcgcgctcgcgcggtacgggaggatccactgcgaggacatcgcgcacaacgcgcgcgccgcgggcgccgcggccgccgtggtgtacacggacccgctccagtacggcggcgcccccggggaggcgccgttcccggactcccggtggctgccgcccagcggcgtgcaggtgggcagcctgttccgcggcgtgggcgacccaaccacgccgatgtgggcgtcgtccgacggctgcgagcgcctcatcgtggaggaggccatgcgcaccga

SEQ ID NO: 28523 - protein, 179 aa, Panicum virgatum
  misc_feature: Ceres CLONE 1884221
  misc_feature (55)..(162): Pfam Name: PA Pfam Description: PA domain
  misc_feature: SWISSPROT Homolog: EC 3.4.17.21 Glutamate carboxypeptidase II
VTLYSVLLSYPVPRSLSLSAPGRGATSFALRQETYRRDPYAAAAAEAIPTFYAYAASGSVSAEAVYANYGREEDFAYLAARGVHVAGKVALALARYGRIHCEDIAHNARAAGAAAAVVYTDPLQYGGAPGEAPFPDSRWLPPSGVQVGSLFRGVGDPTTPMWASSDGCERLIVEEAMRT

SEQ ID NO: 28524 - DNA, 1908 bp, Panicum virgatum
  misc_feature: Ceres CLONE 1884224
  misc_feature: Encodes the peptide sequence at SEQ ID NO. 28525
cccaatcttggattcacctaaacccgatacctttcctcggggaccttgacgaaaacagccgccttttctcctgtgttttatataagccgctgccgcgccgggttgggttcccacacattgcattgcgatcgcgtctcctcctcctccacgccctgccttggtagcttgcacacacaagcgcgtcgttccttctctccttctctgtcgccgggaaagcgccgccgcgcacccccctcgcttgcgttccgtcccgttccctcgggggctcgatccggcaaaggcccgaccttccatggccatcgcctcccgcgtctcgaagcgcgcgctgtccaccctcgccgccgccaagctcccggaggcggtcgccgccgcggagccgctgccgccggccgcgccggcgccgtgcgagagggccggcggcagggtgctgcggttcgaggacaccgggcggctgttcgccggggagccgacgtcggcgctcgtgcgcacgctcgccgcgctgcaggcgctctccgtggggccgctggtcgacgccgcgaccgcggcgctgcggtcgccggcggtggccggcagcgcgctgggccgcgccgcggccagggccacggcgtaccgccacttctgcgcgggcgagaccgcggacgaggccgcggccgtcgtgcgccggctgtggcgcggcggcatgggcgggatcctcgactacgggatcgaggacgccgaggacggccacgcctgcgaccgcaacgccgccgggttcatcgccgccgtcgacgtcgccgcctcgctgccgccgggctcggcgagcgtgtgcatcaagatcacggcgctgtgcccgatcgcgctgctggagaagacgagcgacctgctgcggtggcagaagaagcacccgtcgttcagcctgccgtggaaggcgcactcgttcccgatcctgtctgactccagcccgctctacctcaccgcgtcggagccgcccgcgctgacggtggaggaggagcgcgagctggagctcgcgcacgagcggcttctggcggtgtgcgcgcggtgcgcggagcacggcatccccctgctggtggacgccgagtacgcgaccgtgcagccggccatcgactacttcacgctcgtcggcgcgctggcattcaacggcggcgaggcccgcgcggcggacggggagcgccccatcgtgcacggcaccatccaggcgtacctccgcgacgcgcgggaccggctggaggccatggtggccgccgcggagggcgagcgcgtgcgcctggggctcaaggtcgtgcgcggcgcgtacctgacccgcgagacccggctcgcggcctccctcggcgtgccgtcgccgatccacggcagcatccaggacacccacgactgctacaacggctgcgccgccttcctcctcgaccgcgtccgccgcggctccgcctccgtcatgttcgccacccacaacatcgagtcaggccaactcgcggcggcgcaggcgctggagctggggatccccaagggcgaccgcaacctgcagttcgcgcagctgatgggcatggcggacgggctgtcgctgagcctccgcaacgccgggttccaggtcagcaagtacctgccgtacgggccggtggagcagatcatcccctacctgatcaggcgcgccgaggagaacagaggcctcctctccgcctcctccttcgacaggcagctgctccggacggagctggcgaggagggtcaaggctgcggtggtggggcgtgagtgaggcgagcttgcggagcctgtgaggctgtgaagctggttgctgggacaagggcgagttgaaggctagaagctgtaaatacacccttcggtcttcaggcattgatgtatcctgaattttattgaataattgaatgaatagaacaatgttcttctaggatt

SEQ ID NO: 28525 - protein, 485 aa, Panicum virgatum
  misc_feature: Ceres CLONE 1884224
  misc_feature (114)..(469): Pfam Name: Pro_dh Pfam Description: Proline dehydrogenase
  misc_feature: SWISSPROT Homolog: EC 1.5.99.8 Proline dehydrogenase
MAIASRVSKRALSTLAAAKLPEAVAAAEPLPPAAPAPCERAGGRVLRFEDTGRLFAGEPTSALVRTLAALQALSVGPLVDAATAALRSPAVAGSALGRAAARATAYRHFCAGETADEAAAVVRRLWRGGMGGILDYGIEDAEDGHACDRNAAGFIAAVDVAASLPPGSASVCIKITALCPIALLEKTSDLLRWQKKHPSFSLPWKAHSFPILSDSSPLYLTASEPPALTVEEERELELAHERLLAVCARCAEHGIPLLVDAEYATVQPAIDYFTLVGALAFNGGEARAADGERPIVHGTIQAYLRDARDRLEAMVAAAEGERVRLGLKVVRGAYLTRETRLAASLGVPSPIHGSIQDTHDCYNGCAAFLLDRVRRGSASVMFATHNIESGQLAAAQALELGIPKGDRNLQFAQLMGMADGLSLSLRNAGFQVSKYLPYGPVEQIIPYLIRRAEENRGLLSASSFDRQLLRTELARRVKAAVVGRE

SEQ ID NO: 28526 - DNA, 710 bp, Panicum virgatum
  misc_feature: Ceres CLONE 1884231-R
  misc_feature: Encodes the peptide sequence at SEQ ID NO. 28527
atagtttctaactactatgatatgttgaactgctttaaggggtttgtgagatcccccgtctctgcactatttccacaactttccgggaggttgtttgttacatggggcatcttgtggagctttgctgagacacattcccacgttctcgttacttccttggtcctaagctggtctataactgaggtcataagatactctttctttggtttgaaggaagcatttggaattataccttactggcacctatggcttaggtacagtacatttcttgtgttatatcctatcggtcttgtcagtgagcttggcttaatctatgctgcccttcctttcatgaaggcatctggaaaatactgtctcaagatgcctaacaagtggaatttccccttcagctactactatttttgtattattttatccatcctctacattccagggtttccgtacttgttccattatatgctcacccaaaggaagaaggccttatcaaaggcaaaagctgcataatacttcaaaagagcttcctagttctggagtatccagtaacctgagaatggtggctcttgtttgcaacttaatcttcagtggaagtctgcagactggggacttgttagaatactactcttatattattatctgttgccaacagtgtttgattgcgaacagtgtttcggtgtaacaaggaaaaaagttaaattttccatggataaatt

SEQ ID NO: 28527 - protein, 167 aa, Panicum virgatum
  misc_feature: Ceres CLONE 1884231-R
  misc_feature (5)..(165): Pfam Name: PTPLA Pfam Description: Protein tyrosine phosphatase-like protein, PTPLA
  misc_feature: Functional homolog of the protein sequence given in SEQ ID NO 50911
  misc_feature: Useful for making plants with modulated drought sensitivity
IVSNYYDMLNCFKGFVRSPVSALFPQLSGRLFVTWGILWSFAETHSHVLVTSLVLSWSITEVIRYSFFGLKEAFGIIPYWHLWLRYSTFLVLYPIGLVSELGLIYAALPFMKASGKYCLKMPNKWNFPFSYYYFCIILSILYIPGFPYLFHYMLTQRKKALSKAKAA

SEQ ID NO: 28528 - DNA, 1407 bp, Panicum virgatum
  misc_feature: Ceres CLONE 1884231
actgcaactcttcaatggcggccggccggtcgatggttgggcggctctacctctccgtgtacaactgggttgccttctatggatggtctgatgctctgtctgctgtttttcggttccaaaccgagtttttgcgtgcatttttaattttgggattgggctccttgttggtttgattgggattcttggactttggatcatgcagggcccaggttctgtactacgcaacgttagcattgttggccagtggacatgagactgtctatgatgctgttgagcagccactgctgttcgcacagaccgctgccttactggaggttccttgaagcattagatacttttgcaatgaattgaataccacacgagagttctagaatttaaatctctatggaatcttcttaggtcgattttttaaaaaaaatttgtgccaagtacaacaataaagtctcgtgggatactccccttcttttatttacattgtcatgtattaggttttttctaagtcaaatttagccaactttgatcaaatttatagaaaaatgatatttgcaatactaaatttgtttcattgaacttattaccatgaaatatattttgatagtacatatgttgggtagtatagttgttgctatatttttctacatgcttagttaaagttagctaaatttgacttaagacaaacctaacacgatatgtaaataaaaacggagggggtaatagaaactcgtacactcaaaagaagagccatgctcaccaaccttttcttttgaaaaatcaaccgaaatgtacctagcccatagcaagatgatgcaatcactcatcaatatgtttctgacgccctagatatttactgtttcttccatcatagttatgcatttttgcatctttttatatttttaaacatgtggaataaaggttttgttttctcctgatgatgatggtctcactggtactacagattcttcatcctattttaggtaagaattgcttctctttcatttcaaaagcaagtgtcttacaaatagagtagttaggttatttccactatccttgtcagtctcgaaatttgtagtgcaccagactgaaaaaggataaaagaaatttccatgagttctgaaggactgttagttcctagcaattccgcttggtggaaactttagtaaaaaacattatgtttaggatctactggatattcttcgcattaagtttatccgtatgctggagttcatggtatttggtaaaaagatctcctacaaagcaatgaaatttcgggttgtccctattgtgaattttttggtaaaaagatccttttgggtgcacacataacaaaaaatacattgtactttcaattaatgtattagctattgagcatgcattgaaatttatattcattttttttcatgttgcctc

SEQ ID NO: 28529 - DNA, 1288 bp, Panicum virgatum
  misc_feature: Ceres CLONE 1884238
  misc_feature: Encodes the peptide sequence at SEQ ID NO. 28530
gtgctgaagccaatctgcaccccggaaatttcccgagccgaaatcgcaacaggaaggggagggagcacgcgagcgcaaaaccctagccccgctgctccgccggattcacctcctccttcctcctccctcgcgcgccgctcctctccgcggcgtccgcggctctccctccccgctccgaggagcgcaaggcctcccgccgcgccggccgccgtccgccaccgccgggtcgccgccagccatgtcttctcaggtcgatagccgcagccaatccgctgggaagcgcgcgcgcaccgacggcagccggcgtgaggacgactgggtttgccccagctgcaagaatgtcaacttcgccttccgcaccacttgcaacatgcgcaactgcaaccagtccaggccagcagatcacacggccatgcaaaagcctatgcagactccgccccactccaccacatcagggggttacatgggcccagggacgcctccatcgatgtaccttggtgggggtgctcccccgtatggcacctccatgtttaatggacctgcaatgccgccgcgctatggcattcctcagttccctgggagttcggcgtatccatatggatatggtggtcgcataccgatggggagcccctatgggctgatgcaaatggccgggccacctccatattctgggggatctatgatgggagcaggtggaatctatggaatgcccatggacagatatggcttaattcctcctagtcctggtgcaatgggcacaagggctggctcatattctgatgaaggttcccagaagaagcctgcaggagctgggcgtgataatgattgggagtgtccaaattgccacaacatcaacttcgcctttcgcacagtctgtaatatgagaaagtgcaacacaccaagacctgaaaaccagggatctaagcctgatggttcaagaggctcaaaaccaaagatgccagagggcagttggaagtgcgagcagtgcaataacataaactatccgttcagaacaaaatgcaatcgtcctcaatgtggagcagagaagccactgcagacaaacaatacaaatgattcagcaacagatcaggacaatcaggtctgtgtttcatgaccttcagtatgatcaggacatttggcacacctttattttgaacattaagttgcatattgaagttattgttaatcattttcttgcctcatgtttgcttgcgcatagcttgatatatcgtgtccttactgttacagtgagtcctagaacagtaatggggggtcaagaaggttcagc

SEQ ID NO: 28530 - protein, 291 aa, Panicum virgatum
  misc_feature: Ceres CLONE 1884238
  misc_feature (241)..(272): Pfam Name: zf-RanBP Pfam Description: Zn-finger in Ran binding protein and others
  misc_feature (193)..(224): Pfam Name: zf-RanBP Pfam Description: Zn-finger in Ran binding protein and others
MSSQVDSRSQSAGKRARTDGSRREDDWVCPSCKNVNFAFRTTCNMRNCNQSRPADHTAMQKPMQTPPHSTTSGGYMGPGTPPSMYLGGGAPPYGTSMFNGPAMPPRYGIPQFPGSSAYPYGYGGRIPMGSPYGLMQMAGPPPYSGGSMMGAGGIYGMPMDRYGLIPPSPGAMGTRAGSYSDEGSQKKPAGAGRDNDWECPNCHNINFAFRTVCNMRKCNTPRPENQGSKPDGSRGSKPKMPEGSWKCEQCNNINYPFRTKCNRPQCGAEKPLQTNNTNDSATDQDNQVCVS

SEQ ID NO: 28531 - DNA, 734 bp, Panicum virgatum
  misc_feature: Ceres CLONE 1884238-R
tgttgtttgtatcatagattgtcactcctctgctatgaattatcactactgttcatcatttttttttgttttgttaatgctgtgtttgtggtcgtttttcttttcaattcatggttttattttacaggtgtttttttctgaatggttggcgatggtaaccttttttaccttccaaaataatgttattagcgatgttagcaacttagcatgatgatctactaagatacttaggggagcacttggtagttaattcttgcttgtagtaactgttaggtctgaaacaagtcaatggtcgacatttcagttgcatgactgcatatgttactgttatcatcttccatgtcctccggggattaccgcgttcaagtttcaccattctcatgtgcttggttagaagaagtgctgcttggtgaaagtgatgtgcatcatcacattgtgcggtggtagaccatcaccttgcatgcttgtctcgattgtgactttttcactgacacagtgccattggaattagtttttttcatgtaacattacgaagcttttatcaaagctgcgacttctgcatgaatctcaagacaacagtgagcagacacagatggatcttcctggtgatgtggctggagcaccgatgagttctcacgtgttgtggatggcagcactcagtgagttgcagaacagtcttacaaactgatttgctaccgtttcatattgtgaaacaaaggtgagaaatttgcacc

SEQ ID NO: 28532 - DNA, 601 bp, Panicum virgatum
  misc_feature: Ceres CLONE 1884246
  misc_feature: Encodes the peptide sequence at SEQ ID NO. 28533
acggcagcctcctgctcgcctcctcctctgttcttcatcttcttcgttcttcacatccgccctccctctttctggtccggaggcgcctcgtcccgctccttcgccggcacaggatggcgctgctcacggcgccggcggtggccgcgctgctgctgctcttctggtccgcggcgtacggtgacgcccagctgccgtacaaggaccccagcctgcccgtgaaggcccgcgtcaaggacctcctcggccggatgacgctcgccgagaagatcgggcagatgacgcagatcgagcggaaggtcgcgtcgccgcaggtgctcaaggacaacttcatcggcagcctgctcagcggcggcgggagcgtgccgcggctgcaggcgacggcggcggagtgggtgagcatgatcagcgacttccagaaggcgtgcctgtccacgcggctgggcatcccgatgatctacggcatcgacgccgtccacggccacaacaatgtctacggcgcaaccatcttccctcacaatgtcgcgctcggagccaccagggatcctgatctggtgaagaggatcggtgccgcgaccgcgctcgaagtgcgagccaccggcat

SEQ ID NO: 28533 - protein, 162 aa, Panicum virgatum
  misc_feature: Ceres CLONE 1884246
  misc_feature: SWISSPROT Homolog: EC 3.2.1.21 Beta-glucosidase
MALLTAPAVAALLLLFWSAAYGDAQLPYKDPSLPVKARVKDLLGRMTLAEKIGQMTQIERKVASPQVLKDNFIGSLLSGGGSVPRLQATAAEWVSMISDFQKACLSTRLGIPMIYGIDAVHGHNNVYGATIFPHNVALGATRDPDLVKRIGAATALEVRATG

SEQ ID NO: 28534 - DNA, 1951 bp, Panicum virgatum
  misc_feature: Ceres CLONE 1884256
  misc_feature: Encodes the peptide sequence at SEQ ID NO. 28535
aacacaagaaatgaaccagttcctcccctcccagcaatcggcgctcaccatggactccgcgggcagcacggccgccaccgccgcgcccgcgcccaacggcgccgcagaccgcgccgcggccatcgacgacgacgacggcgtccccgaggtagccgcctgcatttcgtcgatgatcgaccgcgggggcagcgtcgagagccaccgcctcttcctggcgcgccgcaccacgctggagatgctccgcgaccgcgggtacagcgtcccggaggaggagctcgcgcgcaccctcccggagttccgcgcctggtgggccgacaagcccgagctcgaacgcctcgccttctccactactctcgcctccgacccgtccaacaaggtgaaagttgtgttctgtcgaccggaacctgtcaaaattgcagttatccgggagatttatagtggagtcaaagaagacaacttgtctagactgattctgatattgcagagcaaaataatgtctagagccaaagaatctattaaggagatcttcccatttaaagtcgatacattccaggttaggttttgtctaatattgttggatgctcttcacatttcgttcggtttctgtaagtaaagaactttggactctatttgcagtattgtgtctttcatcttgtaaatttgatattttgttgttttatcttatattaatatttgtatccaaaccaatgtgctcctccaatggtagatcacggaattactggtgaacattactaagcatgtcctgaagcccaagcatgaggtgttgactgcagaagagaaggccaagctcctgaaggaatataatgtggtggattcacaggtatgttcctctataatttgttggaagttactgctttgttgtacaggcattggaagtcatggtgccacgtcaattttgtagcctccttttgttacatcttgttgaatgcaataatgcagcctggtgtggcaataggctgttgcttttcattatacctgctgagttactgcaacaccataatttcaacacttgatcttgtttgcagcatgatcatggccataagggcactgcaatactgcaatttctggatgtcatgattgagactaatgaattatgaaattacaatgcggagtgccttgggttgatcacatagaaatgttgatgataatttgatgaacaccatcacttacattgtgctcactttgttgttgtgtttatgcatttttcactaaaatgtaacttcacgacattgaaactaacaatcatcccatattttgtactaatgtactgagagtgctgttatcatatagaagaaaacttgtttaattgcaattgcaaggtcaaatttgtttcactttctatttatgtagattcttattatatattgcaggctccttacataatgatatgcaaatcagaaactaaaactatgtttatagctgtcgtggtgataacacattttatttatcttgttagtggatccttaacatgcctgaagtgcatattacccttgttattaacttgggtgtttcccttggatatttattttgacagagctagctctgttgcaaagcaatttcgggccactatactgaaattggtgcctgtatctttcagttgcctcgcatgctggagactgatgctgttgctcgctaccacggccttggcaagggagctgttgttaaagttacatatgacagcgagcttactgggaaccatgtgacgtacaggtgtattttctgagggggcatgggtttccgcggatgatgtttctcgtaagcggttagtaaaataacttcgcggcagatgatactgcccttctgtaaaaataacttctcggcagatgatactgcccttctaggccagtgtaagcactctattatgtaggatgaggttatctgtaactgtaaggtgttggtaaaaattgcctcgcagcaaagttactaccct

SEQ ID NO: 28535 - protein, 187 aa, Panicum virgatum; identical to SEQ ID NO: 22599
  misc_feature: Ceres CLONE 1884256
  misc_feature (42)..(133): Pfam Name: RNA_pol_Rpb5_N Pfam Description: RNA polymerase Rpb5, N-terminal domain

SEQ ID NO: 28536 - DNA, 617 bp, Panicum virgatum
  misc_feature: Ceres CLONE 1884278
  misc_feature: Encodes the peptide sequence at SEQ ID NO. 28537
aaaccatccgccccaccggacaccaccacaccaacgggctcgctcgctcgctccagcctccgccccctcgccgcacacctccgcaaaaacccacctgattccgtgtaaaccctcaccgcgatccacggcaattcagcggccgcgatgcagggtctcgccccgcccacctctgtttccatacaccggccggggtccagggcggcccgggcccccagctcggtgaggttcgctccgcgcgcggtcagatccgccgagtgcctgccgccggcggcgttcaagcccgccgagctgccggccgccattgccgcgccgaggccctccgcgcccgcgcaggcctcgccgccgcggacggcggggaggaagaaggagctcaatttcttccagcgcgccgcggcggcggcgctcgacgcgtttgaggaggggttcgtggcgggcgtcctcgagcgcccccacggcctgccccggacggccgatccggccgtgcagatcgccggcaacttcgcgcccgtcggggagaggccccccgcccgcgagctcccggtctccggccgcatcccgccctttatcaacggcgtgtacgcgcgcaacggcgccaacccctgcttcgaccccgtcgc

SEQ ID NO: 28537 - protein, 157 aa, Panicum virgatum
  misc_feature: Ceres CLONE 1884278
  misc_feature: SWISSPROT Homolog: EC 1.13.11.51 9-cis-epoxycarotenoid dioxygenase
MQGLAPPTSVSIHRPGSRAARAPSSVRFAPRAVRSAECLPPAAFKPAELPAAIAAPRPSAPAQASPPRTAGRKKELNFFQRAAAAALDAFEEGFVAGVLERPHGLPRTADPAVQIAGNFAPVGERPPARELPVSGRIPPFINGVYARNGANPCFDPV

SEQ ID NO: 28538 - DNA, 457 bp, Panicum virgatum
  misc_feature: Ceres CLONE 1884401-R
  misc_feature: Encodes the peptide sequence at SEQ ID NO. 28539
  misc_feature (170)..(170): n is a, c, t, g, unknown, or other
catctgcataccctccttacccaactcctcgccaatcaccatataccactacagaatatccaccacctccgcagcaagcatacccacccccttcggcaggatatcctccatcatatccaccgcagccatatgggcaaccatatccgccacaaccatatggtcaaccatancccccccctccagaagcacagtccccatatccatctgcgccttaccctggtacctatccaccaagaccttattgatgtatcagcttcagtaaccacaagcaggggcatcaaaagcagcaaacaacaatggttattgctatatgatgtgtgcccgtgtttgggttctttgtttctagttatttggttattcttcctaactgaattctacatacgctgctgaactgttacatcgatctcaagtcaggtaaaggtctggatgggaaatcaaaaaggaatgtcatgaattc

SEQ ID NO: 28539 - protein, 80 aa, Panicum virgatum
  misc_feature: Ceres CLONE 1884401-R
  misc_feature: Functional homolog of the protein sequence given in SEQ ID NO 50391
  misc_feature: Useful for making plants with altered carbohydrate content
  misc_feature: Functional homolog of the protein sequence given in SEQ ID NO 50362
  misc_feature: Useful for making plants with altered cell wall content and/or composition
  misc_feature (56)..(56): Xaa is any aa, unknown, or other
SAYPPYPTPRQSPYTTTEYPPPPQQAYPPPSAGYPPSYPPQPYGQPYPPQPYGQPXPPPPEAQSPYPSAPYPGTYPPRPY

SEQ ID NO: 28540 - DNA, 1419 bp, Panicum virgatum
  misc_feature: Ceres CLONE 1884401
atcgtgccctgctcgcatcgcatcgcatcgcatcgcccagcgtcaatctctcaacagcaacccggtctcctctcctcccgccccccattggccattccctcgttcctcggttcctcctcctcggccctcgcccagcccggccggcgcccgcgctccgcatgtcaatccatgggctgatcctggaagtcagagtcaccgggtgccggaagctgcgggacacggagttcttcacccgccaggacccctacgtcgtgctcgagtacgccaccaccaagctccgcacccgcacctgtaccggtcggtacccacctctctatctgttcgttgtcttctttttttccccctccatctcaatgtcaacggcggacctgattgtggttgcgggcaaccgagcctgagattcaatttcaaactgggacgtgctacacggattcagactgcgggcgggcgccggaattcggcagtcgattcacctcagccttttgggcatactcgttcaattcgcctgattcagaggcattggctgaacgtgaactgtcggtattaacaaggccgtagtaggtgggtgggtgaacgggtcagctgctgctgctgccgcttcccgttaatctcgatgtggctgctgcccgctgcctcctccttggtcaccttacattacatgactcggtaagaaaaaagaaatattaggggatgggagcattttataagaaacccagctagaacattacagccaaattaaaacaaacggccaaaggaaggtgaatcaatgaacaggaaaaggcggcaaagcaaagcaatagctaacgggagaattcacagctcagggaccatagggaacaaataccactgatggtacacagcttcgatacggaggccaacagcctaccagctgggctgattctttcttactttgcgagtagcttctttgtgcctaagttatatgccctgtcgatgctctatatagcctttagctggcatcttcctagaatcggtataatgtgcttgattcttgattaaaaaggaattcggttcggtatggatttttaatgtaaccttttgctattcccacaccattgtgttttctaatcattactggctgacaactattacaaagagatgaacataccccgctgctgctagaagcacttgctttggatgggggaagaaacccaactttcgatgagaagttccatatacccctcattgaagggctccgcgagttgaatgttatcgtttggaacagcaacacattatcccacgatgacttcatcggcagtggcagagtatatctgcacaaggtgctcgcaaatggatatgatgattcctcatggccacttcagacacgccacatgagatctgctggggaagtgaagctcattatgcatgttgatgtctcagcaatgaagaacaaaatgggta

SEQ ID NO: 28541 - DNA, 534 bp, Panicum virgatum
  misc_feature: Ceres CLONE 1884418
  misc_feature: Encodes the peptide sequence at SEQ ID NO. 28542
acccactccactcaccacaccatccatggcgatggcgtcgccctccacggccgccgcttccacccttctcctccccgtcctcctcctcatcgccacctccacccactgcgccgccgccgtcgactcaccctcatccccgtacgcggccgcgctctcctccctcccgcacctccagacgctcaacctctccaacaacatcctcaactccactttccccgaagagatcatcgcgtcgctcaggagccttcgcgttctcgacctctacaacaacaacctcacgggcccgctcccggcggctctccccaacctcaccgaccttgtccacgtccacctcggcggcaatttcttctccggcagcatcccgagttcctacggccagtggagccgtatccgctacctggccctctccggcaatgagctcaccggcgagataccgccggagctcggcaatctgacgacgttgagggagctgtacctgggctacttcaacagcttcaccggcgggataccgcccgagctcgggaggctgcgggc

SEQ ID NO: 28542 - protein, 169 aa, Panicum virgatum
  misc_feature: Ceres CLONE 1884418
  misc_feature: SWISSPROT Homolog: EC 2.7.11.1 Non-specific serine/threonine protein kinase
MAMASPSTAAASTLLLPVLLLIATSTHCAAAVDSPSSPYAAALSSLPHLQTLNLSNNILNSTFPEEIIASLRSLRVLDLYNNNLTGPLPAALPNLTDLVHVHLGGNFFSGSIPSSYGQWSRIRYLALSGNELTGEIPPELGNLTTLRELYLGYFNSFTGGIPPELGRLR

SEQ ID NO: 28543 - DNA, 476 bp, Panicum virgatum
  misc_feature: Ceres CLONE 1884443
  misc_feature: Encodes the peptide sequence at SEQ ID NO. 28544
aagtaccacacgggacagaccagagcagcacagacgtcgccatggcctcccagctctccgccgccgtgccgcagttccacggcctgcgtggctacacctcgccccggtccgtggcggcgctgccgccggtgagggccggcaggaagcgggccaagggcatccggggcaacaacttcggctcggccacaagccaaatctgggtgctgtcgacaacgctgatgctggtcgcggggcggttcgggcgggcgccgtcggcaaaccggaaggcgacggcggggctgaagctggagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccattgtctgccttgtctctctcgccgccgggcggtg

SEQ ID NO: 28544 - protein, 131 aa, Panicum virgatum
  misc_feature: Ceres CLONE 1884443
  misc_feature (46)..(126): Pfam Name: PSI_PSAK Pfam Description: Photosystem I psaG / psaK
MASQLSAAVPQFHGLRGYTSPRSVAALPPVRAGRKRAKGIRGNNFGSATSQIWVLSTTLMLVAGRFGRAPSANRKATAGLKLESRDSGLQTGDPAGFTLADTLACGAVGHIIGVGIVLGLKNTGALDQIIG

SEQ ID NO: 28545 - DNA, 640 bp, Panicum virgatum
  misc_feature: Ceres CLONE 1884465
  misc_feature: Encodes the peptide sequence at SEQ ID NO. 28546
atcacacccaaccagcaaccaggcagagcacagagcagagcagcaagaggagtgatccgatcgagatggccgccgccaccatggccctcacctcccgcgcgctcgccggcaagccggcggccagcagcaggtacatgttcggcgggggccgcatcacgatgcgcaagaccgcggcgaagccgaagccggcggcggccggcagcccctggtacgggcccgaccgcgtcctgtacctgggcccgctctccggcgagcccccgagctacctgaccggcgagttccccggcgactacgggtgggacaccgcggggctgtcggccgacccggagaccttcgccaagaaccgcgagctggaggtgatccactgccgctgggccatgctgggcgcgctggggtgtgtgttcccggagctcctcgcccgcaacggcgtcaagttcggcgaggcggtgtggttcaaggcgggggcccagatcttcagcgagggcgggctggactacctgggcaacaacaacgcctgggcctacgccaccaacttcgtccccggcaagtgagcaagctcgatcgctatgtgaagctagcgacccgggggatcgcgcgtgtaccgtagacgtacgtattcgtatgtactgctacatactgc

SEQ ID NO: 28546 - protein, 161 aa, Panicum virgatum
  misc_feature: Ceres CLONE 1884465
  misc_feature (63)..(151): Pfam Name: Chloroa_b-bind Pfam Description: Chlorophyll A-B binding protein
MAAATMALTSRALAGKPAASSRYMFGGGRITMRKTAAKPKPAAAGSPWYGPDRVLYLGPLSGEPPSYLTGEFPGDYGWDTAGLSADPETFAKNRELEVIHCRWAMLGALGCVFPELLARNGVKFGEAVWFKAGAQIFSEGGLDYLGNNNAWAYATNFVPGK

SEQ ID NO: 28547 - DNA, 537 bp, Panicum virgatum
  misc_feature: Ceres CLONE 1884508
  misc_feature: Encodes the peptide sequence at SEQ ID NO. 28548
aagcagcagctagcatcacaagtaatccggccacacacaatcatcatccgatcctattgtcactctcgcacttgaaggttaaggtccaccacctcttccaccacaagaaggacgaggaggagcagcccaccggcgggtacggcggcgaggccgccaccgccgagtacacggagaccaccgtgacggaggtggtgtccaccggcgaggacgagtacgagaagtacaagaaggaggagaaggagcacaagcacaagcagcacctcggcgaggcaggcgccatcgccaccggcgccttcgcgctgtacgagaagcacgaggcgaagaaggaccccgagcacgcgcaccggcacaagatcgaggaggagatcgcggcggcggcggccgtgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggcccccac

SEQ ID NO: 28548 - protein, 162 aa, Panicum virgatum
  misc_feature: Ceres CLONE 1884508
  misc_feature (72)..(151): Pfam Name: ABA_WDS Pfam Description: ABA/WDS induced protein
AAASITSNPATHNHHPILLSLSHLKVKVHHLFHHKKDEEEQPTGGYGGEAATAEYTETTVTEVVSTGEDEYEKYKKEEKEHKHKQHLGEAGAIATGAFALYEKHEAKKDPEHAHRHKIEEEIAAAAAVGSGGYAFHEHHEKKKDHKDAEEAGGEKKHHHLFG

SEQ ID NO: 28549 - DNA, 659 bp, Panicum virgatum
  misc_feature: Ceres CLONE 1884515
  misc_feature: Encodes the peptide sequence at SEQ ID NO. 28550
ctcgctcgcatccgccgcccgcgatccgcgaacgctgagagggggacacagcgcgcaagatgagcagcggcggcggcgacaagtccggctcgggtggcggcggcggggcggtgaagacgccgtcggacttcctcaagtcaatcaggggccggcccgtcgtcgtcaagctcaactccggcgtcgactaccgaggtattctggcttgtcttgatggatacatgaacatcgcgatggagcaaactgaagagtatgttaatggtcagctaaagaacaaatatggtgacgcattcataagaggaaacaatgtattgtacatcagtacatccaagcgcacccttacagacggttcgtgagaggtgaaactgttaagatcttcagtgccggtcttgcaacttgatcgattatgagtgaattttatgtattactttcttttccattctcatcttctatctggtgagcgaaaattgcaaaaataaaatcttaactgaaatgaattgattggagttgtaccgacagctatgcttaacgttagcatcatggaactctgtccacatattgtgcactcaagatatgtggtggtaattcgacctgtagagatacagataagactctggtgtcatcaactaaaatgtctgctatctcaaatatttttgtgaatc

SEQ ID NO: 28550 - protein, 97 aa, Panicum virgatum
  misc_feature: Ceres CLONE 1884515
  misc_feature (23)..(88): Pfam Name: LSM Pfam Description: LSM domain
MSSGGGDKSGSGGGGGAVKTPSDFLKSIRGRPVVVKLNSGVDYRGILACLDGYMNIAMEQTEEYVNGQLKNKYGDAFIRGNNVLYISTSKRTLTDGS

SEQ ID NO: 28551 - DNA, 537 bp, Panicum virgatum
  misc_feature: Ceres CLONE 1884528
  misc_feature: Encodes the peptide sequence at SEQ ID NO. 28552
atcatagattgctcgcatccaacgaagtatacatagaaaatctaagctcgattatggatgcaagatatgttgctctgtgtttattcgtcatacttattttacatggagaccctacattagcagaaacttgtaggcagtttgttaaaccacatccattctgctttagtgctatgtgcaaggcgaattgttacttggaacgcaaattctctgatggttcatatgtaaagggatatgaatgtcaatcaaatgcattccactctgtgtgtgtttgctatttgtgcaaaaattagtcacttcaaatagaactcaagatatcctcttgtgttccaatccatcgtcataagtattgtctaaataattatatggtagcatagttcactagtaagctttcttctatccatagatagtattgattaactagtcatttttctagactgtttttttgctaatttctcatgtacgtttgcttggacaattctatgtcaagaaacacatgttttagtgctagatactttaataatagattgtattcctttt

SEQ ID NO: 28552 - protein, 78 aa, Panicum virgatum
  misc_feature: Ceres CLONE 1884528
  misc_feature: Functional homolog of the protein sequence given in SEQ ID NO 51284
  misc_feature: Useful for making plants with modulated salt sensitivity
MDARYVALCLFVILILHGDPTLAETCRQFVKPHPFCFSAMCKANCYLERKFSDGSYVKGYECQSNAFHSVCVCYLCKN

SEQ ID NO: 28553 - DNA, 1762 bp, Panicum virgatum
  misc_feature: Ceres CLONE 1884566
  misc_feature: Encodes the peptide sequence at SEQ ID NO. 28554
agctgcagctagcagctgctgcctttcggcctttcccaccgtttctctctctcctccccctctcatttccgtgctcctcccgttggagtacaaaaacttcctattccgcaatcgaagcttccagaaggcttcttcttccgtaccttccacccaacgcgaggggtctcgctcgttcccgcatctggaagctaaggtctccccggctcagatccggccgggctgctgcggtggcgagatggccgagcagggtggcgccaccggggaggctggcggcggcagcgagccccccgcgctcgcccccgccccggcgccaccgccggccgcggaggcggcggggcagaggtcgctgccgacgccgttcctgaccaagacgtaccagctggtggacgacccggcggtggacgacgtgatctcgtggaacgaggacggctccacgttcgtggtgtggcggccggccgagttcgcgcgcgacctcctccccaagtacttcaagcacaacaacttctccagcttcgtgcggcagctcaacacctatggatttaggaagatcgtgcccgaccgatgggagttcgccaacgactgcttccggcgcggggagaagcgcctgctctgcgacatacaccggcggaaggtagcgccggttccggccgcgccggcagcggctctggcgaccgccgccgcggcggcggcttccggggcggtgaccgtcgcggcggcgccgatccccatggccctgccggtgccgctgccgggctcgccggcgctatcctccgacgagcaggtgctctcctccaactccggctcggaccacccgcaggcggcgccgtccggctccgggggcgcgtccgcgtcgggcgacacgggggaggagaacgagcgcctccgccgcgagaacgcgcggctgacccgcgagctcgcgcagatgaagaagctctgcaacaacatcctgctcctcatgaccaagtacgcctcctcccagcagctcgacgcctccgcggcgctgtcctccgtcgtcaactgctccggcgagtcctcggaggccgtgcccccgccgccgcccctccccccggcgatcctcgatctcatgccctcgtgcccgggcctggccaccgcggccgcgggcctcgtcgccgacgcggaccccgaccaggccgcgaggctgttcggcgtttccatcgggctgaagcgggcgcgggaggacgacggcgacactggcgaggaggaagagccggcgggccacggcggctccggcgcggaggtgaagacggaggaggcgtcggatccgcgtcagcatccatcaggcagcagcaaggagccgtcgccggaccagcacccgtggcccatataccggcccacgcccgtgcacccctcgatgcggccctcctgcaacgggccggaccagggcgccgggtccgaccaagacgggtccaactccagcggtcgtcagaatccatgaacttctcgcagttcctcgtcagctctagactagagttgcagccatctacatgtacacggcatggaacatgtggaaccaaagaaatcgccgcactttcagtgggtttcgctcccttcgtagtccctgctgcccttgatcaaggcaaaaatggaagtgaggcggcaggcttgtgaagtccgcaaggtcggctagttatccatgtgttgtaggactatgagtttgagtttttttatgtaatcacaaactatgtaacaattcgttttcttcttcttatatgatgcggcagtgctcctgcctttaagtttc

SEQ ID NO: 28554 - protein, 406 aa, Panicum virgatum
  misc_feature: Ceres CLONE 1884566
  misc_feature (40)..(256): Pfam Name: HSF_DNA-bind Pfam Description: HSF-type DNA-binding
  misc_feature: Functional homolog of the protein sequence given in SEQ ID NO 51285
  misc_feature: Useful for biocontainment applications
MAEQGGATGEAGGGSEPPALAPAPAPPPAAEAAGQRSLPTPFLTKTYQLVDDPAVDDVISWNEDGSTFVVWRPAEFARDLLPKYFKHNNFSSFVRQLNTYGFRKIVPDRWEFANDCFRRGEKRLLCDIHRRKVAPVPAAPAAALATAAAAAASGAVTVAAAPIPMALPVPLPGSPALSSDEQVLSSNSGSDHPQAAPSGSGGASASGDTGEENERLRRENARLTRELAQMKKLCNNILLLMTKYASSQQLDASAALSSVVNCSGESSEAVPPPPPLPPAILDLMPSCPGLATAAAGLVADADPDQAARLFGVSIGLKRAREDDGDTGEEEEPAGHGGSGAEVKTEEASDPRQHPSGSSKEPSPDQHPWPIYRPTPVHPSMRPSCNGPDQGAGSDQDGSNSSGRQNP

SEQ ID NO: 28555 - DNA, 609 bp, Panicum virgatum
  misc_feature: Ceres CLONE 1884615
  misc_feature: Encodes the peptide sequence at SEQ ID NO. 28556
ctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcgccttctcaaccgagcagtcgatgctcgacgccatcgaggccatgaacggcaaggagctcgacggccgcaacatcaccgtcaaccaggcccagtcccgcggcggtggcggcggcggcggcggttacggcggcggtcgccgccggactccgagttcttcgaccgccgcaaggctgagctcgaggaggctaaccgccttcgcgaactcgatgaggaagagaaggcgcgggcctacctccaccaccaacacccctacaacctcaaggaggaagacgaggtcgacgacgacgacgatggcgaggtggaccatgaatcagaggggatgcattgcggcggatgggaggacaacgacgagcactacgcgtccacgaccacg

SEQ ID NO: 28556 - protein, 178 aa, Panicum virgatum
  misc_feature: Ceres CLONE 1884615
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVAFSTEQSMLDAIEAMNGKELDGRNITVNQAQSRGGGGGGGGYGGGRRRTPSSSTAARLSSRRLTAFANSMRKRRRGPTSTTNTPTTSRRKTRSTTTTMARWTMNQRGCIAADGRTTTSTTRPRP

SEQ ID NO: 28557 - DNA, 541 bp, Panicum virgatum
  misc_feature: Ceres CLONE 1884621
  misc_feature: Encodes the peptide sequence at SEQ ID NO. 28558
agtttccatcgacgagggcggcaagggggatccagggcgaccgaccatggcttacgtcgagagaggtgttgtgaaagacaagcggaccatatggcgactgagcataatctctgacttctttcgagctgttgtgaacttcatcagaatcttctttctcacaatgttctcagtggagaaaacagacaactacaggaaaggatatggttctggtaagaaatgggatggtggacctggtggtggcggacgcggcggaggtggcggcggcggcggtcagaatccccgtcattgttgagaaggccgagagaagcgatatccccgacattgacaagaaaaagtaccttgttcctgccgacctcacagttggacagtttgtctatgtggtacggaagcggatcaagctcagtgccgagaaagcgatcttcatcttcgtaaagaacaccctcccgccaacagccgctctgatgtctgccatctacgaggagaacaaggacgaggaccggtttctctacatgagctacagcggcgaggacaccttccggct

SEQ ID NO: 28558 - protein, 113 aa, Panicum virgatum
  misc_feature: Ceres CLONE 1884621
  misc_feature (13)..(113): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
MVLVRNGMVDLVVADAAEVAAAAVRIPVIVEKAERSDIPDIDKKKYLVPADLTVGQFVYVVRKRIKLSAEKAIFIFVKNTLPPTAALMSAIYEENKDEDRFLYMSYSGEDTFR

SEQ ID NO: 28559 - DNA, 610 bp, Panicum virgatum
  misc_feature: Ceres CLONE 1884632
  misc_feature: Encodes the peptide sequence at SEQ ID NO. 28560
acataggcatagccaggcaacacattacatagaagctcgatacaatggcgatccggaacatgcaggtggcgacgcgttcgctggacgcggacatgacggtggacgagttcaaggagtggctgcggcggttcgacacggaccgcgacgggcgcatcagccgcgacgagctgcggcgcgccatgcgcgccatccgcgcccgggtcacggggtggcggaacaaggaagggatcagctaaccccaacccgaacggcaacggcaccttcaacaacgccaaggggaacggccccatcaagttcccgcaaaaaaacctcgggctcaaaatcgtcgcccactgagctggtcgacgcaggtggcggctgggcgggccgggcggcggcaaaagctagctccatcaccatggtccatgggctagcagcagcacgccaccatctgcctgtccccgctaaaaataaaaacaactgcttgatcgaccgcttgcttgcttaaagctttgctttcttgaacgtactctatcaattcatgggctctgatatccctctgtgtgtgatctatgaaaggtgtgtatggcggctgccccctctgcaggggccagccctgccaggggtgccg

SEQ ID NO: 28560 - protein, 63 aa, Panicum virgatum
  misc_feature: Ceres CLONE 1884632
  misc_feature (21)..(49): Pfam Name: efhand Pfam Description: EF hand
MAIRNMQVATRSLDADMTVDEFKEWLRRFDTDRDGRISRDELRRAMRAIRARVTGWRNKEGIS

SEQ ID NO: 28561 - DNA, 584 bp, Panicum virgatum
  misc_feature: Ceres CLONE 1884700
  misc_feature: Encodes the peptide sequence at SEQ ID NO. 28562
aaccaacatcggcgcaacgcgcaagagccgcggccatcgaaagccttggcccttaagctttgccgcaccccccccccacccccccgcatcgccgggatttcgaatttcccctgcctcgaaaggggaaaatcctggtcttttctcttctctctcgggcgagttggcggcggcggcggggatcgcgatgggcgccgcgcgggaggagggcggcgaggggtaccggtcgtggtacctgagccgggaggacatcgagcgcgactcgccgtcgcggcgggacggcgtcggcgcggccaaagaggccgggctccgggccacctactgctccttcatccgcgacgtctgcctcaggctccaattgccgcagattacaatcgccacggcgatcctgctctgccaccgcttctacctccgtcaatcccatgctaagaacgagtggcagactattgcaactgtttgcatatttcttgcttcaaagattgaagacacaccttgctcattaaaaagtgtagtcattgtggcatatgaaacaatgtatcggaaaaacactgatgctgctaagagaattcaccaggaggaagttcttg

SEQ ID NO: 28562 - protein, 133 aa, Panicum virgatum
  misc_feature: Ceres CLONE 1884700
  misc_feature (13)..(128): Pfam Name: Cyclin_N Pfam Description: Cyclin, N-terminal domain
MGAAREEGGEGYRSWYLSREDIERDSPSRRDGVGAAKEAGLRATYCSFIRDVCLRLQLPQITIATAILLCHRFYLRQSHAKNEWQTIATVCIFLASKIEDTPCSLKSVVIVAYETMYRKNTDAAKRIHQEEVL

SEQ ID NO: 28563 - DNA, 368 bp, Panicum virgatum
  misc_feature: Ceres CLONE 1884702
  misc_feature: Encodes the peptide sequence at SEQ ID NO. 28564
tgcgctttccatttcgcttcctccccgtcctcctctcctggccgccggcttccccccttcctcctcttctctccttccagagcacgaggattcttccgaagcagaccacagcgaagccctaaccggagagggagagggagagggagatggcgctggggatatcctcgcgcggcggcgcgcgggcgaaggccgtgctccggcggccgcagggggcggccgtgtccgcgtggggggcgtacgcgggggcggggggcgaggagagcgacgtcctcgttctgggcggcgggcccggcgggtacgtcgcggcgatcaaggccgcgcagctggggctcaagaccacctgcatcgagaagagggggcaccctcgg

SEQ ID NO: 28564 - protein, 73 aa, Panicum virgatum
  misc_feature: Ceres CLONE 1884702
  misc_feature: SWISSPROT Homolog: EC 1.8.1.4 Dihydrolipoyl dehydrogenase
MALGISSRGGARAKAVLRRPQGAAVSAWGAYAGAGGEESDVLVLGGGPGGYVAAIKAAQLGLKTTCIEKRGHP

SEQ ID NO: 28565 - DNA, 693 bp, Panicum virgatum
  misc_feature: Ceres CLONE 1884732
  misc_feature: Encodes the peptide sequence at SEQ ID NO. 28566
catgccgcctcctccgtgtgcccagagcttcgagaagctgctccccaaatccgcctacgcttccccctcctcctccgcgaggtgaggaaaccctagcggaccgaccatggcgctgctcccgcgcacggcgcggctcgcgctcctctccaccccggcgatgtcgaagacggccgagtttgtggtctccaaggtggacagcctgatgaactgggcgcgcaagggctcgatctggcccatgaccttcgggctcgcctgctgcgccgtggagatgatgcacgccggcgcgtcccgctacgacttcgaccggttcggcgtcatcttccgcccctcgccgcgccagtccgactgcatgatcgtcgccggaacactcaccaacaagatggcgccggccctccgcaaggtttatgaccaaatgcctgaacctcgatgggttatctcgatgggcagctgtgctaacggtggtggatactaccactactcctactctgttgtccgcggatgcgaccgtattgttcccgttgacatctacgtccctggatgcccaccaactgctgaggcactactgtacggtgtcctccagctccaaaagaagatcaacaggcgcaaggatttccttcactggtggaccaagtgaagcaattgtctgttcttgtttgtgctcgcttgctatatttcttcgcatttgacctactg

SEQ ID NO: 28566 - protein, 175 aa, Panicum virgatum
  misc_feature: Ceres CLONE 1884732
  misc_feature (53)..(160): Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
MALLPRTARLALLSTPAMSKTAEFVVSKVDSLMNWARKGSIWPMTFGLACCAVEMMHAGASRYDFDRFGVIFRPSPRQSDCMIVAGTLTNKMAPALRKVYDQMPEPRWVISMGSCANGGGYYHYSYSVVRGCDRIVPVDIYVPGCPPTAEALLYGVLQLQKKINRRKDFLHWWTK

SEQ ID NO: 28567 - DNA, 518 bp, Panicum virgatum
  misc_feature: Ceres CLONE 1884772
  misc_feature: Encodes the peptide sequence at SEQ ID NO. 28568
gagctcggctcattgacagccctcccccttaggcttcccttctctctggctctctcctcccttggtcttccttccctggcggcgccgactgggcgagcagcagtgccattcgtcatcacgtcttcgtccagccctttgccggcgacgagcatccaccaggaaagcacctcattctcaaatgaagcatatatccaagattgttgctatactggtagcaatctcagccatctgggttgcactccttgaaacctcaactgttcctcgaagttatacttggctgcttccagtctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggccaatttcagcatttcacattcatgatcgttttgaaggatcaccattctgttccttggaatagactac

SEQ ID NO: 28568 - protein, 89 aa, Panicum virgatum
  misc_feature: Ceres CLONE 1884772
  misc_feature (1)..(86): Pfam Name: DPM3 Pfam Description: Dolichol-phosphate mannosyltransferase subunit 3 (DPM3)
MKHISKIVAILVAISAIWVALLETSTVPRSYTWLLPVYLVVALGCYGLFMVGFGLMFFPTCPQEAILLQQDIVEAKEFLAKKGVDVGSE

SEQ ID NO: 28569 - DNA, 1336 bp, Panicum virgatum
  misc_feature: Ceres CLONE 1884789
  misc_feature: Encodes the peptide sequence at SEQ ID NO. 28570
gagtggggtagtcaggcgaggcgagctcctccccgcgccgccgccaaaaccctcaaaaccccgagacgccggcggcgaggaagagagggcggaggcggagatggcgacgcgggtgaaggacgtggcgcggcggtcgacaaagaagtacgtggaggaggcgctgtaccggcggctgttccggaaggggtcgacgccgcaggcggtgagggaggaggtggacggcttcctcgacagccggaagcgggcgttcaagtgggaagtgggcttttgcgtccgccggatgcggcggaactcgctctaccgcccggcgctcaagctttctaaagttatggccagaagaggcatgaatcctactgtcagtgatcaagcaatccgcctggacctcattgccaaatcgagaggcattgctgctgctgagaagtactttttggacctcccagaaacttccaagactcatctcacatatggcgctcttctaaattgttactgcaaagacttgatgactgagaaggctgaggcacttatggagaaaatgaaggagctcaactttgcttttactgccatgtcgtataacagcttaatgacactgtacaccaaagtcaaccaacctgagagggtccccagtatcattcaggacatgaaggccgatgatgtattaccagatgtctttacttataatgtttggatgagggcgcttgcagctgtcaaggacataccaggggttgaaagggtgattgaagagatgaaacgggatggccgtgttgctcctgattggacaacatacagtaacctggcctccatatacgttgacgctggactgtttgagaaggcagaagctgctcttaaggagcttgagaggcggaacacttgcaatgacattgaagcataccagttccttattacattatatgggaggacacaaaatttagtggaagttcatcgtgtttggcggtcattgaagcagaattgtcctagaaaggcaaacatgagttatcttaatatgattcaggttttgtccaatctgaaggatttgcctgctgctgaagcctgtttcaaagagtgggaagcacaatacatccatccacctaagaagaacatgaagggcgcagaggcatccactacaaaaccagaatcttcaaccaatgcgcctagtaatgagtctaatgtcaacggaacaaagggagcggaggagctcgaactgaagcatccaaaatatgacatccgcgttgcaaatgctatgattagagcatatatcgcagagggtatgcttgacaaggctgaagctctgaaagagcgtgccaagatgcgtggcggaagactgaacgccaagacatgg

SEQ ID NO: 28570 - protein, 411 aa, Panicum virgatum
  misc_feature: Ceres CLONE 1884789
  misc_feature (120)..(154): Pfam Name: PPR Pfam Description: PPR repeat
  misc_feature (155)..(189): Pfam Name: PPR Pfam Description: PPR repeat
  misc_feature (190)..(224): Pfam Name: PPR Pfam Description: PPR repeat
MATRVKDVARRSTKKYVEEALYRRLFRKGSTPQAVREEVDGFLDSRKRAFKWEVGFCVRRMRRNSLYRPALKLSKVMARRGMNPTVSDQAIRLDLIAKSRGIAAAEKYFLDLPETSKTHLTYGALLNCYCKDLMTEKAEALMEKMKELNFAFTAMSYNSLMTLYTKVNQPERVPSIIQDMKADDVLPDVFTYNVWMRALAAVKDIPGVERVIEEMKRDGRVAPDWTTYSNLASIYVDAGLFEKAEAALKELERRNTCNDIEAYQFLITLYGRTQNLVEVHRVWRSLKQNCPRKANMSYLNMIQVLSNLKDLPAAEACFKEWEAQYIHPPKKNMKGAEASTTKPESSTNAPSNESNVNGTKGAEELELKHPKYDIRVANAMIRAYIAEGMLDKAEALKERAKMRGGRLNAKT

SEQ ID NO: 28571 - DNA, 827 bp, Panicum virgatum
  misc_feature: Ceres CLONE 1884789-R
  misc_feature: Encodes the peptide sequence at SEQ ID NO. 28572
cgcgaagcttcgacaccacctccagccaccaagacgcgttgtcagggacagccttccgcggcaggtgcgcgcgccggcggtgttcaagtgcgtgcgcgtgacgtccatcgaagacggcgaggacgagtacgcgtaccaggccatggtcaccatcaacggccacctcttcaaggggttcctctacgaccagggccccgacgacggccgtcacgcggccgccagcaacgaggactccgccgcgggggtgcccaacatctcggagctccacctcggagcggcgtccgcttccggtggagccggtggcagcggcgtcagggaaggcggctcctcgatggtggcgcccacggagctatacggcggcggcgccggacagcatcacattctcggcgggtcaagctacggcaacaccatcaactgagcaaggcctctggaacaagtttggagtaactctgtaacaacacaagctccaagcacatgggtgctacgggcagtcatgagctgtggagaactttttaaaattggagattgctgttgttgcgcaatcttgtcatcatcaaagctgctattatctcatgtacgtgtgatgatggcattggtccatatcgtcttgtcgactgttgtcaacgccgggaggcacggtcactgttcactttgcttctttattcggtgctgtagatagccgtgtggcgaacgcgtacagctcgggcaccgtgaattgtggtactactgtcttgcaaactgaatatttccatagtggctagctcttactgttccaggtcatgctcgctttgtcataggctacttttgcaactcaaaagacttactag

SEQ ID NO: 28572 - protein, 138 aa, Panicum virgatum
  misc_feature: Ceres CLONE 1884789-R
  misc_feature: The sequence is a functional homolog of SEQ ID NO 482 in the 10/666,642 US patent application
AKLRHHLQPPRRVVRDSLPRQVRAPAVFKCVRVTSIEDGEDEYAYQAMVTINGHLFKGFLYDQGPDDGRHAAASNEDSAAGVPNISELHLGAASASGGAGGSGVREGGSSMVAPTELYGGGAGQHHILGGSSYGNTIN

SEQ ID NO: 28573 - DNA, 658 bp, Panicum virgatum
  misc_feature: Ceres CLONE 1884795
  misc_feature: Encodes the peptide sequence at SEQ ID NO. 28574
agagaggagaggagaggaaaaggaaaaccccgaaacagaggagagagcatggagctctgcgtctccaccaccgcctccgccgcgcccttcgcgcccctccgcagcggcgcgtgccccgtcaccgccgtcccgctccgccggcgcctccaagctcgaggctggcgctgcgccagtgcggctgtgcctgatccagtgccgtccgaagagcccgcctccgcctcctccaccgccgtcgtcgtcacggacaagcccgattcgcctgccgacgagaaggttgaggaggttagcgccgcgtccagtggctccgcggaggcgcctgttggagagctggtgtcgtcggaggcgtcgccgtccccagatgatatcaacctggatgaaatactgagcaagttgaacattgaagtaactcccactttaatcctcactggagctggtgcctttgttgctttattggttctatcttccattgtttctgcaattgattcagttcccctgcttccaaaaattctggaactcgtcggaactggctactcaatatggttcattgcacggtatctcatttacaaggaaagcagagacaacctgtttgggaagtttgaagatctcaaacagaggattatttgagatgccaatgaatgatcttcgggcacacgtttag

SEQ ID NO: 28574 - protein, 191 aa, Panicum virgatum
  misc_feature: Ceres CLONE 1884795
  misc_feature: SWISSPROT Homolog: EC 6.1.1.9 Valine--tRNA ligase
MELCVSTTASAAPFAPLRSGACPVTAVPLRRRLQARGWRCASAAVPDPVPSEEPASASSTAVVVTDKPDSPADEKVEEVSAASSGSAEAPVGELVSSEASPSPDDINLDEILSKLNIEVTPTLILTGAGAFVALLVLSSIVSAIDSVPLLPKILELVGTGYSIWFIARYLIYKESRDNLFGKFEDLKQRII

SEQ ID NO: 28575 - DNA, 672 bp, Panicum virgatum
  misc_feature: Ceres CLONE 1884812
  misc_feature: Encodes the peptide sequence at SEQ ID NO. 28576
gagctcaacatttttctttagcttggtgtcagactatcagtagcacagagtaaccagagaagggaagagtgtcagtaattaggggagcggcaaactggcgatcgtccatgagaaacatcccgaggcgcttcttcaagaagaccatgccgacggcctcccaatctccagctctgacacctcgccggccaccaaggcggacgcggaggaggtcaagagggccggcaacgaagagtacaagaagggccgcttcgaggaggcgctcaggctctacgaccgcgcgctggtcatgtggccggacaacgccgcttgtcggggcaaccgcgccgccgcgctcactggcctccgccacttcggtgaggccgtcaaggactgcgaggtggcgctccggatcgatccgtcgtacggccgcgcgcaccagcgcctcacgtccttgcatatcaggctaggacacatcgaggatgctctgaagcacctctccctcgcgtcgcctcagcccgatcccctagagttggataaactgcaaacagtgcagaagcacttggggaagtgtctggatgcacggaaagctagggactggaagaccgtactaagggaagctgacgctgctattgcttctggagctgactcctctgctctgctcttggccactaaagcagaagcccttcttccgct

SEQ ID NO: 28576 - protein, 128 aa, Panicum virgatum
  misc_feature: Ceres CLONE 1884812
  misc_feature: SWISSPROT Homolog: EC 3.1.3.16 Phosphoprotein phosphatase
MWPDNAACRGNRAAALTGLRHFGEAVKDCEVALRIDPSYGRAHQRLTSLHIRLGHIEDALKHLSLASPQPDPLELDKLQTVQKHLGKCLDARKARDWKTVLREADAAIASGADSSALLLATKAEALLP

SEQ ID NO: 28577 - DNA, 495 bp, Panicum virgatum
  misc_feature: Ceres CLONE 1884813
  misc_feature: Encodes the peptide sequence at SEQ ID NO. 28578
ccactgtatccmgctcakctatcwtctatcccatcraccgasccgtttctgaratcactakcacgtggamsaacsaasgaatcccakcamgccaagccaatggaactccctcggaagctcttctcggcctgtcttcctcgtgctgctgcatgctacgwggcacacagacgtcggcgggcgcggtgggcgtggcggasgascgtacgtgcctgtcgcasagccacacgttccgtggcccctgcgagcayagggccmactgcgccracgtctgcasgacggacggcttccccgacggsaastgccgcggcttcsgccgccgctgcttctgcaccacgcactgccgggagtgatcgacccacgggagctgcatgcatgcgtgccttttagttgtgctgccgcctgccggtgttgaataatcggcrgcctagtgcgcccgtgtgtctwttttttmatcccctcgmtctgtttaatgaacgttttgatttttttttcctc

SEQ ID NO: 28578 - protein, 66 aa, Panicum virgatum
  misc_feature: Ceres CLONE 1884813
  misc_feature (18)..(64): Pfam Name: Gamma-thionin Pfam Description: Gamma-thionin family
  misc_feature (16)..(16): Xaa is any aa, unknown, or other
  misc_feature (17)..(17): Xaa is any aa, unknown, or other
  misc_feature (23)..(23): Xaa is any aa, unknown, or other
  misc_feature (36)..(36): Xaa is any aa, unknown, or other
  misc_feature (39)..(39): Xaa is any aa, unknown, or other
  misc_feature (42)..(42): Xaa is any aa, unknown, or other
  misc_feature (50)..(50): Xaa is any aa, unknown, or other
  misc_feature (55)..(55): Xaa is any aa, unknown, or other
MLRGTQTSAGAVGVAXXRTCLSXSHTFRGPCEHRAXCAXVCXTDGFPDGXCRGFXRRCFCTTHCRE

SEQ ID NO: 28579 - DNA, 1398 bp, Panicum virgatum
  misc_feature: Ceres CLONE 1884871
  misc_feature: Encodes the peptide sequence at SEQ ID NO. 28580
ccgcgtgttcccaccgacccaccccgcgcttccggttcctctgcactcgcatcgtggagacaagggggacaacccggacaagggcgtagcgcggggcgggcgggcgcggggggttcccatttgtgccggtctcttcattcgaccccagtttgcgaggctagcgtcgcgccgaggcggcggcggcggcggcgcgatgaacgcgcctgtagtcgatccatatcagggggaatttcccgagacaatcgaggagtacttgcatcatggtactatgaaatgtattgcgtttaaccgtacaggaacacttctggctgctggatgctcaaatggtagctgtgttatctgggacttcgaaacaagggggcttgcaagagaatttcgtgataaagattgcactgcacctataacaagcgtatcctggtccaggtatggccaccgtttgcttgcctctgctactgacaagtcattgacactttgggatgtgtcaagtggggaaaagattgcccgcataactctccagcagactccattacgtgccagtcttcaacctggttctccaaccccatctaattgtttggcatatcctctatcttctgcacctcttcttgttgatttgaatactggaagtaccacggtcctccctgtttctgtatctgagaatggtaacccacctgcacctaatccccgtaataaattcgcggatggtaccccaccttttacaccaacagctgcaacgtttgataagcatggggatctgatatatgtgggcaactctaagggagaaattttaatcgtagattcaaaaaccatccaggtacatgcagtaattcccatccctggtggaactgttattaaggatattgttgtaagccgggatggtcaatatcttctgacgaattctaatgatcgggtcattagagtctacaagaatattctgcctgttaaaggttctggagaggagattagaaacataagcaacaacagtaatggctgtggaagtcactatgataagttgaaagaaaatggtgcaagctgccttattctttcctgtgagctttcagatgccatcacaaagatacagtggaagacaccatgcttcagtggtaatggtgagtggatagttggtgcttctgcaaacaaaggagagcacaggttgcaaatatgggatcaaacagggcgacttgtaaagatccttgatggtccgaaggaagctctcattgatcttgcctggcatcctgttgaacctacaattgctacagtatctgtaacaggctttgtatacatttgggccaaggagcatgtagagaactggagtgcatttgctcctgattttgtagaaattagaagaaaatgaagagtatgtttgaacgagaagatgagtttgatctgaacccacgtgaa

SEQ ID NO: 28580 - protein, 385 aa, Panicum virgatum
  misc_feature: Ceres CLONE 1884871
  misc_feature (14)..(51): Pfam Name: WD40 Pfam Description: WD domain, G-beta repeat
  misc_feature: SWISSPROT Homolog: EC 2.3.1.48 Histone acetyltransferase
MNAPVVDPYQGEFPETIEEYLHHGTMKCIAFNRTGTLLAAGCSNGSCVIWDFETRGLAREFRDKDCTAPITSVSWSRYGHRLLASATDKSLTLWDVSSGEKIARITLQQTPLRASLQPGSPTPSNCLAYPLSSAPLLVDLNTGSTTVLPVSVSENGNPPAPNPRNKFADGTPPFTPTAATFDKHGDLIYVGNSKGEILIVDSKTIQVHAVIPIPGGTVIKDIVVSRDGQYLLTNSNDRVIRVYKNILPVKGSGEEIRNISNNSNGCGSHYDKLKENGASCLILSCELSDAITKIQWKTPCFSGNGEWIVGASANKGEHRLQIWDQTGRLVKILDGPKEALIDLAWHPVEPTIATVSVTGFVYIWAKEHVENWSAFAPDFVEIRRK

SEQ ID NO: 28581 - DNA, 508 bp, Panicum virgatum
  misc_feature: Ceres CLONE 1884885
  misc_feature: Encodes the peptide sequence at SEQ ID NO. 28582
gctcctaaaaaaaaaaagactccttccgtcctctcctacttcgcagaacggtccaaatccccaactgaaattttgcgcccaggcccttcgccggagacggcgtcggagctcccgtaccggggcgccgccgcggcgcacggctccgcctccaagcggcggggagtactccccgaagccctccaagccgctctcctggctctcgcgcgccgcccgctacgcccgccgccgagcagcggcccgtcttccccctcgccggcatgttattcgcggccgccctcttccccttctcctcctcctccccctcctccacatccgactcgtcctacgccgccgtgtccgcccgattcagacacctcgacatcgccgggtaccagcccttccgcgagtcctccgtcggcggcaaggggcccccgggaccgcggcggagcgcgctgcgggtgcctcgcgaccgggcggcgccgggttcctggggagacatctggtgaaccggatggagcagaggggcgac

SEQ ID NO: 28582 - protein, 75 aa, Panicum virgatum
  misc_feature: Ceres CLONE 1884885
  misc_feature: Functional homolog of the protein sequence given in SEQ ID NO 50981
  misc_feature: Useful for making plants with altered carbohydrate content
MLFAAALFPFSSSSPSSTSDSSYAAVSARFRHLDIAGYQPFRESSVGGKGPPGPRRSALRVPRDRAAPGSWGDIW

SEQ ID NO: 28583 - DNA, 394 bp, Panicum virgatum
  misc_feature: Ceres CLONE 1884922
  misc_feature: Encodes the peptide sequence at SEQ ID NO. 28584
gaaatccaaaccaccgccgccatggccgcctccctgattccctcctccgctctggtggcccccggccaggccccaggcccggcctccccccggcccccccccccccccttccccctcctccggcggccccggcaaaaaattcagaaccaacagcccttccggaatggaaggggccccccccgccaaccccaagccccccggaagaaaggccagggccagggcctggaacccgttcgccaacaagtacggcgcccacgtcgacggatacagcccaatctacaaagaggaggactggtctcccaccggtgacgtctacgtcggtggaaccaccggacttctgatctggtccgtcaccctcgtcgggctccttgccggcggcgccctccttgtttac

SEQ ID NO: 28584 - protein, 76 aa, Panicum virgatum
  misc_feature: Ceres CLONE 1884922
  misc_feature (2)..(76): Pfam Name: PsbR Pfam Description: Photosystem II 10 kDa polypeptide PsbR
MEGAPPANPKPPGRKARARAWNPFANKYGAHVDGYSPIYKEEDWSPTGDVYVGGTTGLLIWSVTLVGLLAGGALLV

SEQ ID NO: 28585 - DNA, 1514 bp, Panicum virgatum
  misc_feature: Ceres CLONE 1884925
  misc_feature: Encodes the peptide sequence at SEQ ID NO. 28586
aagcggccggggctggctccgcggctcgacagcccgcgcgaggttggccggcgcgtcggcgcccgcggccggtagccaccgccagccagaggctcgctggtttcgcgggggacgccgagcctgttcgagttttgactcactcgaccaacccggccggcgccgcgccagcttttctttcctttctttttcctggttgggtgatcggttggtgccggtgggctggcgcccgtgcgcctcgtgcccgcggcggcaacgtggacgcgcaaagtcctcggcgccgcggagtcctctcggctcgcgagcgcacatggcggcgagacgacgtgcggtggccgtctggctcgcctcgccggatagggatgttgcgctcgcgtcacgaccagggtttaacttttcggcgaaatttcgccgaaaattcggtttttttcgtttccgctagttaccgagatccgaaatttcggtatttttcgatatatttcgttttaaaattcaaaattcaacaaatttcgtccgaaattcaccgaaattccggaacggaattccgtttccgccgatcaccgggatttcaccggaaaacaaaatggtgaaccctggtcacgacgccgctggaaattaggtgacccgctgcggcctgcgggagcgctctcacgtcgctggaagttggtcgcgcacggggccggacagcggccggaacggtcaccgggacgcccccccccccccccagcaacatgagaagtagcattttccttcccgccttacctaacacacaaaaaggscaatcattcgtttctgggcgaaaaaaaaagtatcatttttcatgatagggatgaaaaacttgagtagtagttgagcatagacgtgtctgtcatccatggaacatccatgatccaacgatgaraaaaaaaagtcgggaaaatcgtctagccgtcaacttgacatagcatgkggacatgttccacacttctcatatccacsaagcttctttagacttttggcggataggctccaaaagtcctcttttttccggttacccatgctggcaaaatgaargcaaacaattttttacttgcaccgacagctctgcatatctgtcggtgtatcgcaaatatccattarctgttactcggttcctgaacaaaaaaaggcgcgtctgactaartagtaatccaccttgtgtcagttccttgccatgtgaatggacgataaattaagcagtaggcttactccaatttcatatcctaaactctcaagtcggcacagttattattgttcaattttttttcagtcaaccactggcactggcagctctgaactgatcccatttttgtccgttccgcctgacagattcctcaatgccggsgccttcggcaccggcgccgacggccacgtgctgccggcggaagccacccgcgcggcgatgctcgtgcgcatcaacaccctcctgcagggctactccggcatccgcttcgagatcctcgaggcaatcgccaagctgctccacgccaacgtcaccc

SEQ ID NO: 28586 - protein, 106 aa, Panicum virgatum
  misc_feature: Ceres CLONE 1884925
  misc_feature: SWISSPROT Homolog: EC 4.3.1.5 Phenylalanine ammonia-lyase
MDDKLSSRLTPISYPKLSSRHSYYCSIFFQSTTGTGSSELIPFLSVPPDRFLNAGAFGTGADGHVLPAEATRAAMLVRINTLLQGYSGIRFEILEAIAKLLHANVT

SEQ ID NO: 28587 - DNA, 340 bp, Panicum virgatum
  misc_feature: Ceres CLONE 1884925-R
aaggagtggaacggtgagcccataccgttgtgctgaacgtgttcttgcccgcaagaggagacaaaacccaacacacacacaaggaaaaccaaagtaaagcgtctcgagacagagcatttcaagaccattgcattgtgaagttgtgggatcagtgtaggtggtgatactatatatattctttccgttccctcgtagctaaagttcatgtgaatcttgctgtgttcctgttgctgagccggccatggcgtgcaatgtgcgtggcgtgggcatctgcatcaggtgaaattttttctactttttaacttgtataagttgggggtaaagtaaattattttgttcc

SEQ ID NO: 28588 - DNA, 655 bp, Panicum virgatum
  misc_feature: Ceres CLONE 1884954
  misc_feature: Encodes the peptide sequence at SEQ ID NO. 28589
acgccattgaacgctccggacctttcttcctccctccccaccaccgggcttatggcggatcagctcaccgacgaccagatcgccgagttcaaggaggccttcagcctcttcgacaaggacggcgatggttgcatcacaaccaaggagctgggtactgtcatgcgctcactgggccagaatcctacagaagctgagctccaggacatgatcaatgaggttgatgccgatggcaatggcaccatcgattttccagaatttctcaatcttatggctcgcaagatgaaggacactgactcagaggaagagcttaaggaggccttccgtgtgtttgacaaggaccaaaatggcttcatctccgccgctgagctccgccatgtcatgacaaaccttggtgagaagttaactgatgaggaggtggatgagatgatccgtgaggctgatgtcgatggtgatggtcagatcaattatgaggagttcgtcaaggtcatgatggccaagtgagccactgaaccataatctgaaggcggagaagattgtgcattgcatattagtcaagatgcaactcttatttcatcaacttgctgtgaaacattctattagctgtagttgctaaaaggacagtgcaattcctgctatgttcttccctcctgtgtgt

SEQ ID NO: 28589 - protein, 149 aa, Panicum virgatum; identical to SEQ ID NO: 12456
  misc_feature: Ceres CLONE 1884954
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 28590 - DNA, 671 bp, Panicum virgatum
  misc_feature: Ceres CLONE 1884965
  misc_feature: Encodes the peptide sequence at SEQ ID NO. 28591
cgttgaaaggaagaatgagtgccgtagtacagatgcgaggatcgatccctctcttttggtctcaagaggcttcacgactcagtcctaagcctgacatttttgtgcagagatatgatcccacatatgaagcaaccaaattacattttgatgatctcgcccagcgatatggacatcctatcataatactcaatttgataaagactgttgaaaaaaggccacgtgaaatgatgctcaggcgtgaatattttaacgcggttggatatcttaatcaaaatgtcccagaagagaagaagttgagattcatccactgggattttcataaatttgctaaaagcaaatctgcaaatgtacttggtgttttaggaaaagttgcgggtgaagcattggaccttactgggttttactacagcggaaagccaaaagtccagaagaaaaggtcaactcagcttagtcgaactagcactgcaagggatggttcccttgatatacgggttggttctggagatctttccaggctctcgagtaatgctgatgcacttagctctacaggctttcaggatataagaaaagaggctaacaaacaagagcctcttggtgatgctccttgttaccaaactggagtccttcgtacaaattgcatagattgcctggatcgcacaaatgttgcacag

SEQ ID NO: 28591 - protein, 222 aa, Panicum virgatum
  misc_feature: Ceres CLONE 1884965
  misc_feature (1)..(117): Pfam Name: Syja_N Pfam Description: SacI homology domain
  misc_feature: SWISSPROT Homolog: EC 3.1.3.36 Phosphoinositide 5-phosphatase
LKGRMSAVVQMRGSIPLFWSQEASRLSPKPDIFVQRYDPTYEATKLHFDDLAQRYGHPIIILNLIKTVEKRPREMMLRREYFNAVGYLNQNVPEEKKLRFIHWDFHKFAKSKSANVLGVLGKVAGEALDLTGFYYSGKPKVQKKRSTQLSRTSTARDGSLDIRVGSGDLSRLSSNADALSSTGFQDIRKEANKQEPLGDAPCYQTGVLRTNCIDCLDRTNVA

SEQ ID NO: 28592 - DNA, 1763 bp, Panicum virgatum
  misc_feature: Ceres CLONE 1884982
  misc_feature: Encodes the peptide sequence at SEQ ID NO. 28593
agactcatgcttgccttctatctaagcactactcctagttagttagctactggtatctctcatctcctccgatccttccttcttgaggctctctgatctatacagtagtacgtagtcaacagtagtataaactgtgtgtagtacgtagactgtctagctaatccaacagctagcacatcagagctgagcagtcaccattcttgtttatcgccacgccatgccgagcgcgactagcagactacctaatcttccagctgggttccgcttccaccccacagatgaggagctcatcgtccactacctcatgaaccaagcttcctccctcccatgccctgtccccatcatcgccgaggtcaacatctaccagtgcaacccatgggaccttcctggtaattaattaattatactatctgaattctgacagcaccacacaataatctatctcaaactattctttcttcaacttcagtttctgaacctaacaaaaattttccccatattccttttcgttttcttttcagccaaagctttgtttggagagaacgagtggtacttcttcagccccagggatcgcaagtaccccaacggcgcccgccccaaccgtgccgccggatccggctactggaaggccaccggcaccgacaaggccatcctgttgactccaacgagcgagaacatcggagtcaagaaagcccttgtgttctatggtggtaagcctcccaagggggtcaagacagactggatcatgcacgagtaccgcctcacaggagctaacaagaccaccaagcgtagaggatcttccatgagggtgagataaatttcccaatattctttttttttctcaattactatatactatgacgtttgctgatgttttttttttaattattgtggttgatttcagctggacgactgggtcctctgcaggatccacaagaagagcaacaattttcagttctctgacaaggaccaggagggctcaactgtggaggaggaagaatccctcaacaacaacatgatgaatggcacaattgcagcctcgcccaagtctgaagccaatgatgatcatgatcatcagttccatccgacgacgatgacgatgaccatgagcaagtcatactcaatcaccgatctactcaacaccatcgactactcggcgctctcacagctcctcgatgccccagctgaacctgaaccaccgctaatctacccaacaacaacacaaacacacgaatcactactcaactataacaacaacagccactacttcaatttgccacaagtagacgcatgttcagatcatgttgcgcctaattgcaacggtctgaagaggaagcgagtgatgaccatggatggtgctgaatcctctgccttggatggtagcagcagtagtaacttcagtggaaaactgaagctgccaagtgattcaataagaagcagcagccacagccattttggcagcacgacgagcagctactgcaaccagcagcagcttgtgggcctgctgagctatccattcctcgagatgcagtagtattgcaccgagagcttggtgtgaatccatacagctgaaacttgttcactgggtcaaacaaaccgagctgaggctgaggggtggttcttgcttgtgaccggaacatgaattcaaaatttctgaagcatttcattttcatgtaaaattaattaaaggttgtaaattagggaggtgtactacgtactgaaagtcacgtgtggatcaatgaaagatgaccacgttcgtttct

SEQ ID NO: 28593 - protein, 59 aa, Panicum virgatum
  misc_feature: Ceres CLONE 1884982
  misc_feature (11)..(59): Pfam Name: NAM Pfam Description: No apical meristem (NAM) protein
  misc_feature: The sequence is a functional homolog of SEQ ID NO 852 in the 10/374,780 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 853 in the 10/374,780 US patent application
  misc_feature: The sequence is a functional homolog of SEQ ID NO 854 in the 10/374,780 US patent application
  misc_feature: The sequence is a functional homolog of SEQ ID NO 1012 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 891 in the 10/374,780 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 890 in the 10/374,780 US patent application
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Functional homolog of the protein sequence given in SEQ ID NO 50324
  misc_feature: Useful for making plants with altered terpenoid content
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: Functional homolog of the protein sequence given in SEQ ID NO 50325
  misc_feature: Useful for making plants with modulated water use efficiency
  misc_feature: Functional homolog of the protein sequence given in SEQ ID NO 50326
  misc_feature: Useful for making plants with modulated light quality response
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 745 in the 11/479,226 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: The sequence is a functional homolog of SEQ ID NO 582 in the 10/666,642 US patent application
MPSATSRLPNLPAGFRFHPTDEELIVHYLMNQASSLPCPVPIIAEVNIYQCNPWDLPGN

SEQ ID NO: 28594 - DNA, 654 bp, Panicum virgatum
  misc_feature: Ceres CLONE 1885031
  misc_feature: Encodes the peptide sequence at SEQ ID NO. 28595
ctctcatttgccgcgctcgcgcgctcccgccccacacacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccaatcggtcgcggcgccgagggcccggaacgccaaacggggcgtcatccgctccgtgtccgcctccgcctccgcctccggctccggctccgtctccggctccggctccgtctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggcggggcggtcgctgcccgcggggctctgggccgagatcctcgacggcctggcgtgggtggaggagtacatgggcgcgcgcctcggcgacccgcaacgcccgctcctgctctccgtccgctc

SEQ ID NO: 28595 - protein, 178 aa, Panicum virgatum
  misc_feature: Ceres CLONE 1885031
  misc_feature: SWISSPROT Homolog: EC 2.7.9.1 Pyruvate, phosphate dikinase
MASVSRAVCGLQMPCLNGREAPAGRQSVAAPRARNAKRGVIRSVSASASASGSGSVSGSGSVSGRGQHCAPANAVADAAPITATKRVFPFGKGKSEGNRGMKDLLGGKGANLAEMSSIGLSVPPGFTVSTEACQQYQEAGRSLPAGLWAEILDGLAWVEEYMGARLGDPQRPLLLSVR

SEQ ID NO: 28596 - DNA, 690 bp, Panicum virgatum
  misc_feature: Ceres CLONE 1885036
  misc_feature: Encodes the peptide sequence at SEQ ID NO. 28597
ggcatacacctcctccctcaacctccccaagcacctgctcctccccaacccccgccggaccaggcacaggccctcctcctcctcctcctcctccgtctccttcgtccccaaggccgcggccaaggccaacggcgtcaacggccacgcgcccgagaagaagccgccgccgccgccgcccaacggcaaggcgctcatcgacggcgtgaacggcaagaagggggtgaacgggcacgtcaacagcaagaagggggtgaacgggcacgtcaacggccattcggaccggatccacctctcggtgagcacgggcggcggcggcccggggggccaggacggctccgggctccgcgtggcgttccagggcgcgccgggcgcctacagcgagttcgcggccaagacggcgctgcccgggtgcgacacgctcccgtgccggaccttcgcggacgcgctggcggccgtggagcggggcgccgccgaccgcgccatcctccccgtggagtccaccatggagggcaccgcgctgcggaactacgacctgctgctgcggcacggcctggtggtggcgcaggagatcaacctcttcgtgcactactgcctcctcgccatgccgggggtccgcgccgccgaagtgcgccgcgtcatcagccacccgatggcgctcgcgcactgcggccgcgcgctggcgcgccttcg

SEQ ID NO: 28597 - protein, 229 aa, Panicum virgatum
  misc_feature: Ceres CLONE 1885036
  misc_feature (116)..(228): Pfam Name: PDT Pfam Description: Prephenate dehydratase
  misc_feature: SWISSPROT Homolog: EC 4.2.1.51 Prephenate dehydratase
AYTSSLNLPKHLLLPNPRRTRHRPSSSSSSSVSFVPKAAAKANGVNGHAPEKKPPPPPPNGKALIDGVNGKKGVNGHVNSKKGVNGHVNGHSDRIHLSVSTGGGGPGGQDGSGLRVAFQGAPGAYSEFAAKTALPGCDTLPCRTFADALAAVERGAADRAILPVESTMEGTALRNYDLLLRHGLVVAQEINLFVHYCLLAMPGVRAAEVRRVISHPMALAHCGRALARL

SEQ ID NO: 28598 - DNA, 1336 bp, Panicum virgatum
  misc_feature: Ceres CLONE 1885039
  misc_feature: Encodes the peptide sequence at SEQ ID NO. 28599
gcagctagctcttcctcctatcattaggtgagaacagcagaaaccgctagcgctgtagcatccagagctatagctagcttgtggtcgagtcttccttattagcattgcgggggagaaagagatgggtagcctgggagaggttgatcatggcaaggggaagttccatggccatggccactctgatcccatcgtcgacgagctcaaccggctggagaatctcctcagagaaaaggagcgagagctaggaaatgcatacagtgaaatcaaaggcttaaaggtgacggaagctctgaaggacaaggctattgctgagctgagcaaggaactaaagaaacaggacgagaagatgagaagtttggaaaaacagcttgagcagaagaatttggatgtgaaacgattaagcaatgagcgtaaagaagcattgtctgcacagttcgctgcagaagcaacactccgaaggatccactcttctcaaaaggacgaggagtcagttcctttcgatgccatcattgcacccttggagtcagacataagaaagtacaggcatgagattgcagttctccaggacgacaacaaggccctagaacgacatgtaaagttgaaggaggtggcgcttgtcgaagcagggaacattttgcgtagcgcacttgagagggcactgattgtagaggatgttcagaaccagaacatcgaactgaagaaacagatggagatataccatgaagagaacaaattgttagaaaaggctaacagacagaaggtgctggaggtcgagaagctcacgcataccattattgagcttgaggagtccattcttgcgactggtgaggttgccaatgcagtgcacttctatcagaatcaggttgccaagttgaaggaggaaaagaaaactcttgagagggagctagctcgagccaaggtttatgtcaatcgtgttgcatcaacagcggcgaatgaatggaaagacgactctgataagctgatgcctgtcaagagatggcttgaagaacgaaggctcctgcagggagagatacaacgactgcgtgacaagataacaatagcagagaaatctgcaaagattgaagcccagcttaacgacaaactaaaagggaggctgaaatcactcgaagaagacatgagaaatgaaatatccaactcctctacaaaggaaattaccaaaaaagtcactcccggaagatcaacatctcaaccaagacaacccaacacagctagagtgtcgtctcaaccatcctcacctgaagccattaacaggaaaaaggccaatatctcaaccaagggcatcaatagcagggaaagtgttgaagcaacctaattt

SEQ ID NO: 28599 - protein, 403 aa, Panicum virgatum
  misc_feature: Ceres CLONE 1885039
  misc_feature (181)..(401): Pfam Name: Myosin_HC-like Pfam Description: Myosin II heavy chain-like
  misc_feature: SWISSPROT Homolog: EC 2.7.11.1 Non-specific serine/threonine protein kinase
MGSLGEVDHGKGKFHGHGHSDPIVDELNRLENLLREKERELGNAYSEIKGLKVTEALKDKAIAELSKELKKQDEKMRSLEKQLEQKNLDVKRLSNERKEALSAQFAAEATLRRIHSSQKDEESVPFDAIIAPLESDIRKYRHEIAVLQDDNKALERHVKLKEVALVEAGNILRSALERALIVEDVQNQNIELKKQMEIYHEENKLLEKANRQKVLEVEKLTHTIIELEESILATGEVANAVHFYQNQVAKLKEEKKTLERELARAKVYVNRVASTAANEWKDDSDKLMPVKRWLEERRLLQGEIQRLRDKITIAEKSAKIEAQLNDKLKGRLKSLEEDMRNEISNSSTKEITKKVTPGRSTSQPRQPNTARVSSQPSSPEAINRKKANISTKGINSRESVEAT

SEQ ID NO: 28600 - DNA, 543 bp, Panicum virgatum
  misc_feature: Ceres CLONE 1885040
  misc_feature: Encodes the peptide sequence at SEQ ID NO. 28601
actgatccgtctctgctttctcctgaagcaggtccatcttcaaaacactagctaagctgcttagctagctacccgccccaagaaacgttccatgcgagctcgcaatttagcagagctcgcaattgcaatcgagctgaggcagtcgtccggggcctcgtcctcgccgccgcagtcgccagctgaggtagagccccggcgcagccgccggggaggcgacaagcgagcgcgggacgccggtggcgggaaccacccgtcgtaccgcggcgtgcggatgcgggcgtgggggaagtgggtgtcggagatccgtgagccgcgcaagaagtcgcgcatctggctcggcacgttccccacgcccgagatggcggcgcgcgcgcacgatgccgccgcgctcgtcgtcaagggccccgccgccgtgctcaacttcacggagatggccgccgcgctcccgcacccggcctccgccgcgcaccgggacgtccaggaggcggcggtgcgctccgctaacgaggaaccaactgatctggagggaggctcggcattggg

SEQ ID NO: 28601 - protein, 150 aa, Panicum virgatum
  misc_feature: Ceres CLONE 1885040
  misc_feature (54)..(105): Pfam Name: AP2 Pfam Description: AP2 domain
  misc_feature: The sequence is a functional homolog of SEQ ID NO 2848 in the 10/374,780 US patent application
  misc_feature: The sequence is a functional homolog of SEQ ID NO 456 in the 10/225,066 US patent application
  misc_feature: Functional homolog of the protein sequence given in SEQ ID NO 51286
  misc_feature: Useful for biocontainment applications
  misc_feature: Useful for making plants with modulated flowering time
  misc_feature: The sequence is a functional homolog of SEQ ID NO 1234 in the 10/374,780 US patent application
  misc_feature: The sequence is a functional homolog of SEQ ID NO 610 in the 11/435,388 US patent application
  misc_feature: The sequence is a functional homolog of SEQ ID NO 628 in the 11/479,226 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 147 in the 11/479,226 US patent application
  misc_feature: The sequence is a functional homolog of SEQ ID NO 2214 in the 10/374,780 US patent application
  misc_feature: The sequence is a functional homolog of SEQ ID NO 692 in the 10/225,066 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: The sequence is a functional homolog of SEQ ID NO 692 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 2874 in the 10/374,780 US patent application
  misc_feature: The sequence is a functional homolog of SEQ ID NO 890 in the 11/435,388 US patent application
  misc_feature: The sequence is a functional homolog of SEQ ID NO 98 in the 10/225,066 US patent application
  misc_feature: The sequence is a functional homolog of SEQ ID NO 694 in the 11/435,388 US patent application
  misc_feature: Functional homolog of the protein sequence given in SEQ ID NO 51287
  misc_feature: Useful for making plants with modulated biomass
  misc_feature: The sequence is a functional homolog of SEQ ID NO 1050 in the 10/666,642 US patent application
MRARNLAELAIAIELRQSSGASSSPPQSPAEVEPRRSRRGGDKRARDAGGGNHPSYRGVRMRAWGKWVSEIREPRKKSRIWLGTFPTPEMAARAHDAAALVVKGPAAVLNFTEMAAALPHPASAAHRDVQEAAVRSANEEPTDLEGGSAL

SEQ ID NO: 28602 - DNA, 489 bp, Panicum virgatum
  misc_feature: Ceres CLONE 1885185
  misc_feature: Encodes the peptide sequence at SEQ ID NO. 28603
acctcatcgatcgagccagccgtccagccagtcgcctatatcctcgcctgctgcgcgcgtctctctgctctcctagggagatctcgcgcagcgcggtaacccaccttcccacctcgtcgccgtcgcagatggccggcctcaggatgaagctcgtctgcgccgccgccatggccgccgcgctcgtggcgtccgccgccaccaccacagaggccccagccccggctcccgcctgcgacgccgcagccacgacgccccacctgccagcgtccctgacgaccgccgcctccgagtacgctatctgctcgacgacgagacagctcaccttgcggccgctactgagacccatgcatccagccagctaggatacttggtagctacttaatgtccaagatatctagtagctctcaggtcatcgacgtcggtcgaatgaacatatggaataatcacggtgatttggtgaccggcgacaccagcctcgatggatgagaa

SEQ ID NO: 28603 - protein, 77 aa, Panicum virgatum
  misc_feature: Ceres CLONE 1885185
  misc_feature: Functional homolog of the protein sequence given in SEQ ID NO 50452
  misc_feature: Useful for making plants with altered carbohydrate content
MAGLRMKLVCAAAMAAALVASAATTTEAPAPAPACDAAATTPHLPASLTTAASEYAICSTTRQLTLRPLLRPMHPAS

SEQ ID NO: 28604 - DNA, 1291 bp, Panicum virgatum
  misc_feature: Ceres CLONE 1885266
  misc_feature: Encodes the peptide sequence at SEQ ID NO. 28605
actcgcagcagcagcacggcagagaccagagagagggtgtcagggcgcgagcagctcagggtccaccaacttcgcctggcccctcggagccagccagccagccattgactgctctgagcaggtgcgcttgggcgtctagcagtttggcggcttgggctttctgcgtgggtgccgcatcgtcccccacccccacctttgcatccttccatccccatcatcgcagcctttttccctccatcgccgccatgttgctttaaagctcaaagctcgtgggattggggtcgaagccgtctttcgccggaaagatgagccgtgtcgtccttgaggtagatgtgaacggcgaggagctcttcgttgttgacaagttctgcggtaggatcaggaggttggtggtcgccggcgcagcgtccgcgaagcggcctcggagggtagcgctgcacggcttccccggtggcgccgaggcgttcgagctcgtcgcgaggttgtgttacgccgacggcggctgcggcggcgcggtgaccgcggccaacgcttgcgtgctccgctgcgcggcggagttcttggatatggcggcggacgcgcccgaggcggcgtcgacggccgcgccgagcctggtgaggatgacggagaaggcgctcgaggagatgccgcactggccgtggcacgccgtcgtggacgccgtgaagcagtgccagcgcctgctcccgctcgccgacaccaccggcgcgttcgacgcggccgtggccgcgctggtgtcccacatgacggtgcccccgcctgccggggacgccacgccgacgagctcctcgccggagagctcggcgttccggttctcgtgcgacaccaagagcagcagcctcagcctgcgggggtcctgcatcagccgcacctggtggttcgaggacctcgtgtcgctccgccccggcacggtggagcgcgtcgccgcggcgctcgtggccaggggcaccgaccaccgcatcgtcgcccggttcctcttctactacctcaagtgccgcatcgccggcgcgagcgccgaggacaagaaggcgatgctggaggcgtcggtcaccgtcatgtccggcctcgaccggagcgcggtctcctgcaagggcctcttcggcatcctccggatcgccgcgccgctcaagctgaccgacgcgtgccagcaacggctcgtcgccatgatcggccccaagctggaccacgccacgctagacaacctcctcgtcccggcgccggcgggtacgggcagcctgtacgacctgaacctggtgctcaggttcttggaggc

SEQ ID NO: 28605 - protein, 328 aa, Panicum virgatum
  misc_feature: Ceres CLONE 1885266
  misc_feature (194)..(328): Pfam Name: NPH3 Pfam Description: NPH3 family
MSRVVLEVDVNGEELFVVDKFCGRIRRLVVAGAASAKRPRRVALHGFPGGAEAFELVARLCYADGGCGGAVTAANACVLRCAAEFLDMAADAPEAASTAAPSLVRMTEKALEEMPHWPWHAVVDAVKQCQRLLPLADTTGAFDAAVAALVSHMTVPPPAGDATPTSSSPESSAFRFSCDTKSSSLSLRGSCISRTWWFEDLVSLRPGTVERVAAALVARGTDHRIVARFLFYYLKCRIAGASAEDKKAMLEASVTVMSGLDRSAVSCKGLFGILRIAAPLKLTDACQQRLVAMIGPKLDHATLDNLLVPAPAGTGSLYDLNLVLRFLE

SEQ ID NO: 28606 - DNA, 771 bp, Panicum virgatum
  misc_feature: Ceres CLONE 1885278-R
  misc_feature: Encodes the peptide sequence at SEQ ID NO. 28607
cttgcagactacaacatccagaaggagagcacgctccacttggtgctccgcctgagaggtgggatgcagatcttcgtaaagaccctcactggcaagaccatcacccttgaggtggagagctccgacaccattgacaatgtgaaggccaagatccaggataaggagggcatccccccagaccagcagaggctcatcttcgctggcaagcagctggaggatggccgcacccttgcggactacaacattcaaaaggagagcacactccacctggtgctccgcctgaggggtgggatgcagatcttcgtgaagaccctcactgggaagaccatcaccctggaggtggagagctccgacaccattgacaacgtgaaggccaagatccaggacaaggagggcatccccccggaccagcagcgactgatcttcgctggcaagcagctggaggatggccgaacccttgctgactacaatatccagaaggagtccaccctccatttagtgctccgcctccgtggtggccagtaagccattggtcatccaagctgctgctgtacctgggtcgtctggtctctgccatgaagggcgtcttctttgaagtatctgtgtcgtttgtctaaactgtgtttggttttcatgaactggttgtgtccttgtgttcctgaaacagtcattgcggccgcagttggcttaagcatgaataagtaagactcaaatttgtgctctgtttatacattatgccagttctatataaattctatagcttttgagttc

SEQ ID NO: 28607 - protein, 174 aa, Panicum virgatum
  misc_feature: Ceres CLONE 1885278-R
  misc_feature (27)..(95): Pfam Name: ubiquitin Pfam Description: Ubiquitin family
  misc_feature (103)..(171): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
LADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 28608 - DNA, 1397 bp, Panicum virgatum
  misc_feature: Ceres CLONE 1885278
atcgcgtctcgtctcgtgttgttcccagaacacaaccaaaatccaaatcctcctcctcgcgagcctcgtcgatccctcacccgcttcaaggtacggcgatcctcctctcccttctcccctcgatcgattatgcgtgttccgtttccgtttccgatcgagcgaatcgatggttaggacccatgggggacccatggggtgtcgtgtggtggtctggtttgatccgcgatatttctccgttcgtagtgtagatctgatcgaatccctggtgaaatcgttgatcgtgctattcgtgtgagggtttttaggtttggagttgtgggggtagttctgatcggtttgtaggtgagattttccccatgattttgcttggctcgtttgtcttggttagattagatctgcccgcattttgttcgatatttctgatgcagatatgatgaataatttcgtccttgtatcccgcgtccgtatgtgtattaagtttgcaggtgctagttaggtttttcctactgatttgtctgatccattctgtttagcttgcaaggtttggtaatggtccggcatgtttgtctctatagattagagtagaataagattatctcaacaagctgttggcttatcaattttggatctgcatgtgtttcgcatctatatctttgcaattaagatggtagatggacatatgctcctgctactttgtgcttatacagatcatcaagattatgcagctaatattcgatcagtttctagtatctacatggtaaacttgcatgcccttgctacttatttttgatatacttggatgataacatatgctgctggttgattcctacctacatgatgaacattttacaggccattagtgtctgtctgtatgtgttgttcctgtttgcttcagtctatttctgtttcattcctagtttattggttctctgctagatacttaccctgctgggcttagttatcatcttatctcgaatgcattttcatgtttatagatgaatatacactcagataggtgtagatgtatgctcctgtttctctacgttgctgtaggttttacctgtggcaactgcatactcctgttgcttcgctagatatgtatgtgcttatatagattaagatatgtgtgatggttctttagtatatctgatgatcatgtatgctcttttaacttcttgctacacttggtaacatgctgtgatgctgtttgttgattctgtagcactaccaatgatgaccttatctctctttgtatatgatgtttctgtttgtttgaggcttgtgttactgctagttacttaccctgttgcctggctaatcttctgcagatgcagatcttcgttaagaccctcaccggcaagaccatcaccctcgaggtagagtcttctgacaccatc

SEQ ID NO: 28609 - DNA, 2016 bp, Panicum virgatum
  misc_feature: Ceres CLONE 1885298
  misc_feature: Encodes the peptide sequence at SEQ ID NO. 28610
atcatcagctcattcattctaatttctccatcatcagtttcagtttctcacatcaaccaaaaacacagctagctcgctcgttctctgattaatataatttctccatcatatatcatcgatcgtctgcattcattcaattcctagctaactacctagctagcttcacatcaaacccatcatagacacatacatacatgcatacatacagattcatggaggtcttcgtcgcagtcccagtccctgtccctgtcccaggggccgccgccatggccatggccatggccgcgcttgccctcctcctctgcgccgccttcatctacgccgcctggctctcgccggccgccaccaggcgccgcctccgccgggccggcttcgacgggcccaggccctgcttccccttgggcaacctgcccgagatcaccgcaactacgatggccgccgtcaaaacaacactgccgctgcttcctgcttcctcctcctccagcatcagcgatgtccacgccgccgtgttcccctacttcgcccggtggcgccaggccttcggcaaggtgttcgtctactggctgggcaccgagcccttcctgtacgtggccgacccggagttcctcaaggccaccaccgccggcgcgctgggcaagcgctggggcaagcccgacgtgttccggcgcgaccggatgcccatgttcgggagggggctggtgatggccgagggcgacgagtgggcgcggcaccgcaacatcatcgcccccgcattctccgccaccaacctcaaccacatgatcggagtgatgcagcggaccaccgccgggatgctggcgcgctgggccgacgccgtggccgccgggcagagcgtcatcgacgtcgaggccggcatcgtccggaacgcggccgagatcatcgccagggccagcttcggcctggacgacggcgacgaggccggggcccgggtgttccggaagctgcaggccatgcaggcgatgctgttccggtcgaaccggctggtgggcgtgccgctggcccggctgctgcaggtgcgcaagacgtacgaggcgtggaagctcgggcgggagatcgacgcgctgctcatggagatgatcgacgcgaggatgagtcgtcaaggcggcagcagcaagaagcaggaagacctgctgtcgctgctgcttgccgggaccggcagcggcagcaaggttatgagtatgacgcggcgggaggtggtggacgagtgcaagaccttcttcttcggcgggcacgagacgacggcgctggcgctgtcgtggacgctgctgatgctggcggcgcacccggagtggcaggaggcgctgcgggaggaggtggcggcggcgggcggcggcggcgacgagcagctggacgctgcccagctggggcggctgagcaagatggggtgggtcatgagcgaggtgctgcggctgtacccgccgtcgcccaacgtgcagcggcaggcgctggaggacatgaagggcatcccgcggggcaccaacatgtgggtggacgtggtggcgatgcaccgcgacccggcgctgtggggcgaggacgcgcacctgttccggccggaacgcttcgccagggaccccgtgcagggcgggtgccgccaccgcatgggcttcctgcccttcggcttcggcgggcgcatctgcgtggggaggaacctgacggccatggagtaccgggtggtgctggccatgctgctgcgccgcttccgcctcgaggtggcgcctcagtacaggcacgcgccgagggtcatgctctcgctcaggccagccgccggcatccacctccgcctcacgcccatccggaattagttagttgttaattaattaatttattattacctgcactgtactgtactgtacgcatgcctgccgcgcgcctaatataactactgtactctactactaactttttgctattctatacgtatatatatagtatatacggagtatgtggcattgatgtctttgacattttcagtaatatatataataattctttgcccgc

SEQ ID NO: 28610 - protein, 517 aa, Panicum virgatum
  misc_feature: Ceres CLONE 1885298
  misc_feature (63)..(511): Pfam Name: p450 Pfam Description: Cytochrome P450
  misc_feature: SWISSPROT Homolog: EC 1.3.3.9 Secologanin synthase
MAMAMAALALLLCAAFIYAAWLSPAATRRRLRRAGFDGPRPCFPLGNLPEITATTMAAVKTTLPLLPASSSSSISDVHAAVFPYFARWRQAFGKVFVYWLGTEPFLYVADPEFLKATTAGALGKRWGKPDVFRRDRMPMFGRGLVMAEGDEWARHRNIIAPAFSATNLNHMIGVMQRTTAGMLARWADAVAAGQSVIDVEAGIVRNAAEIIARASFGLDDGDEAGARVFRKLQAMQAMLFRSNRLVGVPLARLLQVRKTYEAWKLGREIDALLMEMIDARMSRQGGSSKKQEDLLSLLLAGTGSGSKVMSMTRREVVDECKTFFFGGHETTALALSWTLLMLAAHPEWQEALREEVAAAGGGGDEQLDAAQLGRLSKMGWVMSEVLRLYPPSPNVQRQALEDMKGIPRGTNMWVDVVAMHRDPALWGEDAHLFRPERFARDPVQGGCRHRMGFLPFGFGGRICVGRNLTAMEYRVVLAMLLRRFRLEVAPQYRHAPRVMLSLRPAAGIHLRLTPIRN

SEQ ID NO: 28611 - DNA, 657 bp, Panicum virgatum
  misc_feature: Ceres CLONE 1885309
  misc_feature: Encodes the peptide sequence at SEQ ID NO. 28612
acctcgcagtcatccccgagaaggagccgccgccgccgccgcgcaaaccctagcaggcttcgccgccgtcactcctcctcggggcgcaaccatggtggccacaaagaagacgaagaagtccacggacaacatcaacaacaagcttcagcttgttatgaagagcggcaagtacacgctcggctacaagaccgtcctcaggactcttaggaactccaagtcgaagcttgtgatcattgctaacaactgccctccccttcggaagtctgaaattgagtactatgctatgctggctaaggtcactgttcaccatttccatggaaacaatgttgacctgggtacagcctgtgggaaatacttccgtgtctgctgtcttagcattattgatccaggtgattcggatatcatcaagactacaccaggtgaccagtaaggaagagatgtcagtacccttcgcatcggtgttctgaactgttttagtgtattagtggatctttctggacttgttctttcacctcatattgtgttaacacagcatttacctgcctgtaatctgagatcttgggaacatagtcttgcattgaaaattttgttcctggaattgacactatcaatggagctgtggcctatggttgtccctcattttaggttcagctcgtt

SEQ ID NO: 28612 - protein, 112 aa, Panicum virgatum
  misc_feature: Ceres CLONE 1885309
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGDQ

SEQ ID NO: 28613 - DNA, 1336 bp, Panicum virgatum
  misc_feature: Ceres CLONE 1885312
  misc_feature: Encodes the peptide sequence at SEQ ID NO. 28614
gcatgcattctccgaagaagctgcaggtggatgctgtgcatttgcctgcctgtccatattggtcggattggggattggatggaccgcccacacggtccacaccgcaccacaccacacaagatttttttttttttgaaggggacgaaacgaaatatcgcggagactagacgagaaatcggtcgaccatgtcctccggcggcgacctccacctcgacggcgccggcctcatcctctccctccccgaggacgtcctcgccctcatctccgcgcacctccgcccccgcgacctcctcgccctctccgccgcctcccgccgcctccgccgcgcgctctccggcgccgccgccgacaaggcctggctcgcccagtgccgccgcctcctcccctcgccgccccacctcctcgcctggcgcgccgccgccgggggctcctccctcaccgtctgccgcttcctccactccgccgcgccgcttctcggcgccctctgggcccaccagaaccccgagctcggcaacctcgtcgccgccgtcccgggcttcctctccgtcgtcgccgcccgcgccatcccgcaggacctctccccgcgcctccgatgggcccccgtcttcgagctcctcgccgacgcccacggccgccccgccatcctcttcctccacggccaccagcccgccgacctcttcccggcccgcctcgcctccctccagccccacgccaacgtcctcttcctcgaggcccaaacccaccagggtgaggaccccatcgcctcctcctcctcctcgcaccaccacttcccccgcctcgccttcgccgaccgccgccgcctgctcgactccctcgtcgccgcctgccgcgtcacgctcccgcccgacctcgtcgccgccccgctcttcgcgcgcaccgacgaggacctcccgctgctctcggcgcggcgggaggcgatgctgcccctgcacagggaggccggagggggcatggtgcgcacacccgaggtccaggggctcctcctcctcgatgccaagaagaagccggcgcccaccgacggtggggagaggatccgcctgcagaggaccctctccgctgtagccgggtatgtcaagaacagcctgcgccagatggtgacgcgatcagtgtcagcaaattccagggctcaccatgtggacacaagacatctgccgttgccagacttcttgcacaccagtgagagcgccggcctgaccctccgcggcgctagaatgcggctatccacttacggagcatggccgagcatgcatgacaaccggttcgcactctacaagctcacgctgcaagcacccatgccaggaggggagtatgccgg

SEQ ID NO: 28614 - protein, 383 aa, Panicum virgatum
  misc_feature: Ceres CLONE 1885312
  misc_feature (13)..(60): Pfam Name: F-box Pfam Description: F-box domain
MSSGGDLHLDGAGLILSLPEDVLALISAHLRPRDLLALSAASRRLRRALSGAAADKAWLAQCRRLLPSPPHLLAWRAAAGGSSLTVCRFLHSAAPLLGALWAHQNPELGNLVAAVPGFLSVVAARAIPQDLSPRLRWAPVFELLADAHGRPAILFLHGHQPADLFPARLASLQPHANVLFLEAQTHQGEDPIASSSSSHHHFPRLAFADRRRLLDSLVAACRVTLPPDLVAAPLFARTDEDLPLLSARREAMLPLHREAGGGMVRTPEVQGLLLLDAKKKPAPTDGGERIRLQRTLSAVAGYVKNSLRQMVTRSVSANSRAHHVDTRHLPLPDFLHTSESAGLTLRGARMRLSTYGAWPSMHDNRFALYKLTLQAPMPGGEYA

SEQ ID NO: 28615 - DNA, 796 bp, Panicum virgatum
  misc_feature: Ceres CLONE 1885312-R
tccgaatgggtcatccatgtttattgcaaggatgtgtgaaccatcaacagaggcttttccctggcagactgatggggaatcccgaaatgtggatgttgagagaagctttgcaggagagggcattgccaatgggtatggcttcaggtaccctggctcaaagccaggttcactgtttgtcctccaggatggtcaacttgcatttgtttggagagagaccggagctgtgctcaccttgcaaagactcaatttggaggagttgctgaagaaaggggagcgtgtgcctgcgttgcagccagtaccaaattttgcttacctcacaaagtcttactccaacgtgttcactggtttccctggcagttcggcttcgcccaggtaaaaagcatgagtggagggtgtataaaatgaccacgatgcagagcaatggagaaattgtccttggatcatgttctgttcttcttccttgtcaagcaatacatgcgcttgcttctcctatggctctggaggttgggcgtcaccaggcaatggttccatgtctgtctgctgctaagggagaggagcaaaacataagccatacttctgaaaattcaaatacttcatcctgaaggaaataggcaatagcaaccacaccccatattccatactaaaactatttttcatgactgttgtaaatgaaatccgattggagtgtaaatttgttgtatatttcttttttgaaatgcaggtgattgatacaaactctatactgaacgattccttcatacgacgttgcttaatacattcatcatgtgtgttgagc

SEQ ID NO: 28616 - DNA, 3314 bp, Panicum virgatum
  misc_feature: Ceres CLONE 1885314
  misc_feature: Encodes the peptide sequence at SEQ ID NO. 28617
gatcttcagctacacagccgtcttcctcagactccagcttggtgctgccacaacggctgctcttgatccatcgcctttaatccatcgcctgcctcttcccggccactaaatcagcacagtctgcggccactaataatcaagggaacccgcagatctggatggtgccctcccctgcggccgagtatcgcaaggatcaccaccgtcccagccaagaacaaccgcttgccccggccttgaggtgcaggtacacatgatgctactgctgcagaggcccccaggtcttggtcttttccttggccggaatcgccgccatttcggactcaccaaagctccggcttgcttttccacttggacgccacaatgcctcctccaacattataaattgcctaatcgcatgcgcggctgaactggactggacgatgctctggccaagattcagatgcccatccacgagccattcttccctcatcgccatgcgccggctcctgctcctggtgctcgccgccgcgcccgccgccgccgctggtggcgagatggggtacacgcattgcgcctgcgacggagagggcggcggcggcggcttctggagcctggacaacatcttcaagtggcagaaagtcagcgacctgctcatcgccgcggcttacttctccatccccctcgagctcctctacttcgtcgccggcctccgccacctgctcccgttccgctgggtgctggtccagttcggcgccttcatcgtgctgtgcggcctcacccaccttctggcggccttcacctacgagccccaccccttcatggtcgtgctgctcctcaccgccgccaagttcctcacagcgctcgtgtccttcctcaccgccatcacgctgctcacgctcatcccgcagctgctgcgcgtcaaggtccgcgagagcctgctctggatcaaggcccgcgagctcgaccgcgaggttgtgctgatgaagcggcaggaggaggcgagttggcacgtccgcatgctcacccaggagattcgccgctcccttgaccgccacactgtgctctataccacgctcattgagctctccagggtgctcgcactcaacaactgcgccgtgtggatgccctcagaggacaagtccggaatgtgcctcacccacgagctccgccggggcagcgacggcgaagccgtcgtcagcgccgacgacaaggacgtcctcgaggtcaagagcagtgacggcgtcaagctgctgccgccggagtcggtccttgggtcggccagcggcggcggcaaggaggggaccggcacggtggctgcaattcggatgccaatgctcaaggtcgcggacttcaagggtggaacgccggaggtgatccagacgagctatgctgtgctagttttggtgccgcccagtgacaggaactgggcaccacacgagctggagatcgtcgaggtggtcgctgatcaggtggccgtcgcgctctctcatgcctcactgcttgaggagtcacaagcaatgcgtgacaggctggccgagcagaaccgtgagctgctgcaggcaaggcgggatgccctcatggccaatgaggccagggacgcgttccagcgtgtcatgagccagggaatgaggaggcccatccactccatcctagggctggtatctgtggtgcaggaggagggcctgacacctgagcagaagctcgtcatcgacactatggcgcggacagcaaccgttgtctcgacgctcatcaaggatgtcatggagatgtctgctgtcaaccaggagcgcttcccattggagacacggccattccacctgcagtccatgatcagggatgccgcttgtgtggcgcggtgtctttgtgacttcagggggtttggtttcgcggtgcacattgagaatgcgctgccagaccttgtcattggtgatgagcggcggattttccatgtcttgttgcacatggttggcaatctgattggccggatcgatgcggggaatgtcacgttccgggtgcgtgctgatgatgagacgatggaggatcagaggtgggatccatggaggccaagctactctggtgggcactcgtcagttaaatttgtgattggggtgaagcagcagcagagtgctgactcatcaagctcgcttgcacagttcttgcggaagccaagcgctgaggggtttgatctcaggctcagcttcagcatgtgtaggaagctcgtgcagatgatgcaaggaaacatctgggccattcttgatggccaaggactcccggagagcatgaccctagtcctgagattccagctgcaaccatcgctgtcgggctccagccttggaggatcatttgatctgcagtacccatcgccatcaaaccaaatcgcgggcctgaaggttctgctgatcgatgatgatgaaatcaacctagtcgtggctcgaaagctcctggagaagataggctgcactgtgtcctcactcccctcgggttcagggttcatgaactccgtggggcccacctctacctcattccagcttgtcgtggtcaacctggagatggcacaagtgaatcccttggatgttgcctccaggatcaggcaatacaggagcgcgcactggccctttgtcatggcgatgacatcagagcaaaacgtgtgggagaagtgcgctcagtcagggatcaacggcgtcctgaagaagccgcttgttctgcaggaagtaaaagatgagctgacacgaatccttcagaacacatgatgtttgctggtgttttttggctgctcgccaggagttttgtactctggagcttcttcaggttcaggttatatgcatgcttcttcttcacatggaggaggaggtgcatgagcaggttggtaggtgcctacttcgcggcgagcctgaacctcttggatatgctcaagccgtacgatcacatacgtgcgggtgagattgcgtatgcctgtctgcctccctcgctcgcatctgtatagcaatagccaatagctgccgtgaccgtgagagcagcacctgcagattgctcgatcgtcggtcgtgtgacggcggctggcatctatctattctgacgaggacggcggcggcggcggcgtcagggctgcaactggaaggctcgcttgttgactgttgtttcaatcacctgactagtcaacgtcacaggccggctagcactagtttcagcctaacgcggcagtttttaacttattgcttggttccaacttcaattagcaggcggcggggcatgtatgggtgtacgttcagtccttgggtagaataacaaaatctgtctgatgatcaatattgtaaccagaaaattattagtctgtt

SEQ ID NO: 28617 - protein, 751 aa, Panicum virgatum
  misc_feature: Ceres CLONE 1885314
  misc_feature (631)..(745): Pfam Name: Response_reg Pfam Description: Response regulator receiver domain
  misc_feature (185)..(330): Pfam Name: GAF Pfam Description: GAF domain
  misc_feature (366)..(431): Pfam Name: HisKA Pfam Description: His Kinase A (phosphoacceptor) domain
  misc_feature: SWISSPROT Homolog: EC 2.7.13.3 Histidine kinase
MRRLLLLVLAAAPAAAAGGEMGYTHCACDGEGGGGGFWSLDNIFKWQKVSDLLIAAAYFSIPLELLYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALNNCAVWMPSEDKSGMCLTHELRRGSDGEAVVSADDKDVLEVKSSDGVKLLPPESVLGSASGGGKEGTGTVAAIRMPMLKVADFKGGTPEVIQTSYAVLVLVPPSDRNWAPHELEIVEVVADQVAVALSHASLLEESQAMRDRLAEQNRELLQARRDALMANEARDAFQRVMSQGMRRPIHSILGLVSVVQEEGLTPEQKLVIDTMARTATVVSTLIKDVMEMSAVNQERFPLETRPFHLQSMIRDAACVARCLCDFRGFGFAVHIENALPDLVIGDERRIFHVLLHMVGNLIGRIDAGNVTFRVRADDETMEDQRWDPWRPSYSGGHSSVKFVIGVKQQQSADSSSSLAQFLRKPSAEGFDLRLSFSMCRKLVQMMQGNIWAILDGQGLPESMTLVLRFQLQPSLSGSSLGGSFDLQYPSPSNQIAGLKVLLIDDDEINLVVARKLLEKIGCTVSSLPSGSGFMNSVGPTSTSFQLVVVNLEMAQVNPLDVASRIRQYRSAHWPFVMAMTSEQNVWEKCAQSGINGVLKKPLVLQEVKDELTRILQNT

SEQ ID NO: 28618 - DNA, 526 bp, Panicum virgatum
  misc_feature: Ceres CLONE 1885318
  misc_feature: Encodes the peptide sequence at SEQ ID NO. 28619
cgcgcaccacctcctcgcccaccactgaacgaggcgagaaccggccgaagcggacgcgatgggcggcggcggcggcggcgcgcacagcggcaccgcctacaagggctacaccatcccgcacaacaagcgctggcataccgtctccggctagggcctctgcgccgtcgtgtggttttgggttttctacagagctaagcaagacggtgctgtgctcttgggcttgcgccatccttgggatgggcatgatgatcactctcatggacatggacatggacatggacatggacatgaggcatcatcatcgtcatcgtcgtcttctcattgagttcactacaacttgtcgctgacggtgatgcgatgcttgtcatgttccgactaaagtttcatttaataaattctgccccgttgcatgggagtcatgttgtttgctagttgcttatcacaaactgtttgcctgacaattgtgcttgtgtatttgatttcgagcttcaattgatatgttgtggaacatgaaagaagaacaagc

SEQ ID NO: 28619 - protein, 30 aa, Panicum virgatum
  misc_feature: Ceres CLONE 1885318
  misc_feature: Functional homolog of the protein sequence given in SEQ ID NO 51200
  misc_feature: Useful for making plants with modulated flowering time
MGGGGGGAHSGTAYKGYTIPHNKRWHTVSG

SEQ ID NO: 28620 - DNA, 1731 bp, Panicum virgatum
  misc_feature: Ceres CLONE 1885334
  misc_feature: Encodes the peptide sequence at SEQ ID NO. 28621
acttcaccagagaccagcagcggagcagagccagtagccagcagaactataccggcgatccgtcgagcgagcgccgccgcaccgtcgtcgttgtcccccggccccgccacggccagcaccggagttaatttggtggcgtatttacggtgttgatcgagcgtggcaaattaagccaacggcggaggccgtcttcggattccggtcacggccggatcgggaggtgatgagccggaggaattattgaagctcaaggatcaacccaaggcgcgcctaccgacctactacgcccggtgtcgtcgggccgggcataattgtggtcttgagttaaagttgggggacgaggtgggcagggcaggatccttctcgatcgtgagcctagtctgaccggcattggtatctgggggagggtgggcagcccaacgggccagaggtggttgccgacgatgaggtcacttctcatcggttcacgccggctagaatgtctcatgtttcttctctgaatccagatgatatggattgcgtaagtgaaccaatcatcaggagcaacagtatcagtaccagtgtgaatgaaaacctgagaagcagaagcatcaattctgaggctgacattcagcttgcaatcaagtctctgagggcatcaagcatgtcacacgagatggtagaggtctcgactgttcctgacaggagagatgaaggtgcatcctcaaggaagttcacaagaaccgccagccagcaaaggagtgtgataattgaggatctgccaccctccccagacgacaaaggggaaaaggagaaagaaggtgaggttgaagagaagagatggaagatacttgtctggaagactgctgtttatctcataactcttggcatgctcatcgcacttctaatgggacttaacatgtcctggactgcaatcactgcggctcttgttcttctggcacttgattttacagacgcacaggcttgccttgagaaggtgtcatactcactgctgatctttttctgtgggatgtttatcacggtcgatggcttcaataaaactggcataccaaacacactgtgggagttggtggaaccatattcacgaattgatagcgctaaagatgttgcacttcttgcagtggtgatccttatcctttcaaatgtggcatcaaatgtccccacagtcttgttgctcggtacaagagttgcagcttctgctgctgcgattcctcacgataaagagaggaaggcctggctcatccttgcatgggtgagcaccgtggccgggaacctcaccctcctgggttcggccgcgaatctgatcgtgtgcgagcaggcgaggcgggcccagttcttcggctacaacctcaccttctggagccacctccgattcggggtcccttcgaccatcgtggtcacggcgatcgggctgctcatcgtcatcagctactgaagcaagctggaggcagaagaagatagtgtaccagctgaagcagggatggataaatccttccttccaataagaaaagtactactacatgtaaaataggcttgtcctgtaactctcgtgtgtattgtgtctccgtatgtagtgtgtgtctccgtctgtgctcttgctcattcgtcgctgcccaggggagccgtgtgatgattgagcagactgcagatggctgaccgtacgtctagcctgaattttcgtttcctgaacggaggaggttgcgagatagggttaatgaagaatggtatggt

SEQ ID NO: 28621 - protein, 318 aa, Panicum virgatum
  misc_feature: Ceres CLONE 1885334
  misc_feature (1)..(264): Pfam Name: CitMHS Pfam Description: Citrate transporter
MSHVSSLNPDDMDCVSEPIIRSNSISTSVNENLRSRSINSEADIQLAIKSLRASSMSHEMVEVSTVPDRRDEGASSRKFTRTASQQRSVIIEDLPPSPDDKGEKEKEGEVEEKRWKILVWKTAVYLITLGMLIALLMGLNMSWTAITAALVLLALDFTDAQACLEKVSYSLLIFFCGMFITVDGFNKTGIPNTLWELVEPYSRIDSAKDVALLAVVILILSNVASNVPTVLLLGTRVAASAAAIPHDKERKAWLILAWVSTVAGNLTLLGSAANLIVCEQARRAQFFGYNLTFWSHLRFGVPSTIVVTAIGLLIVISY

SEQ ID NO: 28622 - DNA, 423 bp, Panicum virgatum
  misc_feature: Ceres CLONE 1885342
  misc_feature: Encodes the peptide sequence at SEQ ID NO. 28623
atctcacagaggaagaacgagtggaaatcgaagcagcagcagcaatggcggcatccatgatcacgtcctccgctctggtggcgcccgccagggcccagggcctgccgtcccacggccgccgcgcctcctccttcgccgtcctctgcggcaccggcaagaagatcaagaccgaccagcccttcgggattggaagtggcctccccgtccaccacgaagcctccgggaagaagggcaagggcaagggcgtgtaccagttcctccaacagtacggggcccacgtccacggaaaccgcccaatctaccaagaagaagaatggtctcccaccggtgaactccacgtcggtggaacccccggaattccgatctggtccgtccccctcctccggctccttggcggcggccccctccttggttaccacaccc

SEQ ID NO: 28623 - protein, 126 aa, Panicum virgatum
  misc_feature: Ceres CLONE 1885342
  misc_feature (35)..(126): Pfam Name: PsbR Pfam Description: Photosystem II 10 kDa polypeptide PsbR
MAASMITSSALVAPARAQGLPSHGRRASSFAVLCGTGKKIKTDQPFGIGSGLPVHHEASGKKGKGKGVYQFLQQYGAHVHGNRPIYQEEEWSPTGELHVGGTPGIPIWSVPLLRLLGGGPLLGYHT

SEQ ID NO: 28624 - DNA, 509 bp, Panicum virgatum
  misc_feature: Ceres CLONE 1885344
  misc_feature: Encodes the peptide sequence at SEQ ID NO. 28625
aagcactttgttcaaaaaaatggcaaccccaatggtggccacccgggcccagttcgcaaccaccaccggccgcctcagcttctcctcctcccccagcgaagcagcaagcgggcaattcccgccggtaagggcgtcggcgaaggcaatggcaacggaaaacctggccatcagggggaaccgcaccccccccaagtcccgcccctccaagctcggcgtccgccaagggcccaattgggggtgcaaaaaaagaaagttcccgggaacctactcgcccaaggaaacttgctacctgctgcagggaaaggtgaaggtgaacccggagggccacgggaagaacttctggaaaatcgccccggggaacctagtcgtcttccccaagggcataagctgcacctggaacgtcgccaaggccgtcaacaagcactacaacttcaagtagcctcccccgctgccgcccatgccaaattaccctggaatggcacgcattatcagaaatttgttgaccgcct

SEQ ID NO: 28625 - protein, 139 aa, Panicum virgatum
  misc_feature: Ceres CLONE 1885344
  misc_feature (61)..(136): Pfam Name: Cupin_3 Pfam Description: Protein of unknown function (DUF861)
MATPMVATRAQFATTTGRLSFSSSPSEAASGQFPPVRASAKAMATENLAIRGNRTPPKSRPSKLGVRQGPNWGCKKRKFPGTYSPKETCYLLQGKVKVNPEGHGKNFWKIAPGNLVVFPKGISCTWNVAKAVNKHYNFK

SEQ ID NO: 28626 - DNA, 698 bp, Panicum virgatum
  misc_feature: Ceres CLONE 1885351
  misc_feature: Encodes the peptide sequence at SEQ ID NO. 28627
actgccaagctagctagcagcttcaattccttctctcccttttcctcaaacaaaacttggttatctcccgttggtccatcccccccagcagctcgccatttatctctgtcatgcatcttctccgtccttttgttctctccgtgctccttttcgtcatcatcctgcacgcaccctcgccctccgccgccgcagacacgctccgacgcggccatgcacttgccggccacgacaagcttgtctcgggcaatggcaagttcgcgctcagcttcttccaactccaaacaggggcctcctattacctcggcatatgttttgataaagtccccgtgctgacccccgtgtggacagccaacagggacaatccgatctccaattccacttcgccggagctcatcatttccggcgacggcaacatggttgtcttagctcagggcaccaccatctggtctacccgggcaaacacaacaaccaatgacaccgtcgctgtgctcttgggcaatggcaacctagttctacggagctcctccaacccttcactcacattctgggaaagcttcgactacccaacagacaccatgctacctggtgtaaagattggatggaacaaggtcaccggcttgaaccgccgacttgtttcgaggaagattccatcgatctgtcctcgggtctatactcctcgaggatggaccacgatgggg

SEQ ID NO: 28627 - protein, 195 aa, Panicum virgatum
  misc_feature: Ceres CLONE 1885351
  misc_feature (73)..(181): Pfam Name: B_lectin Pfam Description: D-mannose binding lectin
MHLLRPFVLSVLLFVIILHAPSPSAAADTLRRGHALAGHDKLVSGNGKFALSFFQLQTGASYYLGICFDKVPVLTPVWTANRDNPISNSTSPELIISGDGNMVVLAQGTTIWSTRANTTTNDTVAVLLGNGNLVLRSSSNPSLTFWESFDYPTDTMLPGVKIGWNKVTGLNRRLVSRKIPSICPRVYTPRGWTTM

SEQ ID NO: 28628 - DNA, 665 bp, Panicum virgatum
  misc_feature: Ceres CLONE 1885352
  misc_feature: Encodes the peptide sequence at SEQ ID NO. 28629
atcgctcgcccacctgggaggcggggaccgccgccgccgccgccggtaggagttggagatgtcccatcccgccgactccgcctccacgccgccggctccaaacgccggcacgccacaaagggggcgggacaaggtggtgattgtgatgggcgccacgggcgccggcaagtcgcggctggccgtcgacctcgcggcccacttcgccggcgtcgaggtggtcagcgctgactccatgcaggtctaccgcagtcttgacgtcctcaccaacaaggttcctctgcacgagcagaaaggtgttcctcatcatctccttagcgtgatcgatccctccgtcgagttcacttgccgcgatttccgcgactatgccgtgccgatcatacaggaaatactggatcgcggtggcctccctgttattgttggcggtacaaacttctacatccaggcccttgttagcccattcctctttgatgacatggcacaagatatgcagcactctactttgaatgatcacccagatgatatagggcttaccagtgatgatgaaggcggtgggtatgagcgcttgaaggagatcgatcctgtcgcagcccaaaggatccacccaaacgaccatagaaaaataaaacgctaccttgagttatatgcgaccacaggtgccctacccc

SEQ ID NO: 28629 - protein, 202 aa, Panicum virgatum
  misc_feature: Ceres CLONE 1885352
  misc_feature (59)..(202): Pfam Name: IPPT Pfam Description: IPP transferase
  misc_feature: SWISSPROT Homolog: EC 2.5.1.8 tRNA isopentenyltransferase
MSHPADSASTPPAPNAGTPQRGRDKVVIVMGATGAGKSRLAVDLAAHFAGVEVVSADSMQVYRSLDVLTNKVPLHEQKGVPHHLLSVIDPSVEFTCRDFRDYAVPIIQEILDRGGLPVIVGGTNFYIQALVSPFLFDDMAQDMQHSTLNDHPDDIGLTSDDEGGGYERLKEIDPVAAQRIHPNDHRKIKRYLELYATTGALP

SEQ ID NO: 28630 - DNA, 337 bp, Panicum virgatum
  misc_feature: Ceres CLONE 1885362
  misc_feature: Encodes the peptide sequence at SEQ ID NO. 28631
caaagtattgatgatacgtcatactcggagcttgaagtaggagcagatgatactgccacattggataaaataattgattccttgacttctcttgctaatgcacacgggggaaatcacaatgctcggaaagagactgaactatctctgaagataggaaaagtcaatgagtgtggaactggtgacatcgtggataaagaagggccgaaggttttgattcttggagctggaagagtttgtcgaccagcggcgcagtttctagcatcttaccccaacatatgtagctacggtgctgatgaccatagcaccgatcaaattcatgtcattgtggcatctctgt

SEQ ID NO: 28631 - protein, 112 aa, Panicum virgatum
  misc_feature: Ceres CLONE 1885362
  misc_feature (1)..(68): Pfam Name: Saccharop_dh_N Pfam Description: LOR/SDH bifunctional enzyme conserved region
QSIDDTSYSELEVGADDTATLDKIIDSLTSLANAHGGNHNARKETELSLKIGKVNECGTGDIVDKEGPKVLILGAGRVCRPAAQFLASYPNICSYGADDHSTDQIHVIVASL

SEQ ID NO: 28632 - DNA, 716 bp, Panicum virgatum
  misc_feature: Ceres CLONE 1885395
  misc_feature: Encodes the peptide sequence at SEQ ID NO. 28633
acgcatcttcgtttcgccccttctcttccttcccgcttcctacgcggccgcccccaaacccaatcctcgcgtcgtccccaaccaaaccctagcgcatcgccaagcgcaacgcaaaggccggaggtcatggcggcggcgttgccgggacagctcaacctcgacgagtcgccgtcgttcgggtcccgcagcgtcgactgcttcgagaagctcgagcagatcggggagggcacctacgggcaagtattcatggcgaaggagatggagacgaaggaaatcgtggcgctcaagaagatccgcatggacaacgagcgagagggcttccctatcacggccatccgcgagattaaaatcctcaagaagctgcaccaccagaacgtcatcaatctcaaagagatcgtcacctcaccagggccagagagagatgagcaggggaagccaattgagggaaataagtacaaggggagcatttacatggtcttcgagtacatggatcatgacttgacagggctgtcggacaggcctggaatgcggttcaccataccacagattaagtgctacatgaagcaactccttttgggtcttcactactgtcacatcaatcaagttctgcatcgagatattaaaggatctaatctcttgatagacaatcacggtatcttaaagcttgctgattttggcctggcaagatcatattcatatgatcacactgcgcacct

SEQ ID NO: 28633 - protein, 196 aa, Panicum virgatum
  misc_feature: Ceres CLONE 1885395
  misc_feature (25)..(196): Pfam Name: Pkinase Pfam Description: Protein kinase domain
  misc_feature: SWISSPROT Homolog: EC 2.7.11.22 Cyclin-dependent kinase
MAAALPGQLNLDESPSFGSRSVDCFEKLEQIGEGTYGQVFMAKEMETKEIVALKKIRMDNEREGFPITAIREIKILKKLHHQNVINLKEIVTSPGPERDEQGKPIEGNKYKGSIYMVFEYMDHDLTGLSDRPGMRFTIPQIKCYMKQLLLGLHYCHINQVLHRDIKGSNLLIDNHGILKLADFGLARSYSYDHTAH

SEQ ID NO: 28634 - DNA, 694 bp, Panicum virgatum
  misc_feature: Ceres CLONE 1885420
  misc_feature: Encodes the peptide sequence at SEQ ID NO. 28635
cacatctgtggagcatgcgccgcagcaaagcaaacttcttccgtcttgtcagtgtgctctctggtcctgtgaccattggcaggtggtttgagcttgtccgctcttggcagcgcccggtgcattcatgccttgctgtattcacattcctggtatttgtcacaatgccggagctgattcttccaacagcctttctggccatggcattcacaggcctctggaggtacagagtccgcccaaggcacccacctcacatggagatgaggctgtctcatgcagacggagctactgcagatgagcttgatgaagagtttgatacgttcccttcgagccgtggagatgtcgtgcgcttcacgtatgaccgccttcgcagtgtagctgggagggtgcagacagtggttggtgatattgcaacacagggtgagaggatgcagggcctgctcagctggcgtgactcgagggcgacacttcttttctccattgcctgtgtcctcgctgctgtcattgcttattgtgtgcctatgaaggtgatgattgggctctggggactgtacgccttgcgtccgccaagattcagaagcaggatgccatctccactgatgaacttcttccgaaggcttccttccagggctgacatcctgctctgatgctagtgatttctattgatggctggctgtggatgagctgctggccttct

SEQ ID NO: 28635 - protein, 213 aa, Panicum virgatum
  misc_feature: Ceres CLONE 1885420
  misc_feature (59)..(213): Pfam Name: PRT_C Pfam Description: Plant phosphoribosyltransferase C-terminal
HLWSMRRSKANFFRLVSVLSGPVTIGRWFELVRSWQRPVHSCLAVFTFLVFVTMPELILPTAFLAMAFTGLWRYRVRPRHPPHMEMRLSHADGATADELDEEFDTFPSSRGDVVRFTYDRLRSVAGRVQTVVGDIATQGERMQGLLSWRDSRATLLFSIACVLAAVIAYCVPMKVMIGLWGLYALRPPRFRSRMPSPLMNFFRRLPSRADILL

SEQ ID NO: 28636 - DNA, 660 bp, Panicum virgatum
  misc_feature: Ceres CLONE 1885429
  misc_feature: Encodes the peptide sequence at SEQ ID NO. 28637
aaccttgcctctgccctcctcagatccgcgcgcctgcctgctcgatttgctctgctccccgcttgccccgcccttcgtctccgcctgatgatctccgcgcctctgcgcgcgccggccgccgccggggcgccgccgttccggcccgcctccgcggccgggcgcaacgagctccggggcccctcctgtcccggccacaccgacgagcgtccgcgccgccgtggccgccgccatcgtcgcggcggagcctgccgaggtcgactacagctcgagcttctcggtgttccccatggaggcctgcgagctgctcggcggcgacgcctgcagcgcgcagatgtacccggaggctaaactcgccggcgcggcggaggcggccgcgggcaggagggaggaggaggtggagagggactacctgtcctacgacgagccgaagacggtgttccccggcgaggcgtgcgacgacctcggcggcgagttctgcgaggcgccgtaccaggccggcgtgtccagggagctggcgcacgcctgatccatcgtccatctatccgcaacatgaattgatctcgccgtcgagtcgatgggtgatgggtccatatgctgctatgcacgtacgtgttgcagatgatactcgagtggtggaggggaagctagcctacgtgtgct

SEQ ID NO: 28637 - protein, 79 aa, Panicum virgatum
  misc_feature: Ceres CLONE 1885429
  misc_feature (1)..(67): Pfam Name: Lir1 Pfam Description: Light regulated protein Lir1
MEACELLGGDACSAQMYPEAKLAGAAEAAAGRREEEVERDYLSYDEPKTVFPGEACDDLGGEFCEAPYQAGVSRELAHA

SEQ ID NO: 28638 - DNA, 583 bp, Panicum virgatum
  misc_feature: Ceres CLONE 1885434
  misc_feature: Encodes the peptide sequence at SEQ ID NO. 28639
gaggattttcggggagctaaacatgcagcagggattggccgcgctcgtgctcctggtagcgacggcggcgtgcgcgtgcgcgtccccggccgcctcggcgttcgcgggagacgtccgcgtcgcgctgaagcacgtcgacgccgggaagcggctgtccaggcccgagctcatccggcgcgccgcgcagcggagcaaggcgagggcggccgcgctctccgcggtgcggagccgcggcggccgcttctccggcgcgagcgagcagcgggaggcgccccgcggcacgacggtgcgcccgtcgggggacctcgagtacgtcgtccacctcgccatcggcacgccgccgcagcacgtgtcggcgctgctcgacaccggcagcgacctcatctggacgcagtgcgcgccgtgcaccagctgcctcgcgcagccggacccggtgttcgcgccggcccagtcggcgtcgtacgagcccatgcggtgcgccggcccgctctgctccgacatcctgcgccacggctgcctgaggcccgacacgtgcacctaccggtacaactacggcgacgggacgacgaccatgggcgtctac

SEQ ID NO: 28639 - protein, 186 aa, Panicum virgatum
  misc_feature: Ceres CLONE 1885434
  misc_feature: SWISSPROT Homolog: EC 3.4.23.12 Nepenthesin
MQQGLAALVLLVATAACACASPAASAFAGDVRVALKHVDAGKRLSRPELIRRAAQRSKARAAALSAVRSRGGRFSGASEQREAPRGTTVRPSGDLEYVVHLAIGTPPQHVSALLDTGSDLIWTQCAPCTSCLAQPDPVFAPAQSASYEPMRCAGPLCSDILRHGCLRPDTCTYRYNYGDGTTTMGV

SEQ ID NO: 28640 - DNA, 2491 bp, Panicum virgatum
  misc_feature: Ceres CLONE 1885469
  misc_feature: Encodes the peptide sequence at SEQ ID NO. 28641
aaaaaccacgctaaaatctcgcccaaatcaccgccgccccagccatggcgacctccttcggtttcggcggctccgcggccgcgggctccaccgcctcctcccccttctccttctcctccaccccatccgccttctccttctcccagccggcggcggcctcctcccccgcccccgccttcggctcatctctcttctcatcctccgccgccgcttcctctgcccctactttcggctcctccctgtttggggcctcgtccgccgccgcgcccgcctccactgcagcctcccctttcggcttcggatccaccggattctcgttcgggcaatccaccgcagccgcctcatcggccgcgccggccccatcccttttcggtgcaacggccgccgcatcccccgccggaacaacccctagcatattcggcgctgccacctccgccgcaagcagccccggcctcttcggcgctgcctctgcccccgcaagcagcccgggcctcttcggcgcgtccgccgccggctctgcgacgtctactccgggcctgttcggcgctaccacctccgcggcagccactccgggcctatttggggccacctccgccgcggcgaccacaccgagcatattcggggccacttccgccgctgcgacgacacctagtctgttcggcgccgccacctcggctgcgtccacgccaagcctcttttccggagcctccacgggcttcagctttggctcatcggcgtccggctccaccagtaccacggccgccgcctcggcaccatcattcggcttctcgttcagctcgggggcggccgcgtcgagcactgcttccaccactgcatcatcacaggctttagggtttggaggcgccactggctcgtcgctgttcggatctaccacctctgcgccactcttcagcagcagcagcacctcttctccagccccagctgcaaccacgacaccatcctttggcttctctgcctcgccagcaacagcatccgccccgtcctttggttttacgccgtcaacagcaagctcgacgacggggaacacggctgcttccttgttctcttctgcttcctcggctcctacctttgcttttgctaagagcacatccgccactcctaccactccagtgtcctcgcctgccaacagcctctccttggccacttcgcaggcttcacctgcaccctcgctattctctaataccagtgcagcaggtagttcatctaccgctacatctggcttctcctttggttcatcttcggcagcttctacactaactatagcttctatctctgcaactggtgcatccactgcgccatcagctacttcagcttctgcgacatcggggtcattgttccctgctgcttctactagtggtttcagtttttcagaagcaccatcatcgtcatcagcagcggcagcaacagccactaccaccactgtcacaagtgcatctacgtctgcaggcatgaccactacctctccattgactggaacaatagggtttcctagttttagtgttcaaacaaccacaccagcttctacctcatctccaacactgtcacttggcctttctactacaactgctagcacatcagccaccaccaccagcacaagccaggcaacttcctcagctgttcaagctagcagcacaggtcctgctacttctacagctatcactccagcatcttcccaagcacctaagcttccatcagaaatcgttggcaaaagtgttgaggagattattagggactggaacaatgagcttcaagaccgtactgtgaagttcaggaaacatgcaactgcaatagctgaatgggacaagagaattctgcaaaatagaaatgttcttatcaagcttgaggctgaggtggcaaaagttgttgaaacacaaacaagcttggaacgccaacttgagttgatagaaactcatcagcgagaggtagacaacgctctccagggcatggaggaggaagctgaacgcatattccaggatgaacgtgcattacttcgtggagatgaggctgcttcagcaagagatacaatgtatgaacaagcagaagttgtggagcatgaattgcaacatatgacagaacaagtaaaatccatcattcagactatgaatgctactcagggtggtgaacttcaggcctctgatagtatgacaccatttgatgttgctgtccggatactggataatcaactgcggtccttgatgtggattgatgagaaggttaacgagttctctggcagaatacagaggctgcctaacaacagtgcttcaagtgaacgtgactccgggattcccaggttttggttaagctgatccgggctagtaagcatgctgtgcttggttgctccagcaaatgtacgcgttattttctccccgttaaagtactttggtgccacatacctctagctggttgactctttgattgatactattcaatgtcactcagattgctgaaaatcaaccctctgctttgcatc

SEQ ID NO: 28641 - protein, 285 aa, Panicum virgatum
  misc_feature: Ceres CLONE 1885469
  misc_feature (58)..(185): Pfam Name: Nsp1_C Pfam Description: Nsp1-like C-terminal region
MTTTSPLTGTIGFPSFSVQTTTPASTSSPTLSLGLSTTTASTSATTTSTSQATSSAVQASSTGPATSTAITPASSQAPKLPSEIVGKSVEEIIRDWNNELQDRTVKFRKHATAIAEWDKRILQNRNVLIKLEAEVAKVVETQTSLERQLELIETHQREVDNALQGMEEEAERIFQDERALLRGDEAASARDTMYEQAEVVEHELQHMTEQVKSIIQTMNATQGGELQASDSMTPFDVAVRILDNQLRSLMWIDEKVNEFSGRIQRLPNNSASSERDSGIPRFWLS

SEQ ID NO: 28642 - DNA, 652 bp, Panicum virgatum
  misc_feature: Ceres CLONE 1885484
  misc_feature: Encodes the peptide sequence at SEQ ID NO. 28643
cagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagcagggtgccatccagaccaccatgcaggagctcgcatccaagggccttgctgcaaagattcttccaccaccgatctccaggacagattttgaaaaggtcctgtcaaggcagaggccgacagttagcaagaaggacctggaggtgcacgagaggttcaccaaggagtttggcgaggagggctgatacaccgctcgaggacactcacccatgcacagctgcgccacagaaatgtatattgtttatgacttcgattgttctgcatgcaagttggattcacaggattgtacattcggtagcccaactaaagttgatcatggctgcggctttatcatgtgttgggcacttgggctatcgatgtgcgtctgttgtcatcttatttcgattttacacatacttggaatttttccacaggtgtattaatgaataataattcttaacgtggagtccttgtggtgcagtctgtatgtacagatgttttcttaatg

SEQ ID NO: 28643 - protein, 115 aa, Panicum virgatum
  misc_feature: Ceres CLONE 1885484
  misc_feature (47)..(112): Pfam Name: Vps4_C Pfam Description: Vps4 C terminal oligomerisation domain
  misc_feature: SWISSPROT Homolog: EC 3.6.4.3 Microtubule-severing ATPase
ESDFESLARRTDGFSGSDIAVCVKDVLFEPVRKTQDAMFFFKADGDMWMPCGPKQQGAIQTTMQELASKGLAAKILPPPISRTDFEKVLSRQRPTVSKKDLEVHERFTKEFGEEG

SEQ ID NO: 28644 - DNA, 2044 bp, Panicum virgatum
  misc_feature: Ceres CLONE 1885515
  misc_feature: Encodes the peptide sequence at SEQ ID NO. 28645
gctagcggccagccccgcggacggaccacgcctccggcctccttccgccggtcggagacgtcggagaacgccagctacctcgaagtcccttgcactctcctgcgttgccactccctggtggttccggattggcgcggactggagatccatcctgacatggaattgaccccttttccagattttgagattaaactccagaagttcagctaggcacacataacatttagctgttgcttaaccatggataactctcagaatcaaccattaccacctggtgttggagcatggccacaggcacctcccaatcacccgccacagttccattctgacccacagtcttatcattctccatttgacactagacctgacaatgctagtgccaatggtagtgatagtgcagcaaatattgaatcagctgtccaagaggctgttcttcacgcacaggacgttgagacccagcaagtcattcaaaatcaaagacatgcaaacacaacaagtgaacctacaacctatggggaagacttactgtctaaccgccgtgatcctaatgcattgaaggaacacttactaaagatgacagctgatcatcgtgcagagatggcaaacaaaagggggaagccacttcatccaaataatggaaatgttgaaattggcaatggctatggtgtaccaggagggggtgcttattatgctgcaaacttgccaagtgctcaaacgaacaaacctagagatgaatctgataaagcaaaatgtggaaatgatctccctgattttttgaagcagaggttaagggcaaggggaattctcaaagatgagagaacaaataagaataacacgggtacacagaatgtggattctcaagaaaatcagaacaaatctgtgcatgagttgcctcctggttgggttgaagcaaaggacctgacaaccggtactccttatttctacaatcaaagcactggagtgagtcaatgggatcgtcccggtggtgctgtgaacaccatgcaacatcaagtttctttatccttgccagagaattgggaggaggcagtggatgaaacaacaggccacaaatactattataatacaaagacacaggccacacagtgggagcctcctacttctgtgaataccattgttacacatcatgttcccaccaacactgcagtagagccaatcactcaaactgcagatatttgggattctcaaatgcagagatgttcaggctgtggtggttggggagttggtcttgtccaatcttggggatactgcaatcactgcactagggttcaaaaccttccttttcaacagtatccatcttacacaaacaatatggcgcattctggtaacaatgctaccagaactcaggggaatgttgctgctaaggacagatcaagctcaaaaccaccctctgggaaaccacacagaaaagatcaccgcaaaagaaatcgccccgaggatgatgagcttgacccgatggacccaagttcttactcagatgctccacggggtggctgggttgttggtttgaagggtgtacaaccacgagcagcagatactacagcagctggacctttgttccaacaaagaccgtatccctccccaggtgctgttttgaggaaaaatgcagaagtagcaacccacggcaagaaacgcggcggtatggctccgataacaaagagaggagatggcagcgatggacttggggaggcggattagtcttttgatgaactgaaattcttgtgcaatcagagtatattctgtggtttggtttctggagctggttaaccatgcgtgcagtgcagtatggagaatggagaaaatcaagagcattattatatatggagaaaatcaagagaattatgggcagcccattttcaggaagaaactgtgcagcagctagattatagtgaacccagcagtgcgctcaccctgttttgtagaggccattcacagtgccctggtttgcttggaatctgtaatttgtaagtggaaagcgacagcatttcatagtttacgcaatgttccgagagatataaggaatcac

SEQ ID NO: 28645 - protein, 491 aa, Panicum virgatum
  misc_feature: Ceres CLONE 1885515
  misc_feature (217)..(247): Pfam Name: WW Pfam Description: WW domain
  misc_feature (262)..(292): Pfam Name: WW Pfam Description: WW domain
MDNSQNQPLPPGVGAWPQAPPNHPPQFHSDPQSYHSPFDTRPDNASANGSDSAANIESAVQEAVLHAQDVETQQVIQNQRHANTTSEPTTYGEDLLSNRRDPNALKEHLLKMTADHRAEMANKRGKPLHPNNGNVEIGNGYGVPGGGAYYAANLPSAQTNKPRDESDKAKCGNDLPDFLKQRLRARGILKDERTNKNNTGTQNVDSQENQNKSVHELPPGWVEAKDLTTGTPYFYNQSTGVSQWDRPGGAVNTMQHQVSLSLPENWEEAVDETTGHKYYYNTKTQATQWEPPTSVNTIVTHHVPTNTAVEPITQTADIWDSQMQRCSGCGGWGVGLVQSWGYCNHCTRVQNLPFQQYPSYTNNMAHSGNNATRTQGNVAAKDRSSSKPPSGKPHRKDHRKRNRPEDDELDPMDPSSYSDAPRGGWVVGLKGVQPRAADTTAAGPLFQQRPYPSPGAVLRKNAEVATHGKKRGGMAPITKRGDGSDGLGEAD

SEQ ID NO: 28646 - DNA, 818 bp, Panicum virgatum
  misc_feature: Ceres CLONE 1885547
  misc_feature: Encodes the peptide sequence at SEQ ID NO. 28647
aagaagaacccgaagccaaacgggacaaagaggcaggaaacgagaggggaattccagagacgcctcatctcaggtccaaacttatcggcgatgatgctgcgcgcggcgggcaagaggctcctcggcgccgcgtccggcgtcacaggcggcgaggcggctgcgggcgcggcgaggcggggctaccacgagcgggtcgtggatcactacaacaacccgcgcaacgttgggtccttcgacaaggacgacgcggacgtcggcacggggatcgtcggcgcgccggcgtgcggggacgtcatgaagctgcagatccgtgtcgacgaggggtccggcaagatcgtcgacgcgcgcttcaagaccttcgggtgcggctccgccatcgcgtcctcctccgtcgctactgagtgggttaagggcaagcaaatggaggaggtagtcgcaatcaagaacactgaaattgcaaagcacctatctcttccaccggtgaagctccactgcagcatgctcgctgaggatgcgatcaaagccgccgtgaaggactacgaagcaaagaaggggaagctggccaaggcagacgagtaggaacaccccacaagagcgcggccacctctagatgactagctctggctggcagagtactttgcaacgagagcatgtacataaacaagaaagggatgatgtttggttggtttcaccaaaataagtgcactttatgtcgtgcaacggcagggtagtgtcgtagtgatacaattgtacctcttgtaacctgtattgtactgcgtgagcttcacatatgtgctaaattagtaattatcttcccg

SEQ ID NO: 28647 - protein, 162 aa, Panicum virgatum
  misc_feature: Ceres CLONE 1885547
  misc_feature (30)..(157): Pfam Name: NifU_N Pfam Description: NifU-like N terminal domain
MMLRAAGKRLLGAASGVTGGEAAAGAARRGYHERVVDHYNNPRNVGSFDKDDADVGTGIVGAPACGDVMKLQIRVDEGSGKIVDARFKTFGCGSAIASSSVATEWVKGKQMEEVVAIKNTEIAKHLSLPPVKLHCSMLAEDAIKAAVKDYEAKKGKLAKADE

SEQ ID NO: 28648 - DNA, 678 bp, Panicum virgatum
  misc_feature: Ceres CLONE 1885560
  misc_feature: Encodes the peptide sequence at SEQ ID NO. 28649
atcctcccagtcctcaactcctcacccccagcatccaactacccccagtcaagccgccccgccccgccccgcctgggaaccttccagaagcgcaagactccaaggccgtcgccctcccacccgttcctcgccgcgggggtcgcctgagttgttgcagatcacataaacaatggtgaaggctgttgctgtgcttggtagcagcgagggtgtcaagggcaccatcaacttcacccaagagggtgatagccccaccactgtcaccggaagtgtctctggcctcaagcctggcctccatgggttccatgtgcatgcacttggtgacacaacaaatggctgcatgtcaactggaccgcattacaaccctgcgggcaaggagcatggagcacaagaagatgagaaccgccatgctggtgacctcggaaatatcacggtcggagatgacggtgttgctaacttcactattactgacaaccagatcccactgactgggccaaactcaatcattggcagagctgttgttgttcatgctgatcctgatgatcttggaaagggtgggcacgagctgagcaagagcactggaaacgctggtggccgtgtcgcctgcgggatcatcggactccagggctgagattgatcaccagactcgagtgccgaaagcgtcgtcgtcgtcgccccccg

SEQ ID NO: 28649 - protein, 152 aa, Panicum virgatum
  misc_feature: Ceres CLONE 1885560
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSEGVKGTINFTQEGDSPTTVTGSVSGLKPGLHGFHVHALGDTTNGCMSTGPHYNPAGKEHGAQEDENRHAGDLGNITVGDDGVANFTITDNQIPLTGPNSIIGRAVVVHADPDDLGKGGHELSKSTGNAGGRVACGIIGLQG

SEQ ID NO: 28650 - DNA, 652 bp, Panicum virgatum
  misc_feature: Ceres CLONE 1885578
  misc_feature: Encodes the peptide sequence at SEQ ID NO. 28651
cagctgtacacggaggcaacagatggctcctccatcgagcacaaggagagcgccttagtctggcaccaccaggaagcggatccggacttcggttcctgccaggccaaggaactgctcgaccatcttgagaacgtgctcgccaacgaacccgtggtggtgaagaggggccagcacatcgtcgaggttaacccccagggcatcagcaaaggcgtggtggtggagagcctcctgtcgtccatggtcaagacggggaaggcgccggactttgtgctgtgcatcggcgacgaccggtcggacgaggacatgttcgagagcatcgtgtgcccgtccaatgccagcgtgaagctcccggccaccagcgaggtgttcgcctgcaccgtgggcaagaagccgagcatggccaggtactacctggacgacacggtggacgtgattaaaatgctggagggcctggcgaacgcgccgtcgcagcggcccaggccggcggtgcagctccgggtctcgttcgagggctcgctgtgagacggaaacgaaaggggaattttactgcacaggaaggagtagtagtacactacacatcgaggacgaataaccaaccaatggtaacgaagatggttcagacgcgtggtttaggattagctgcagtagttac

SEQ ID NO: 28651 - protein, 173 aa, Panicum virgatum
  misc_feature: Ceres CLONE 1885578
  misc_feature (1)..(142): Pfam Name: Trehalose_PPase Pfam Description: Trehalose-phosphatase
  misc_feature: SWISSPROT Homolog: EC 3.1.3.12 Trehalose-phosphatase
  misc_feature: Functional homolog of the protein sequence given in SEQ ID NO 50800
  misc_feature: Useful for making plants with altered carbohydrate content
QLYTEATDGSSIEHKESALVWHHQEADPDFGSCQAKELLDHLENVLANEPVVVKRGQHIVEVNPQGISKGVVVESLLSSMVKTGKAPDFVLCIGDDRSDEDMFESIVCPSNASVKLPATSEVFACTVGKKPSMARYYLDDTVDVIKMLEGLANAPSQRPRPAVQLRVSFEGSL

SEQ ID NO: 28652 - DNA, 565 bp, Panicum virgatum
  misc_feature: Ceres CLONE 1885593
  misc_feature: Encodes the peptide sequence at SEQ ID NO. 28653
acgcagcaccagccatccacgtccgcaccgcaccgcaccagcagctagcagcagcaccgcagcagcggccgacaactcgcttactgatggcgtcgctcaccatgatggcgccctccttcgcggcagtggcggcggccgcaccctcccgccgcggcagcctcgccgtggcccgggccgccaaggtcgagcgcggccaccaggagcaggagcccgcgaggctggtgggggaatcattttgttttgtgacgaggggctcatcgcaatgggcgatattcttttcctgtcaggtctgggcttgacaattgggctgaaatcgcctatgcattttttcaccaagcctaggaattacaagggtacaatctcattcggcgctggatgtttcctggtgctcattgggtggtctttttttggcatgctcttggaggaatatggatttattgtactcttcagtggattctggagaacactagtagtgttcctgcacaggattcctatcattggttggatatttcaaaaaacgtttgtgacatcattccttgatcgctacagagggaatcgggttcca

SEQ ID NO: 28653 - protein, 100 aa, Panicum virgatum
  misc_feature: Ceres CLONE 1885593
  misc_feature (1)..(92): Pfam Name: Got1 Pfam Description: Got1-like family
MGDILFLSGLGLTIGLKSPMHFFTKPRNYKGTISFGAGCFLVLIGWSFFGMLLEEYGFIVLFSGFWRTLVVFLHRIPIIGWIFQKTFVTSFLDRYRGNRV

SEQ ID NO: 28654 - DNA, 643 bp, Panicum virgatum
  misc_feature: Ceres CLONE 1885604
  misc_feature: Encodes the peptide sequence at SEQ ID NO. 28655
caggaggagaacgtgagattcaaagaactatgttggagctgctgaatcagctagatggttttgactcgcgtggagatgttaaagttatcctagcaacaaaccgcattgaaagtcttgatccagctttgcttcggccaggtcgcatagaccggaagattgaatttcctttgccagatattaaaactagacgtcgcatcttccagatacacacctcaaaaatgacgttagccgatgatgtgaacttggaagaatttgtgatgacgaaggatgagttctcgggggctgatatcaaggctatttgtacggaagctgggttgctagcattgcgagaacgtagaatgaaggtgacccatgcggatttcaagaaagcgaaggagaaggtgatgtacaagaaaaaggaaggcgtcccagatggtctctacatgtaacgaatcggtcccttcattgtcaggacaagctatctttattatagtagcacttctctcttcagcatgggagatttgttggcttggtgtcgcactcagtttggaaaacatgtattatcttttgatttatttgaagtaaattccctttgagaggatgctggaacgctgtgtaggcaaggtatgcactaaaaaaatacgattaattttctcgtggtcgc

SEQ ID NO: 28655 - protein, 141 aa, Panicum virgatum
  misc_feature: Ceres CLONE 1885604
  misc_feature (1)..(109): Pfam Name: AAA Pfam Description: ATPase family associated with various cellular activities (AAA)
  misc_feature: SWISSPROT Homolog: EC 3.6.4.6 Vesicle-fusing ATPase
GGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 28656 - DNA, 782 bp, Panicum virgatum
  misc_feature: Ceres CLONE 1885615
  misc_feature: Encodes the peptide sequence at SEQ ID NO. 28657
ggcggagcacaatacatccgatccatcgatcgctgtaggtgtccttctctgagatggccggagggaagctgtactcgttcgaggaggtgaggaagcacaacgaccgcaaggattgctggctcatcatcgccggcaaggtaataattaatcatccatcttccttgtcgatcgttccccatgccagttttcctgcgtcgatcctggtctgaccggccggccggccggccatgttctcctcacaggtgtacgacgtcacgccgtacatggaggagcaccccggcggcgacgaggtcctgctggcgtgcacaggcaaggacgcgacggccgactacgaggacatcggccacagcgccgacgccaaggagctcatgaagcagtactgcatcggcgaggtcgacgcggccaccgtcccggccaagctcacctacacctaccccagcgactcgagcgcccagaaggcgtcggcgagcgcgggcgcctgggccacgacgctcctgcagctcggcgcgcccctcctgctgctggcgctggccctggcgagctacggcaagggctgggccaaggcagagtaggaggcgagcacgagatgccgtcgttgattccgcgggggcgcatagctgcagcctcttggaagcatctgggagttgtttttgggtccttaaaaaagtacgagtggttcgtgtgttcacctcaaccgctgggtggtgtcgtcaattttaaattcctgggtattgtgtatcgaacatgatgtatacagcatactgctataattacgtgttcgt

SEQ ID NO: 28657 - protein, 114 aa, Panicum virgatum
  misc_feature: Ceres CLONE 1885615
  misc_feature (2)..(57): Pfam Name: Cyt-b5 Pfam Description: Cytochrome b5-like Heme/Steroid binding domain
MFSSQVYDVTPYMEEHPGGDEVLLACTGKDATADYEDIGHSADAKELMKQYCIGEVDAATVPAKLTYTYPSDSSAQKASASAGAWATTLLQLGAPLLLLALALASYGKGWAKAE

SEQ ID NO: 28658 - DNA, 692 bp, Panicum virgatum
  misc_feature: Ceres CLONE 1885623
  misc_feature: Encodes the peptide sequence at SEQ ID NO. 28659
aatattcagaggcacagcgcacacaagcaaggcggctagctacagacgcggctagtggcgcgagtacacacagccacgcccagtgcgaagcttgctggtgcatgcggcaatggcggcttcgcttgggctaaaccctgaagctctcttcagctcccactcgtcgtcatactcctcgcccttcatgtccggctacgcgccgcagagattcccggcggccgataacaccgtcgtcgacgacgcggcggccttctcctcagagctcgatgatctttgccagcttgagtactcgccggcaccgctcatcgccggcgccggcgccggcgccggcggcggggctggagacgatcgcgacgagaagccgatgtggtgtggggggcgagatgagaagagacccaggagcagtggaaggattgggttcagaacgagatcggaggtggagatcttggacgacggattcaaatggaggaagtacgggaagaaagctgtcaagaacagccctaatccaaggaactactaccggtgctcgtcggagggctgcggcgtgaagaagcgcgtggagagggaccgcgacgacccccgctacgtcatcaccacctacgacggcgtccacaaccacgccagccccggcgccgccgccatcatccagtacggcggaggcggcttctacagcccgcagcacagcggctcgccgt

SEQ ID NO: 28659 - protein, 194 aa, Panicum virgatum
  misc_feature: Ceres CLONE 1885623
  misc_feature (112)..(171): Pfam Name: WRKY Pfam Description: WRKY DNA -binding domain
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 148 in the 10/714,887 US patent application
  misc_feature: The sequence is a functional homolog of SEQ ID NO 148 in the 11/435,388 US patent application
  misc_feature: The sequence is a functional homolog of SEQ ID NO 210 in the 10/714,887 US patent application
  misc_feature: The sequence is a functional homolog of SEQ ID NO 210 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 130 in the 10/714,887 US patent application
  misc_feature: The sequence is a functional homolog of SEQ ID NO 130 in the 11/435,388 US patent application
  misc_feature: The sequence is a functional homolog of SEQ ID NO 132 in the 10/714,887 US patent application
  misc_feature: The sequence is a functional homolog of SEQ ID NO 132 in the 11/435,388 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 144 in the 10/714,887 US patent application
  misc_feature: The sequence is a functional homolog of SEQ ID NO 144 in the 11/435,388 US patent application
  misc_feature: The sequence is a functional homolog of SEQ ID NO 1611 in the 10/412,699 US patent application
  misc_feature: The sequence is a functional homolog of SEQ ID NO 971 in the 10/666,642 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAASLGLNPEALFSSHSSSYSSPFMSGYAPQRFPAADNTVVDDAAAFSSELDDLCQLEYSPAPLIAGAGAGAGGGAGDDRDEKPMWCGGRDEKRPRSSGRIGFRTRSEVEILDDGFKWRKYGKKAVKNSPNPRNYYRCSSEGCGVKKRVERDRDDPRYVITTYDGVHNHASPGAAAIIQYGGGGFYSPQHSGSP

SEQ ID NO: 28660 - DNA, 567 bp, Panicum virgatum
  misc_feature: Ceres CLONE 1885652
  misc_feature: Encodes the peptide sequence at SEQ ID NO. 28661
tggcccgcctcatgcgcggccacgaggaggagccctggttcaagcccgagttcaaggaggaggacatggcgagggagatgaccgcgttcgacatcctgagcttctccgccgggtccgacctgtcggcgctcttcggcgccgggcatggcaaggagcgggtgttcgtcagcgaggccggcgctgccgtgctgagccgcgtggaggcggccgggcggaaggaagggtaccgcgtgaggagggaagggaagcggggcaccgggccggtctacctggaggaggagagcggcggcggcatcgtggcgaaggtgagcgtcttcaagctcgccgacgcggtgtcagtggtggaggttgtgaagggcgacggcgcggaggccgcgctgttctggaccgagcggctcgagccggccgtgaagcccccggtgctgtcgtgctgagctgagcaggccgccgccgagggttcctggcttcctgctcctggccctgggaggcgcctccgccgcttgccgggaatgggatccgtttcctttggttgtgatggttcctcaaaaattcatttggttgtttggc

SEQ ID NO: 28661 - protein, 143 aa, Panicum virgatum
  misc_feature: Ceres CLONE 1885652
  misc_feature (22)..(79): Pfam Name: NAF Pfam Description: NAF domain
  misc_feature: SWISSPROT Homolog: EC 2.7.11.1 Non-specific serine/threonine protein kinase
ARLMRGHEEEPWFKPEFKEEDMAREMTAFDILSFSAGSDLSALFGAGHGKERVFVSEAGAAVLSRVEAAGRKEGYRVRREGKRGTGPVYLEEESGGGIVAKVSVFKLADAVSVVEVVKGDGAEAALFWTERLEPAVKPPVLSC

SEQ ID NO: 28662 - DNA, 657 bp, Panicum virgatum
  misc_feature: Ceres CLONE 1885699
  misc_feature: Encodes the peptide sequence at SEQ ID NO. 28663
tctcttcggagacatccgataaaattggaacgatacagagaagattagcatggcccctgcgcaaggatgacacgcacaaatcgagaaatggtccaaatttttaagggcttgcccaggggtgtagctattctaatctcgtttctggtttcagctgtatttcatgagatatgtgttgctgtgccatgccacattttcaaattctgggcattttttgggatcatgtttcagataccgttggtgttcttgacaagatatcttcaagataagttccagaacataatggtgggcaacatgatattctggttcttcttcagcatagtcgggcagccgatgtgtgtccttttatattatcatgatgtcatgaataggcaagcccaggcaagtagatagttctgctgaaatatgaaccataatacagatcatcagatggaaacaggatcgaatatgctggaagctgtagcagcccccgtggcatgtttgtcaccagctagtcagcttgcaaatgctcccattccgtgcagccgtgccagggatgcagcgtgtacatttccagtgatgcaacatcaagatctgacagcgctaccaacatgtcaagactctacactttttcagtatatgtcagcagttctgtgtgcataatgtcgtgtaacatgtaag

SEQ ID NO: 28663 - protein, 100 aa, Panicum virgatum
  misc_feature: Ceres CLONE 1885699
  misc_feature: SWISSPROT Homolog: EC 2.3.1.20 Diacylglycerol O-acyltransferase
  misc_feature: The sequence is a functional homolog of SEQ ID NO 2 in US patent 7067718
MVQIFKGLPRGVAILISFLVSAVFHEICVAVPCHIFKFWAFFGIMFQIPLVFLTRYLQDKFQNIMVGNMIFWFFFSIVGQPMCVLLYYHDVMNRQAQASR

SEQ ID NO: 28664 - DNA, 627 bp, Panicum virgatum
  misc_feature: Ceres CLONE 1885709
  misc_feature: Encodes the peptide sequence at SEQ ID NO. 28665
ataaaccacacactcccactctccgtccgtctccccaccaaggcaaacagactcccaggctcccggcctcccagcaagcaagctagatcgatggcggactggggccccgtggtggtgggcgtggtgctgttcgtgctgctgtccccgggcctgctgtgcgagctcccgggcacccaccgccacgtcgacttcggcggcttccacaccaacggcaaggccattttcgtccacactctcatcttcttcgccgccttcaccatcctcacgctcgcgctccacgtccacatctacgccggctagtagtctgctccaggcctgcctgcctcgtcgatctggacgcgggatccagatcgggacaaggcacgagtgaagtgcgtgtgtgctactgctatctatatgcaagacatcgtcgtctgtaattcgattctgtaggcggacccgtccaccttgctgcgtgcttgcccttcaatccatccaatcgaggagctattcaaacaaatctagctaatagttactgcccttttcttttggtgttcatcccgatccgtctggccgctcgtcatcatgtctctcgatttcatcttctttgtttccatgtatgatccatggtattgatttttgaatgtc

SEQ ID NO: 28665 - protein, 69 aa, Panicum virgatum; identical to SEQ ID NO: 27018
  misc_feature: Ceres CLONE 1885709
  misc_feature: Functional homolog of the protein sequence given in SEQ ID NO 51235
  misc_feature: Useful for making plants with altered cell wall content and/or composition

SEQ ID NO: 28666 - DNA, 626 bp, Panicum virgatum
  misc_feature: Ceres CLONE 1885727
  misc_feature: Encodes the peptide sequence at SEQ ID NO. 28667
accactccccacccccttccaaccccagcacccggcggcggcggcgatgacgacgagcctgaagaagaaccgtaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaagttctactgcccgtcggtcaacgtcgagcggctctggtcgatggtgcccgccgacaaggccgcggaggcggcgggcggcgccgacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttgcatcctgtttcgtctatctgttctaagagaacaccttaatttgttgtggatcctgagtttttagaccccggttttgtgcacttggtaacgaatgcccgttcatttactgaaatgtttccgatttata

SEQ ID NO: 28667 - protein, 147 aa, Panicum virgatum; identical to SEQ ID NO: 12136
  misc_feature: Ceres CLONE 1885727
  misc_feature (109)..(141): Pfam Name: L15 Pfam Description: Ribosomal protein L15

SEQ ID NO: 28668 - DNA, 714 bp, Panicum virgatum
  misc_feature: Ceres CLONE 1885777
  misc_feature: Encodes the peptide sequence at SEQ ID NO. 28669
atgccgcctcgtgcctcgcaggaccagaagagagagagggagaaggaggatcgaatcagccgctgaattgacctcgcgattcgagcgcagaaagcgaaagcatcgtctgatcagccagcggcgccgccggaggaggaatcaatcaagaaaggaggagatgagcggcggcggtggagtgctggcggcgcagtcgcaggagctgcagctgccgccggggttccggttccacccgacggacgaggagctggtgacgcactacctctgccggcggtgcgccgggctgcccatctccgcgcccatcatcgccgagatcgacctctacaagttcgacccctggcagcttccaaggatggcgctgtacggcgagaaggagtggtacttcttctccccgcggaaccgcaagtacccgaacgggtcgcggccgaaccgcgccgccggcacggggtactggaaggccaccggcgccgacaagccggtgggcacgcccaagcccctggccatcaagaaggcgctcgtcttctacgccggcaaggcccccaagggcgacaagaccaactggatcatgcacgagtaccgcctcgccgacgtcgaccgctccgcccgcaagaagagccacagcctcagggtatgtacgccgtctcaatctcagagcgactccgccccaaatcatcttatggatcactgcatgccgtagcaaatagttcagataagatg

SEQ ID NO: 28669 - protein, 178 aa, Panicum virgatum
  misc_feature: Ceres CLONE 1885777
  misc_feature (17)..(142): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: Functional homolog of the protein sequence given in SEQ ID NO 50325
  misc_feature: Useful for making plants with modulated water use efficiency
  misc_feature: Functional homolog of the protein sequence given in SEQ ID NO 50326
  misc_feature: Useful for making plants with modulated light quality response
  misc_feature: Functional homolog of the protein sequence given in SEQ ID NO 50324
  misc_feature: Useful for making plants with altered terpenoid content
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 854 in the 10/374,780 US patent application
  misc_feature: The sequence is a functional homolog of SEQ ID NO 891 in the 10/374,780 US patent application
  misc_feature: The sequence is a functional homolog of SEQ ID NO 1012 in the 11/435,388 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 612 in the 11/435,388 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: Functional homolog of the protein sequence given in SEQ ID NO 50641
  misc_feature: Useful for making plants with altered carbohydrate content
  misc_feature: The sequence is a functional homolog of SEQ ID NO 344 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 854 in the 11/435,388 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 582 in the 10/666,642 US patent application
MSGGGGVLAAQSQELQLPPGFRFHPTDEELVTHYLCRRCAGLPISAPIIAEIDLYKFDPWQLPRMALYGEKEWYFFSPRNRKYPNGSRPNRAAGTGYWKATGADKPVGTPKPLAIKKALVFYAGKAPKGDKTNWIMHEYRLADVDRSARKKSHSLRVCTPSQSQSDSAPNHLMDHCMP

SEQ ID NO: 28670 - DNA, 1058 bp, Panicum virgatum
  misc_feature: Ceres CLONE 1885789
  misc_feature: Encodes the peptide sequence at SEQ ID NO. 28671
acacatcccacacaagcagtgcccactcgcccacgccacaggaaactcatggccagcgctctcggcgccgtcaccgctcgtccccacctgcaccccgccgtcgccctcgcgctccctgcagccaccgcaagaaagttcctcttccgctccagggccgcctccaccatggacgcggcctcggcgagctcgccgggctccgagaagacgacgacgaccgtcttcgtggccggctcgacggggcgcaccggcaagcgcgtcgtggagaagctgctcgcgaagggattcggcgtcgtcgccgggaccacggacttgcagagggcacgcggcagcctgccccaggaccccaaccttcgactcgtcacagctgatgtgacggaaggcgccgatatgctggtggaggttgtgcgcggtgtcgacgccgtcgtctgcgcgacggggttccggcggtccttcgacccttttgctccgtggaaggtagacaactttggcacggtgaacctggttgaagcatgccgaaaagcaggtgtcacgagattcattcttgtcagctccattttagtaaatggtgcagctatgggtcaacttcttaatccagcctacattgtgctcaacctgcttgggttaacactggttgccaagcttcaggcagagwaacacatcakgagatcaggaataaattacaccattgtaaggcctggagggctgacagatcaaccaccraccgggaatatagtcwtggagccagaggacactctttattcgggatccatatctagggaccaggttgctgaggtagccgtggaagcattgttgtgtccagaatcttcgtacaaagtcgttgagattattgcccgccctgatgccccaaatcgccctcttcaggatatgtttgcagcacttaagcaaaattgactactccatcacatcagttaggtagacaagggatttgtgcccaatctaagattataacgaacaaatttgcccttatgtactatttaagagtactattttcattgcttgtattacaaactaatcacttgatagtatcatgccattct

SEQ ID NO: 28671 - protein, 287 aa, Panicum virgatum
  misc_feature: Ceres CLONE 1885789
  misc_feature (57)..(267): Pfam Name: Epimerase Pfam Description: NAD dependent epimerase/dehydratase family
  misc_feature: SWISSPROT Homolog: EC 1.1.1.170 Sterol-4-alpha-carboxylate 3-dehydrogenase (decarboxylating)
  misc_feature (202)..(202): Xaa is any aa, unknown, or other
  misc_feature (205)..(205): Xaa is any aa, unknown, or other
  misc_feature (230)..(230): Xaa is any aa, unknown, or other
MASALGAVTARPHLHPAVALALPAATARKFLFRSRAASTMDAASASSPGSEKTTTTVFVAGSTGRTGKRVVEKLLAKGFGVVAGTTDLQRARGSLPQDPNLRLVTADVTEGADMLVEVVRGVDAVVCATGFRRSFDPFAPWKVDNFGTVNLVEACRKAGVTRFILVSSILVNGAAMGQLLNPAYIVLNLLGLTLVAKLQAEXHIXRSGINYTIVRPGGLTDQPPTGNIVXEPEDTLYSGSISRDQVAEVAVEALLCPESSYKVVEIIARPDAPNRPLQDMFAALKQN

SEQ ID NO: 28672 - DNA, 289 bp, Panicum virgatum
  misc_feature: Ceres CLONE 1885795
  misc_feature: Encodes the peptide sequence at SEQ ID NO. 28673
acctcatcgatcgatccagccagtcgcctatcctcgcctgctgcgcgcgtctatctgctctcctagggagatctcgcgcagcgcggtaacccaccttcccacctcgtcgccgtcgcagatggccggccgcaggatgaagctcgtcgccgccgccgccgtggccgccgcgctcgtggcgtccgacgccgccgccacagaggcccgcgccccggcgcccggcggcgaaggcgcccccttgcagcacctggaagcaccgtccctcgaagcggccgcctttggccattgatac

SEQ ID NO: 28673 - protein, 55 aa, Panicum virgatum
  misc_feature: Ceres CLONE 1885795
  misc_feature: Functional homolog of the protein sequence given in SEQ ID NO 50452
  misc_feature: Useful for making plants with altered carbohydrate content
MAGRRMKLVAAAAVAAALVASDAAATEARAPAPGGEGAPLQHLEAPSLEAAAFGH

SEQ ID NO: 28674 - DNA, 638 bp, Panicum virgatum
  misc_feature: Ceres CLONE 1885815
  misc_feature: Encodes the peptide sequence at SEQ ID NO. 28675
  misc_feature (576)..(576): n is a, c, t, g, unknown, or other
gtcaggttcctgcaccggaaggtcatccgagacgtgcactacaatgggtacgacataccaaggggatggaaaattctgccggtgctagcagcagtgcatctggattcgtcgttgtacgaggaccccaatcagttcaacccttggagatggaagagcaacacgccgagcagcttcatgccgtacggcggcgggccgcggctgtgcgccgggtcggagctggccaagctggagatcgccatcttcctgcaccacctggtgctcaacttccggtgggagctggcggtgccggaccaggccttcgtctaccccttcgtcgacttccccaagggcctgccgatcagggtacagaggatcgccggcgagcacagcgttttgacggagagcacagcaatgtagcggcacgtgcggtaccgtgtctagcagggagtacaggggatcgtacaatttttcgttgcgttttggtggttcgtgtccatgtagatgtgatggtaaagaagcagataggagaaggatatgtgtatagacagagtaaagaagtgggggatgatgatgggtgcaaaatgttgggtagctaanacgtactagtagggttgtaataaggccggcccacggcccattcaagtaataatagaaacatt

SEQ ID NO: 28675 - protein, 131 aa, Panicum virgatum
  misc_feature: Ceres CLONE 1885815
  misc_feature: SWISSPROT Homolog: EC 1.14.13.93 (+)-abscisic acid 8'-hydroxylase
  misc_feature: Functional homolog of the protein sequence given in SEQ ID NO 50965
  misc_feature: Useful for making plants with modulated biomass
  misc_feature: Useful for making plants with modulated heat sensitivity
  misc_feature: Useful for making plants with modulated seed number
  misc_feature: Functional homolog of the protein sequence given in SEQ ID NO 50272
  misc_feature: Useful for making plants with modulated oxidative stress sensitivity
VRFLHRKVIRDVHYNGYDIPRGWKILPVLAAVHLDSSLYEDPNQFNPWRWKSNTPSSFMPYGGGPRLCAGSELAKLEIAIFLHHLVLNFRWELAVPDQAFVYPFVDFPKGLPIRVQRIAGEHSVLTESTAM

SEQ ID NO: 28676 - DNA, 934 bp, Panicum virgatum
  misc_feature: Ceres CLONE 1885820
  misc_feature: Encodes the peptide sequence at SEQ ID NO. 28677
agaaggaccctgtcagaattggagcgcacgcgaccccctttccagttcccgccccgcgcctcgctgagagatctgcggtggacaccgatccgcccgtcgttggcgccggaagctgcggggagaacgagcggagatggaggacacagcaacggcggcgccggcgccggcggagaaggcgtcgtcgtacaggtactgggtgcgggaggccaccggcgacgccgcgccgctcccggtcccgcgcaagctcgacccggccgcggccgccgccaacggcaacgggaacggcaacccgccgccgctcggctccgtctggaaccaggctggaacctgggaggagaaaaacctcaactcatgggccaatagtaggattaaggatttgttgggttctctaggttcattggaattcccaacagggaaggcatccattgatgaagtgtccaaatgctcaggagacgcatttcaggtcacagttcgcaacaagaagagagtagggtataattatgagctgagcttgagatttagaggtgaatggttagttaaagaagaaaacaagaaagtaaaaggccatttagacattcctgagttttcatttggtgagcttgaggacttggagttacaagtaaggttcagtgacgacaaggaactcacatccaacgataaaacactgatttgtaaggatctgaagtcatttctggctccaattcaggagaaaatgcgcatgtttgaagaagagcttaaaggtagatagcgaaggttaacaggagtcagcagtgctaggtaactgactggcgctgctgtgctagatgagtaagcatgtcaaagctgaggtcgtcttgtggtttcgccatcttctgcagtcgtacttggacgactgagactgtatgtgtactgatttgatgcccctgttgagatgaacaagaactgtctaaaactc

SEQ ID NO: 28677 - protein, 204 aa, Panicum virgatum
  misc_feature: Ceres CLONE 1885820
  misc_feature (68)..(204): Pfam Name: Aha1_N Pfam Description: Activator of Hsp90 ATPase, N-terminal
MEDTATAAPAPAEKASSYRYWVREATGDAAPLPVPRKLDPAAAAANGNGNGNPPPLGSVWNQAGTWEEKNLNSWANSRIKDLLGSLGSLEFPTGKASIDEVSKCSGDAFQVTVRNKKRVGYNYELSLRFRGEWLVKEENKKVKGHLDIPEFSFGELEDLELQVRFSDDKELTSNDKTLICKDLKSFLAPIQEKMRMFEEELKGR

SEQ ID NO: 28678 - DNA, 579 bp, Panicum virgatum
  misc_feature: Ceres CLONE 1885844
  misc_feature: Encodes the peptide sequence at SEQ ID NO. 28679
aaccctagccgccggccgtcctgaatcccttctcgcctcttctccgctgcgctcctccgcggctccgccatcatctgggctcatcccgcgcttggattcaagatgtatctccagtactacatcaacgagaagggggacaaggtttacaccaccaagaaggagtcgcctctcggtgtgccgacgcagtctgctcatccggctcgcttctcaccagatgacaagtactctcgccagcggtacctgttgaagaagagatttggactgctgccaacccagaagccagcaccaaagtactaagttccaactgtccaaccatatggatgttcaggagaaaatcatctgtttggcagctttttggtatctcagcacattcagacgctaccatggtatctctcagcacattcagacgctatgtaatactatgctatggacagatcgtgcttcctaatgttatgttactctttcggtcttgactgttgctgcagtacacatggtccggactattacggtaacctgtatttcctgggctaccaggagtacagagcagcttctgttggccttttaaaacgtttacagtcc

SEQ ID NO: 28679 - protein, 64 aa, Panicum virgatum; identical to SEQ ID NO: 25837
  misc_feature: Ceres CLONE 1885844
  misc_feature (3)..(53): Pfam Name: Nop10p Pfam Description: Nucleolar RNA-binding protein, Nop10p family

SEQ ID NO: 28680 - DNA, 711 bp, Panicum virgatum
  misc_feature: Ceres CLONE 1885857
  misc_feature: Encodes the peptide sequence at SEQ ID NO. 28681
gtgctccagccaccaccacggcaacccagcaaggcgagctcctctggttcataactttcttcttcaccgacctcggcacacctccaccgagaacaagcaagttttcaagctctcgagcacaaaacctgtcgtggccgcagctggttggcaaccaacggtttcagaaatgaagcaaaagatcgtgatcaaggtgcagatgagctgcaacaagtgccgggcgaaggcgatggcgctggtggcggcggccggcggcgtggactccgtggcgatcgccggcgccgacagggaccaggtcgtcgtcgtgggcgagggcgtcgactccatccacctcaccgccgcgctgcgcaggaaggtcgggcccgcgcacatcctgcaggtcggcgaggacaagaaggacgacaagaagaagccgccgccggcgccgcccgtgcccgactactacccgtggtgctacccgccgccgccgtcgcagccggccggcttcctctccgacccctacggctacgggtacgcctaccagacgcggcaagagagcagcggctgctccataatgtagattgtacatttgtatctgtacttgtagagagaaggcaacaatccacacatacgtacgtatgtacgggctagtatatgtacttgtagagagaaggcaacaatccacacatatacttctttttttttttgaagggaatccacacatatacctgatac

SEQ ID NO: 28681 - protein, 129 aa, Panicum virgatum
  misc_feature: Ceres CLONE 1885857
  misc_feature (5)..(73): Pfam Name: HMA Pfam Description: Heavy-metal-associated domain
MKQKIVIKVQMSCNKCRAKAMALVAAAGGVDSVAIAGADRDQVVVVGEGVDSIHLTAALRRKVGPAHILQVGEDKKDDKKKPPPAPPVPDYYPWCYPPPPSQPAGFLSDPYGYGYAYQTRQESSGCSIM

SEQ ID NO: 28682 - DNA, 712 bp, Panicum virgatum
  misc_feature: Ceres CLONE 1885862
  misc_feature: Encodes the peptide sequence at SEQ ID NO. 28683
ctccccgcgccgccgccgccgccgccgcctccctcccgacccttcctcctcctctgcctccgtccggctcctcctgctcccacgacacagccgcgtacgagccccagcacctgcccgttcgaggatgagccgcagcctcgggatcacggtgaagctgctgcacgaggcggcgggtcacgtcgtcacggtcgagctcaagaccggcgaggtctaccgcggcgccatggtcgagtgcgaggacaactggaactgccagctcgacaacatcaccttcacggcaaaggacggcaagatgtcgcagctggagcacgtcttcatcagggggagcagggtcaggttcatgatcatacccgacatgctcaagaacgcccccatgttcaagcgcctcgaggccaggattaggggtaaaggctcagctgttggggttggccgcggccgtgcggtcgccatgcgcactcgagctgctgctggtcgcggtggtggtcccgttggacgcggcagtgcaccccctgtgaggaggtagatctgtctaaagtatcgtgcacactgttatctggtgaaccaagtttgtgtcttggttatgaaaactttgcttgggctgcgaggcttgtaaggaagcttatgtgtatctctgcagtagtttgtgttctacggaatggatgtgtgactttggcgcctttgacccggggtggattgctcttgagctaatgtg

SEQ ID NO: 28683 - protein, 132 aa, Panicum virgatum
  misc_feature: Ceres CLONE 1885862
  misc_feature (10)..(75): Pfam Name: LSM Pfam Description: LSM domain
MSRSLGITVKLLHEAAGHVVTVELKTGEVYRGAMVECEDNWNCQLDNITFTAKDGKMSQLEHVFIRGSRVRFMIIPDMLKNAPMFKRLEARIRGKGSAVGVGRGRAVAMRTRAAAGRGGGPVGRGSAPPVRR

SEQ ID NO: 28684 - DNA, 653 bp, Panicum virgatum
  misc_feature: Ceres CLONE 1885887
  misc_feature: Encodes the peptide sequence at SEQ ID NO. 28685
tgtcagcataaattccactctcagtgcatccttccatggctggagcttcacagttcttgcccaatctgtcgatttcagttgcctactgaggagacgaagaacccatgtgaatcagccagcagtgccggggccatgaacggcaatggagacaatgttgctgcaagcagtagtgatacagaaagtactacccgtaatggagacaaccattcagatagtcctatcttctctgctttgagcgcactcttctctgatccatcctcatcatctgatgatgaaagtgctccacactcttctgagacctgaagacaccgctggatgcaggcttgcagtacggtgaaggtgatctgaaatgtgagactggcatctttatattgtagtttctgactttctgtacatatctctgaattggcgcccccagaagacaagatattctatcctcttttctgaaaactatgtggcttgtaacgtgctagtgcttgctatgtttacttatcctaaataaaagttagcctctagtgtgcttaccgtctcctgaaggcttcaacatgcatcagacggctgccagtttggttgagagtgatcaatgtaagactaatctcctctgctagctgtttggcttatgtaagcagtgacattgtgcgctatgtttttac

SEQ ID NO: 28685 - protein, 100 aa, Panicum virgatum
  misc_feature: Ceres CLONE 1885887
  misc_feature: SWISSPROT Homolog: EC 6.3.2.19 Ubiquitin--protein ligase
CQHKFHSQCILPWLELHSSCPICRFQLPTEETKNPCESASSAGAMNGNGDNVAASSSDTESTTRNGDNHSDSPIFSALSALFSDPSSSSDDESAPHSSET

SEQ ID NO: 28686 - DNA, 518 bp, Panicum virgatum
  misc_feature: Ceres CLONE 1885904
  misc_feature: Encodes the peptide sequence at SEQ ID NO. 28687
gcagatcaatcgagcaccccaaacttgcacacaatccccatcaggtctagtagacaagatatatcgacctcaacgatgagctccgtggacgccaccggcggcgagaagaagacgtcgtggccggaggtggtgggcctgccggcagaggaggccaagaagatcagcctcaaggacatgcccgacgccaacgtcgtcgtcctgcccgccggctcggcggtgaccaaggactggaggtccaaccgcgtccgcgtcttcgtcgacaccgtcgctcagaccccgacggagggctgaatgataaacgttccgcctgcatgctggatcaaagatgctagctagcgcctgcacccttagatgttgcttcctgattgcccttactagtttagcttttatctgagctacaccacagaagggaagatccacagatcgaataattgaagctcatcaaatagaatggggaatggagctagctgctgtcgagagtagaactgatggaatgcctgaataaacaatgtattatg

SEQ ID NO: 28687 - protein, 71 aa, Panicum virgatum
  misc_feature: Ceres CLONE 1885904
  misc_feature (12)..(71): Pfam Name: potato_inhibit Pfam Description: Potato inhibitor I family
MSSVDATGGEKKTSWPEVVGLPAEEAKKISLKDMPDANVVVLPAGSAVTKDWRSNRVRVFVDTVAQTPTEG

SEQ ID NO: 28688 - DNA, 595 bp, Panicum virgatum
  misc_feature: Ceres CLONE 1885964
  misc_feature: Encodes the peptide sequence at SEQ ID NO. 28689
acatctcatctcgctcgctctcacttccaccagtacaagcccagcagcccgacagatccgtgcacgtctgatcgactaccatgtcgacggtgacccgtgcctacctggaccagaggctcgccatggccaagcgctgctccagagaggcgacgctcgccggagccaaggcggcggccgtcgccaccgtcgcatctgcagtcccaacgctggcgagcgtgcggatgctgccgtgggccaaggcgaacctgaacccgacgggccaggcgctcatcatctgcacggcagccgggatggcctacttcgtcgcagccgacaagaagatcctctcgctggcgcggcgccactcgttcgaggaggcgcccgagcacctcaggaacacctcctaccagggcgccgcccgcccgcacccggtcttcttcaggccttgatcgctggtgccgtgtgcatgcccgtgtcctcgatgcccaggctcagtgttctcagagaaagtgtaatggtagtgcttgggttattattgtgatgtaactactactaccttcttgaatcattattgatgctgcctccaaataattaacaagcatactgaactagtacc

SEQ ID NO: 28689 - protein, 115 aa, Panicum virgatum
  misc_feature: Ceres CLONE 1885964
  misc_feature (11)..(89): Pfam Name: ENOD93 Pfam Description: Early nodulin 93 ENOD93 protein
MSTVTRAYLDQRLAMAKRCSREATLAGAKAAAVATVASAVPTLASVRMLPWAKANLNPTGQALIICTAAGMAYFVAADKKILSLARRHSFEEAPEHLRNTSYQGAARPHPVFFRP

SEQ ID NO: 28690 - DNA, 639 bp, Panicum virgatum
  misc_feature: Ceres CLONE 1885978
  misc_feature: Encodes the peptide sequence at SEQ ID NO. 28691
attcacctcggaagagaagaagttactccaatacaagtctgatttcatcgggctaaatcattatacagcgatttacaccaaggactgcatccattccccgtgcgatcttcgtacctacgaagggaatgcacttgtctctgctaccggcgaaagggatggggtgaagatcgggggagatactgcgctcgccggttactatgtcgtcccggaagccgtggagccagccatcatgtatgtcaaccagagatacaaggacacgcctgtttacatcactgagaacggttactcgcagtggagtgatatcagcagggaggagctgatcaatgacgtcgagaggttgaactacctgcggggctacgtcacacatctatcaaaagccatcaggaacggggcgaacgtgcggggctacttcgtgtggacgctcctggacaacttcgagtggacgttcgggtacagggtcaggttcgggctgtaccacgtggatttcgacacgcaggagaggacgcctcggatgtccgcgaggtggtacaggagcttcctcacgggatccgcttccgccgccctgacggcggacgaagcagcggcagcgcagcaggaacggagagcagattcatgacgtgtccagccatcggagcttgc

SEQ ID NO: 28691 - protein, 204 aa, Panicum virgatum
  misc_feature: Ceres CLONE 1885978
  misc_feature (1)..(185): Pfam Name: Glyco_hydro_1 Pfam Description: Glycosyl hydrolase family 1
  misc_feature: SWISSPROT Homolog: EC 3.2.1.147 Thioglucosidase
  misc_feature: Functional homolog of the protein sequence given in SEQ ID NO 50474
  misc_feature: Useful for making plants with altered carbohydrate content
  misc_feature: Functional homolog of the protein sequence given in SEQ ID NO 50616
  misc_feature: Useful for making plants with altered cell wall content and/or composition
FTSEEKKLLQYKSDFIGLNHYTAIYTKDCIHSPCDLRTYEGNALVSATGERDGVKIGGDTALAGYYVVPEAVEPAIMYVNQRYKDTPVYITENGYSQWSDISREELINDVERLNYLRGYVTHLSKAIRNGANVRGYFVWTLLDNFEWTFGYRVRFGLYHVDFDTQERTPRMSARWYRSFLTGSASAALTADEAAAAQQERRADS

SEQ ID NO: 28692 - DNA, 663 bp, Panicum virgatum
  misc_feature: Ceres CLONE 1885985
  misc_feature: Encodes the peptide sequence at SEQ ID NO. 28693
gagggaccccgatttgtttcgttccccatcctcgcggccgctccaccaccgccgccgccgccctccgctccggtcgccgaagtccccgattcaaatccagggcccgagagatggacgcgagcaggcgccagagcgggatccagcagctgctggccgcggagcaggaggcgcagcagatcgtcaatgcggctagggctgctaagtcggcaaggcttaagcaagcgaaagaggaggctgagagggaaatagctgaataccgtaaacagatggaggctgaattccagaggaaggttgcagagagcagcggtgactctggtgcaaatgtcaagcgtctcgagctggagacggcggcgaagatcgaacagctcaaccaacaggctgcaagcatctccccagaagtcatccagatgcttctgaggcatgtcaccaccgtgaagaactgagccttgctgtgcctgaaaatatgattggaagcttgtatcatctgtccatttattatttcggagagcgtggtgagaaataatttgacttatggctgtaattccttgaccacggaataagctgctgcagtagagcagcaaccgtactggtactgtcagatcttgcattgtttggtatattggtaaatattttcttcatgttcaaattttgaacatactcact

SEQ ID NO: 28693 - protein, 110 aa, Panicum virgatum
  misc_feature: Ceres CLONE 1885985
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDASRRQSGIQQLLAAEQEAQQIVNAARAAKSARLKQAKEEAEREIAEYRKQMEAEFQRKVAESSGDSGANVKRLELETAAKIEQLNQQAASISPEVIQMLLRHVTTVKN

SEQ ID NO: 28694 - DNA, 567 bp, Panicum virgatum
  misc_feature: Ceres CLONE 1886019
  misc_feature: Encodes the peptide sequence at SEQ ID NO. 28695
tattggcagcttaactaatatggaatccatgcagggtttggcgttccagttgattgacgatgttctagatttcactggcacatccgcatcccttgggaagggttcattatctgatattcgccatggaatcattactgccccaattctatatgcaatggaggaattcccgcaactacatgaagttgttgacagcggtttcgacaatcctgcaaatgttgaacttgcccttgactatctccagaagagccgtggaattgaaaggacgaaagagcttgcgcgggaacatgctaaccgtgcaatcaaagctatagaagccctcccggatagtgacgacgaggatgttctgacttcgagacgcgctcttattgacataacagagagagtcatcacaaggacaaagtagcaagtgtttggcactcccaaagtgaatagaaagctgaacctcgccacatgccaagtattgcacttggaagattttgtatactccggttcattgcattcttttcacagcccaagttttgtgtaacattgctggaagtttaggacctgcatttctcagagctgtag

SEQ ID NO: 28695 - protein, 133 aa, Panicum virgatum
  misc_feature: Ceres CLONE 1886019
  misc_feature: SWISSPROT Homolog: EC 2.5.1.30 Trans-hexaprenyltranstransferase
IGSLTNMESMQGLAFQLIDDVLDFTGTSASLGKGSLSDIRHGIITAPILYAMEEFPQLHEVVDSGFDNPANVELALDYLQKSRGIERTKELAREHANRAIKAIEALPDSDDEDVLTSRRALIDITERVITRTK

SEQ ID NO: 28696 - DNA, 592 bp, Panicum virgatum
  misc_feature: Ceres CLONE 1886053
  misc_feature: Encodes the peptide sequence at SEQ ID NO. 28697
attcccgttgagttcccctccccacttcgcctcgcccccctccctcttctcctcttgctttcgcgagaggcggctgcggctcgccgagacagactcctacccccgactccggcgcgtcagccagcacattcgggctagggttccggccatggaggacgacgagtacgaggaggggatggagatgggctacggcgggcaccaccagcaccgcggcggccacgcggggtacgcggaggatgaggacgaggtagggtacggcggcggggacggggacgagatggacgaggatggggacggggacgccgagcagcgggacgaggaggagatcacccaggaggacgcctgggccgtcatctccgcctacttcgaggagaagggcctcgtgcgccagcagctcgactccttcgacgagttcatccagaacaccatgcaggagattgtcgacgagtccgccgacatcgagatccgccccgagtcgcagcacaaccccggccgccaggctgagttcgccgaggttgttgccccaccctgatcgatcctagcaagcgtggcttcaatttttcgctaattgctgctgctaggtttggcgatt

SEQ ID NO: 28697 - protein, 127 aa, Panicum virgatum
  misc_feature: Ceres CLONE 1886053
  misc_feature: SWISSPROT Homolog: EC 2.7.7.6 DNA-directed RNA polymerase
MEDDEYEEGMEMGYGGHHQHRGGHAGYAEDEDEVGYGGGDGDEMDEDGDGDAEQRDEEEITQEDAWAVISAYFEEKGLVRQQLDSFDEFIQNTMQEIVDESADIEIRPESQHNPGRQAEFAEVVAPP

SEQ ID NO: 28698 - DNA, 543 bp, Panicum virgatum
  misc_feature: Ceres CLONE 1886098
  misc_feature: Encodes the peptide sequence at SEQ ID NO. 28699
ctcgacggagagcgcgcagtaaccagccaccgatagcccgtgcgggacttggagcgcaagcaaggcgggcgcgcggccatggactccttctcgtcgccctcgctgtcgtcgtcaggttccagccccaacccggaggccgttatggagcagatcaaggcgcagctcgcacaggcttacgcgcaggagtttctcgagaccgtggggaacaagtgctttgaaaagtgtgtgaccaagccaggatcaagcttgagcggaagcgagagcagctgcatatcacgttgtgttgaccgctacattgaggccaccggtattgtgagccgagccttgttcagctcccagcgctaagagcacattatgatttcagtgatcgctcctgagagtgatgtacccttgagaattttgacttgtcaggatatgcaataacaattgatgcttggttgtccaagcagcgaatcctctaaagactcgaggttcttgtaagcctttctgctttagtagaagtaacaggctctatccagtggcgcagatgtttagttacgctcg

SEQ ID NO: 28699 - protein, 88 aa, Panicum virgatum
  misc_feature: Ceres CLONE 1886098
  misc_feature (22)..(86): Pfam Name: zf-Tim10_DDP Pfam Description: Tim10/DDP family zinc finger
  misc_feature: Functional homolog of the protein sequence given in SEQ ID NO 51288
  misc_feature: Useful for making plants with altered alkaloid content
  misc_feature: Useful for making plants with altered terpenoid content
MDSFSSPSLSSSGSSPNPEAVMEQIKAQLAQAYAQEFLETVGNKCFEKCVTKPGSSLSGSESSCISRCVDRYIEATGIVSRALFSSQR

SEQ ID NO: 28700 - DNA, 466 bp, Panicum virgatum
  misc_feature: Ceres CLONE 1886143
  misc_feature: Encodes the peptide sequence at SEQ ID NO. 28701
caattcaacaagtaaatgcgtgcaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcacaaaaaaaacaaaaaaaaaaataaaataaaaatagctgtctacgtttatgtaattttattttttacgcgtaatttactgttattatgatgcataggcatcatggtttatgtatcacccgagatgggggacacgtacggtacggggtttggcacgagtcatgcaggtctcaaacctgaacctccagttgtagcactcgccatatctatcatatcctcccgttggttttccattgcc

SEQ ID NO: 28701 - protein, 37 aa, Panicum virgatum
  misc_feature: Ceres CLONE 1886143
  misc_feature: Functional homolog of the protein sequence given in SEQ ID NO 50272
  misc_feature: Useful for making plants with modulated oxidative stress sensitivity
IQQVNACRWRMGEEDAPMLHQYVEFKKGLPIQLEPVS

SEQ ID NO: 28702 - DNA, 465 bp, Panicum virgatum
  misc_feature: Ceres CLONE 1886163
  misc_feature: Encodes the peptide sequence at SEQ ID NO. 28703
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacagtggctgcggtgacggctcccgcggcggtggcaatcggggatgaa

SEQ ID NO: 28703 - protein, 122 aa, Panicum virgatum
  misc_feature: Ceres CLONE 1886163
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYSGCGDGSRGGGNRG

SEQ ID NO: 28704 - DNA, 636 bp, Panicum virgatum
  misc_feature: Ceres CLONE 1886184
  misc_feature: Encodes the peptide sequence at SEQ ID NO. 28705
atcgcatctcctattctcctctcgctctctgttgtgtgactgattgccaagaaagctctctgcttgcttgtgttccagcctctgaatctcgcgaggatgtcgtgctgcggaggcaactgcgggtgcggctccggctgcaagtgcggctccggctgcggagggtgcaagatgtacccggacatgactgagcagggcaccaccagcagcagccagactgtcatcatgggcgttgcaccaaccaactgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcacaccatgctctgatctttgtggtgtatgtgtgtggcctgctgcttggtgtccctagtgtcatgtgtaaccatccatctatatcgatctacatccctcttgtgt

SEQ ID NO: 28705 - protein, 58 aa, Panicum virgatum
  misc_feature: Ceres CLONE 1886184
  misc_feature (1)..(57): Pfam Name: Metallothio_2 Pfam Description: Metallothionein
MSCCGGNCGCGSGCKCGSGCGGCKMYPDMTEQGTTSSSQTVIMGVAPTNCTCNPCTCK

SEQ ID NO: 28706 - DNA, 450 bp, Panicum virgatum
  misc_feature: Ceres CLONE 1886208
  misc_feature: Encodes the peptide sequence at SEQ ID NO. 28707
accacctgttctcgaagctcaaaaagagatgcaaattgctggcggtttttgctgaggtggaccgtgtgttgaggccacaaggcaaactgatcgttagggacaccgcagacacaataaacgaactggagagcatggccaagtcccaaaagtgggaggtgcgcatgacctacaccaagggtaacgaggggctgctctgtgtcgagaagtcgatgtggcggcccaaggaggttgaagcaagcacgtgaagtatatgtgctgaacaaaactgtcactgtgtagggcacattagacgaattttggctctaggtatgtgtatgattcctgttgatgctgaaaggacaaaaatctttggtgtaactgtagaataatacgtctatttttccccaattcgttgttcgacaatgttgctgtaagatagtgctggaaatcacaggtacattacattcagtc

SEQ ID NO: 28707 - protein, 80 aa, Panicum virgatum
  misc_feature: Ceres CLONE 1886208
  misc_feature: The sequence is a functional homolog of SEQ ID NO 484 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
HLFSKLKKRCKLLAVFAEVDRVLRPQGKLIVRDTADTINELESMAKSQKWEVRMTYTKGNEGLLCVEKSMWRPKEVEAST

SEQ ID NO: 28708 - DNA, 649 bp, Panicum virgatum
  misc_feature: Ceres CLONE 1886278
  misc_feature: Encodes the peptide sequence at SEQ ID NO. 28709
tatcttgatctgcaattggtttggtatttgggcaggaatgcacacagtacgttactttgacggcaaaacatatgaatgggttggactgagccgccaaccaagcatcatgggtaaggtgaaaagatcgttgagccagttcacccctgcacaatgggacaaggatcagtggcatcctttcatggggccactgcgattcatccaagtgcttttcctctgcgccgtcttcatgactgtggagcttaacacattctttctcaaattttgtctatggattcctccaaggaaccccttggtcgtgtacagattgatcctctggtggctgattgccatcccaaccatccgcgagtataactcctacttacaagacagcaaacaagtgaagaaggttggagccttttgttggctctctctggctatttgcatagtggagctacttatctgcatgaagtttgggcatgggctgtttcatgacccaatgcctacctggttggttatcttttggagctcagtggggattgcgcttgtgattttcttgcttgcatggtcatggaggaatcaccaaaaattccggagaaagcagctgtgatagattgcaagaatctatcttagacaatttaaaactcgattcctttcttggatacaggcgctg

SEQ ID NO: 28709 - protein, 194 aa, Panicum virgatum
  misc_feature: Ceres CLONE 1886278
  misc_feature (1)..(153): Pfam Name: PSS Pfam Description: Phosphatidyl serine synthase
ILICNWFGIWAGMHTVRYFDGKTYEWVGLSRQPSIMGKVKRSLSQFTPAQWDKDQWHPFMGPLRFIQVLFLCAVFMTVELNTFFLKFCLWIPPRNPLVVYRLILWWLIAIPTIREYNSYLQDSKQVKKVGAFCWLSLAICIVELLICMKFGHGLFHDPMPTWLVIFWSSVGIALVIFLLAWSWRNHQKFRRKQL

SEQ ID NO: 28710 - DNA, 485 bp, Panicum virgatum
  misc_feature: Ceres CLONE 1886284
  misc_feature: Encodes the peptide sequence at SEQ ID NO. 28711
acttctaagtatctgcgcctcgccatcgcagacaagcacacgagctcggagaagaacaccgcacgcatgaccaaccgcatcttctccgccatggcaggggaccaagcgtacatgatccgattcgacggccgcttcgacgaccccacgccgagctccgccggcgcggagccgctggcgatgccacaggcggcgccgttcgcggggcgggtgatctcccccgagcgggagcaccaggtcattgtcgccgccctgctgcacgtcgtctccgggtacaccagcgggccgccggagatcttcccgcccgccgccgcggcgtgccgggtgtgcgggatggagcggtgcctctgctgcgagcttttcggcgcagagggcgccgcggcgatcgcattggacggcgcggcgagtaatgtggccggcgcgccgggcgcggcggcggcggcagggcagaggaggcagcggaagaagaagaacaagtgaccgcggcg

SEQ ID NO: 28711 - protein, 136 aa, Panicum virgatum
  misc_feature: Ceres CLONE 1886284
  misc_feature: Functional homolog of the protein sequence given in SEQ ID NO 50277
  misc_feature: Useful for making plants with modulated biomass
MTNRIFSAMAGDQAYMIRFDGRFDDPTPSSAGAEPLAMPQAAPFAGRVISPEREHQVIVAALLHVVSGYTSGPPEIFPPAAAACRVCGMERCLCCELFGAEGAAAIALDGAASNVAGAPGAAAAAGQRRQRKKKNK

SEQ ID NO: 28712 - DNA, 453 bp, Panicum virgatum
  misc_feature: Ceres CLONE 1886330
  misc_feature: Encodes the peptide sequence at SEQ ID NO. 28713
aaccaagaaacacgcgcagccaccaccgcacaccaagtcagggagaagctaggccatggccggcgtgaactcaaccagcgtcgtcgggctcaagcccgccgcggcggtgccgcaggccgccgccgcctcgccggcggcgaagcgggtgcaggtcgcgcccaaggaccgggcggccgagggccggcgcgcggcgctcctcggcctggcggccgtcttcgccgtcaccgccaccaccgggtcggccgatgccgggatcatcgacgagtacctagagaacagcaaggccaacagggagctgaacgatcagaataggctggacaccaacggcgccaaattcgcgcgcgcctacaccgtagagttcggaagctgtcagttcaccctaccacttgacgggctgcctaggacttcgccctgctaaagatggttcccttcatcagcgacgacctcgatatc

SEQ ID NO: 28713 - protein, 120 aa, Panicum virgatum
  misc_feature: Ceres CLONE 1886330
  misc_feature (9)..(117): Pfam Name: PsaN Pfam Description: Photosystem I reaction centre subunit N (PSAN or PSI-N)
MAGVNSTSVVGLKPAAAVPQAAAASPAAKRVQVAPKDRAAEGRRAALLGLAAVFAVTATTGSADAGIIDEYLENSKANRELNDQNRLDTNGAKFARAYTVEFGSCQFTLPLDGLPRTSPC

SEQ ID NO: 28714 - DNA, 696 bp, Panicum virgatum
  misc_feature: Ceres CLONE 1886518
  misc_feature: Encodes the peptide sequence at SEQ ID NO. 28715
gcgtcgtttctcccccactccactccgcctcccccctcgcgtcgcggcgccctctgatctgatgccggggaggccctgatggcggcggcgggagctggagcggccggcggcggcgggggagccgggggcggggaggggtcctcctcctccccggcgggcgtcgcgatcgggccccaccaccacgggaccgcggaagaggctatgtggcaaatgactttaggaggaggagaatctattgaacatggtcccttccctgagagaattggagaaccagactgtagttattatatgaggactggactttgtagatttggggcaacgtgcaagttcaatcacccgccaaacaggaagctggctgttgccgctgcaaggatgaaaggggagtatccttacagagttggtcaaccagagtgtcaatattatctgaagaccgggacatgcaagtttggagcaacatgcaagtttcatcaccccagagaaaaggctgcgattgcaacgcgagtacagttgaatgttctaggttacccaataaggccgaatgagaaggaatgtgcttattatttgagaacagggcagtgcaaatttgcaagcacatgtaagtttcatcatccaccgccctccaatacgatggttgctgtacgcggctctatttattcacctgggcaatctgcaacctctcctggtcaacattcatat

SEQ ID NO: 28715 - protein, 205 aa, Panicum virgatum
  misc_feature: Ceres CLONE 1886518
  misc_feature (62)..(88): Pfam Name: zf-CCCH Pfam Description: Zinc finger C-x8-C-x5-C-x3-H type (and similar)
  misc_feature (107)..(133): Pfam Name: zf-CCCH Pfam Description: Zinc finger C-x8-C-x5-C-x3-H type (and similar)
  misc_feature (153)..(179): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
MAAAGAGAAGGGGGAGGGEGSSSSPAGVAIGPHHHGTAEEAMWQMTLGGGESIEHGPFPERIGEPDCSYYMRTGLCRFGATCKFNHPPNRKLAVAAARMKGEYPYRVGQPECQYYLKTGTCKFGATCKFHHPREKAAIATRVQLNVLGYPIRPNEKECAYYLRTGQCKFASTCKFHHPPPSNTMVAVRGSIYSPGQSATSPGQHS

SEQ ID NO: 28716 - DNA, 707 bp, Panicum virgatum
  misc_feature: Ceres CLONE 1886538-R
  misc_feature: Encodes the peptide sequence at SEQ ID NO. 28717
ctccatgcagttgaaatcatacaccgtgatgttaagacgaacaacatactgctggacaacagcttccacgtcaaagttgctgactttgggttgtcgcgtttgtaccctcttgaagtcacccatgtctcaacagttccacagggcacaccaggctatgtcgacccggtgtaccaccagtgctacaagctaactgataaaagcgacgtgtacagcttcggtgtggtgttggtagaactcatatcctctaaaccagctgttgacatgagcaggagccacagcgagattaacttagccaatatggctctcaacagaattcagaaccacgaagttgagcaactggttgaccctgagctcggttacgagactgatagcgaaacaaagagaatggtagatcttgttgccgagctggcttttcagtgcttgcagctagaaagggatttgaggccgtcgatcaaggaggtagtggaggccctgaattgtatcaagaatggggattccccagaaaaaaaggtggatataaagtcatctcttaaggaagatgcacacttgctgaagaatagcatacagtattcacctgattcggtaatccacagattccacagtcaatcgactacccactctgtagcatcaaatgctagcggatgagatgagattccttgtatgtactgaacctgaagaaataaagccctttcggatgtgttgtatac

SEQ ID NO: 28717 - protein, 214 aa, Panicum virgatum
  misc_feature: Ceres CLONE 1886538-R
  misc_feature: SWISSPROT Homolog: EC 2.7.11.1 Non-specific serine/threonine protein kinase
LHAVEIIHRDVKTNNILLDNSFHVKVADFGLSRLYPLEVTHVSTVPQGTPGYVDPVYHQCYKLTDKSDVYSFGVVLVELISSKPAVDMSRSHSEINLANMALNRIQNHEVEQLVDPELGYETDSETKRMVDLVAELAFQCLQLERDLRPSIKEVVEALNCIKNGDSPEKKVDIKSSLKEDAHLLKNSIQYSPDSVIHRFHSQSTTHSVASNASG

SEQ ID NO: 28718 - DNA, 515 bp, Panicum virgatum
  misc_feature: Ceres CLONE 1886538
aaatgccatttgctccttctcccttcggaccttgttcgccgccccctccattccgcagcctgcaagctcctccattgatcgagtagcaagcaagctcgatgcatggccttatcctcctcaagctggtcgcctcctccttgctcctactccacggccgcgcgagtgccgcctgcgagccggcggcatgcgggaacctcactctcagatacccattctggctcggcagcggcaaccagacctcgtcgccatgcggccacccagccttcgaggtctggtgcggcgacggcgggagcgtggcctcgctgaagggctcctccatccacgtcctcgccatcgactacgccaacagctccttcctcgcctcccacagccgggtcgccgccggcgaccacggcgtgtgcggcaccgacttcaacatgtcggtcagcatcgcgctcagcccgttcacgatcagcccccggaaccgtgccctgtgcttcctctccaagtgcgacggcacggccccaagcgggccc

SEQ ID NO: 28719 - DNA, 1717 bp, Panicum virgatum
  misc_feature: Ceres CLONE 1886540
  misc_feature: Encodes the peptide sequence at SEQ ID NO. 28720
aaaaacaaaaccgaaagaaagtacggccccagtgcctgacctcaaaaagtcccctttttcccaccacttctccgttctccccaccacctcccgcgaaagcagcagcaacagcagccgccatggccgcctcctgcgacctcctcgacgtcgacccgctggagcttcagttcccgttcgtgctctacaagcagatctcctgccccctgcggctcaccaacaggaccgacagtaccgtcgcctttaaggtcaagacgacgagccccaggaagtactgcgtgcggcccaacaatggcgtcgtacccccacggtcctcctgcacagttgtagttacgatgcaagcacagaaggtggtgcctccggatttgcagtgcaaggacaaattcttggtgcagagcgcgatcgtcagtgatggcttgtcagccaaggacataacctcgcagatgttcgtgaaagaaaggggtaatgtggttgaggaggtgaagctgaaggttgcttatctgatgcctcctgaaccacaatcagagattgcagaggagcacgatggtttagagagaattttagtgcctatgcagcggaatgtggacaatggaaggagtacttcggggctgtcgagtggctctgcatctttgagatcagctgaggaggtgggatcacctgttggacgaattgtgaagagtgaggagttcctgaaggctgcaggacctgctctggaaacaaaagtatatccgagacctgctgaacaatccaatcaggtgagcttgtattctgtgttgactgtggaatactgaaggttttccatacgtttaggtagaatccacattttacaatgggatattaaataggagaaacccgttatgtcccttactgactctttcattctttgaattttattgctcagaaacaatgggggatgtaatagcaggtcttgtgaactatgttttacgaattttttacaaattctatttcagttcatttttattggaattatctacatggaagttttgcattgcacatagatagccacttacaacgtttatcttgctacttactctagttacttttcttgactataattagggttatttgctgagagcttaatgtcattttattttcattgtgtttcactgttttgtagttcgatacaaatcatgtaattgatattggtaacacggtgctcttttagtttagtgtgcgcttgaagtattttactagtgattgtttcaggattcagttatttgtttgatgtaaatttgatatatttgacatttctttgtgtagtttttctaagctgaatatacacttgtttctcatcccagttgtcagctataattgcaaaattgactgaagaaaagaattctgcacttgagcaaaatagaaagcttcgagatgaattggaacttgtaaggcgtgaagccagtaaacagcaaggcagcttctcgctggttctcttaatagctatcgggctcctgtgcatcattctgggttatcttgtaaataaatgagaatttcatagtctaattgggtactagatatggtaaataaaaggtgacataccatgtgattcttagattcgtcgggcagctgccaatgctacgagccgtgcaacagcacgaacgtcaaattgacaaaagtgggttgtgagtttgatccttgatgtattttaactaatcactgtaaaagtgattgctcttattgtgtttgatttctgtatcaatcc

SEQ ID NO: 28720 - protein, 222 aa, Panicum virgatum
  misc_feature: Ceres CLONE 1886540
  misc_feature (7)..(114): Pfam Name: Motile_Sperm Pfam Description: MSP (Major sperm protein) domain
MAASCDLLDVDPLELQFPFVLYKQISCPLRLTNRTDSTVAFKVKTTSPRKYCVRPNNGVVPPRSSCTVVVTMQAQKVVPPDLQCKDKFLVQSAIVSDGLSAKDITSQMFVKERGNVVEEVKLKVAYLMPPEPQSEIAEEHDGLERILVPMQRNVDNGRSTSGLSSGSASLRSAEEVGSPVGRIVKSEEFLKAAGPALETKVYPRPAEQSNQVSLYSVLTVEY

SEQ ID NO: 28721 - DNA, 1587 bp, Panicum virgatum
  misc_feature: Ceres CLONE 1886600
  misc_feature: Encodes the peptide sequence at SEQ ID NO. 28722
tcagtttcttcctctcctcctcgccaagccggtaccctctcttcagctacctcctgcagcagctgccagccagttcctgaaaagaacagttgatcgatttgctggtagtgggatcagatcgtacagctgcgaagcagagtctcctcaaaaaaaaaatcagaagcggagagctagtagctcatctagcctgcagctgaggaacatgaggaacatggcagagaagaggagacatggaggagggcatcatgtccatggtgttgggtttggagccggagttggacatgccgagcacgacgagaagcgcatggagccaaagaagctggacatgagcggcatgtccatggacaccatcccacatctcagcatgcctcttggcagcatcactaccttggatctctccaacaacaacctacagagtattccggagtccataatcgcgaggcttctgaacgtggtggtgctggacgtgcggtccaaccagctgacatcgctgcccaactccatcggctgcctctccaagctcaaggtcctcaacgtctccggcaacctcctccgcgacctgcccgccaccatcgaggaatgccgggcgctggaggagctgaacgccaacttcaaccagctgacgaagctgccggacacgctggggttcgagctccacggcctccgccgcctctccgtcaactccaacaagctggcctacctgccgtcgtccacctcccacatgacggcgctgcggtcgctggacgcgcggctcaactgcctccgcgcgctgcccgacgggctcgagaacctcggcggcctcgaggccctgaacgtgagccagaacttccagtacctacgggagctcccctacggcatcggcctcctcacctcgctccgggagctggacgtcagctacaactccatcgccgcgctcccggactccatgggctgtctcaccaagctctcccggttcagcgccgcgggcaacccgctggtgtccccgcccatggacgtcgtcgagcagagcctcgacgccatgcgcgcctacctcagcgcgcggatgaacggcaccgacaagcaggacaggaggaagaagaagagctgggtgcccaagctggtcaagtacagcaccttctcggcggggatgatgacgcccggccgcgccaccaaggtgcacggcagcggcgccgagggcctgctcatgtcggactaccggtcgctcgacggcggcggcatcgcctcgccggggttcctcagcatgctgtcgccgcggcggctcttctcgccgcggaggaactcgcccaagcatcattgataaattacttggcatgtgtgcacctgcctgcctgcttgctgcttcgtgtgtgcagatagaacatgcatgctcctcgtattgtagcgtgattaagctgatgctgttgctactgcagatgtagtatatgttttttttttgaagagatacatgcatataaagcgtgtacagagtagtagtgggatagggcattcatgacttgatgtacataagaattaagggtgtccatttctctttttttcttgtttctcggttacttgagcgtaatgcttatggaagcagtattttggagc

SEQ ID NO: 28722 - protein, 364 aa, Panicum virgatum
  misc_feature: Ceres CLONE 1886600
  misc_feature: SWISSPROT Homolog: EC 4.6.1.1 Adenylate cyclase
MRNMAEKRRHGGGHHVHGVGFGAGVGHAEHDEKRMEPKKLDMSGMSMDTIPHLSMPLGSITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPSSTSHMTALRSLDARLNCLRALPDGLENLGGLEALNVSQNFQYLRELPYGIGLLTSLRELDVSYNSIAALPDSMGCLTKLSRFSAAGNPLVSPPMDVVEQSLDAMRAYLSARMNGTDKQDRRKKKSWVPKLVKYSTFSAGMMTPGRATKVHGSGAEGLLMSDYRSLDGGGIASPGFLSMLSPRRLFSPRRNSPKHH

SEQ ID NO: 28723 - DNA, 594 bp, Panicum virgatum
  misc_feature: Ceres CLONE 1886624
  misc_feature: Encodes the peptide sequence at SEQ ID NO. 28724
ctcccggccttccttcctagtcctcctacttgcatgctgacaagacaaccagcagccggttttggcctctcctaaacatacccaatcacaactcagcaccaaggcggcgatggccactatcctgctcctcctgctgctcctcgcattgccgccgccgtcggccgtggcgctcaattccgagggcctggcgctgctggcgttcaaggcggcggccaccgacgacccctactcggcgctctcgcggtggtccgagtcggacccggacccgtgccgctggccgggggtcacctgcgccaacgcctcctcggcctcggcctcgcccgcccagccgcgcgtcatcggcgtcgccgtggcgggcaagaacatctccgggtacatcccgtcggagctcggctcgctgctcttcctccgccggctcaacctccacggcaaccgcctggcgggcgccatccccgccgcgctctccaaagcgtcctcgctccactcgctctacctctacgggaaccgcctcacgggccgcctccccgtcgcgctctgcgacctcccgcgcctgcagaacctcgacgtctccgggaacgcgctctccggcgagct

SEQ ID NO: 28724 - protein, 161 aa, Panicum virgatum
  misc_feature: Ceres CLONE 1886624
  misc_feature (21)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MATILLLLLLLALPPPSAVALNSEGLALLAFKAAATDDPYSALSRWSESDPDPCRWPGVTCANASSASASPAQPRVIGVAVAGKNISGYIPSELGSLLFLRRLNLHGNRLAGAIPAALSKASSLHSLYLYGNRLTGRLPVALCDLPRLQNLDVSGNALSGE

SEQ ID NO: 28725 - DNA, 1202 bp, Panicum virgatum
  misc_feature: Ceres CLONE 1886685
  misc_feature: Encodes the peptide sequence at SEQ ID NO. 28726
acaacttaagtgagatctcattacattgccccaagtaagcgtttgtcttaggccccaaggtgcatactgaatcactttggagacaatgcacagcggaagcaccatcatgaccaccttctccttcaaaccacctcctccgtgcagcagcagcaggaggaggagctgccatgtccatgttggtgccgctgctgcatcgccgccgccgctcatcaggcgatgcccgagcgtttcatggaggtggcggctgcggcagcacacctgcaggttgcaacgcggacagcagtcaccgcagcagaattccaaccttgttgatgaggatgatagccggctcagtcagaacgccggcattttccatccatctatctggggagatttctttcttggctactccaacccagctgcagcttcatcgcaacagcagactcagatggcagaacgagcagacaagctcaaggaagaagtggccggaatgatagcaagttcaactgttggtggccagcatgagaggctacatctcatcgacacactggagcgtctgtgtttggatcacctgtttgaagaagagattagcgctgccttaccacagattgaggctgctggcgtcatcgactgtgatcttgggacggtggctctctggttttctctacttcggagacatcggtacagggtttcaccagatgtgtttgcgaggttcaaaaatgaagagggaggttttttagcagacaaccctgaagacctactgagcctttacaatgctgcgcatatggggacgcatggagagacaatactcgatgaagccatagtattcacccgaaggcgtttagaaacgacattacgcgacatggaagaatcatcattattagcacgcgaaataaaatctgcacttgaaatccctcttccaaggagggttagaatatacgaatcaaagcattacatatctgcatatgagcaggatgatgccacagtacatgagacggtattgcaacttgcaaagttgaactcaaatattatgcagctccaccaccagcatgatctggaaatcattacaaggtggtgggagggtttacacgttgaatcgaggtttccatttgctctatatagagttgtcgaatgctaattgtggatcttacgactatactatgaaccgtgttattcacaaagccaaataatattgacaatagattattgccatagtgacccta

SEQ ID NO: 28726 - protein, 336 aa, Panicum virgatum
  misc_feature: Ceres CLONE 1886685
  misc_feature (87)..(284): Pfam Name: Terpene_synth Pfam Description: Terpene synthase, N-terminal domain
  misc_feature: SWISSPROT Homolog: EC 4.2.3.13 (+)-delta-cadinene synthase
MTTFSFKPPPPCSSSRRRSCHVHVGAAAASPPPLIRRCPSVSWRWRLRQHTCRLQRGQQSPQQNSNLVDEDDSRLSQNAGIFHPSIWGDFFLGYSNPAAASSQQQTQMAERADKLKEEVAGMIASSTVGGQHERLHLIDTLERLCLDHLFEEEISAALPQIEAAGVIDCDLGTVALWFSLLRRHRYRVSPDVFARFKNEEGGFLADNPEDLLSLYNAAHMGTHGETILDEAIVFTRRRLETTLRDMEESSLLAREIKSALEIPLPRRVRIYESKHYISAYEQDDATVHETVLQLAKLNSNIMQLHHQHDLEIITRWWEGLHVESRFPFALYRVVEC

SEQ ID NO: 28727 - DNA, 649 bp, Panicum virgatum
  misc_feature: Ceres CLONE 1886685-R
ggagcccagcaggtgcaacttgcaatggttcggcatcaccagcagaagcttcgtctggaaggagatcgcctacgcggagcacaaggtctgattccggctcggccggcgcgtgtgcaagatcggtttgggctccgggttcaagtgtaacagcgctgtctggcgtgggctccgcgatgtggcgccgctgccccccggcggcggagttggcaggagcagaaactgcaacccgtgggtggacagcattcagaggtaccagccgaaagcgtacatctaaaacagagcgtcggttggttccgacgcagctgcggaagaactgtatgataaaagaacacgcaaaatcaaaggttataattttcgtttaatttgtttcttgatcaggaaggatcggagttggcgatcgattcttgttctatatgttgcatgtatgcccacaaggtctgtaattctgggctgcggttgggtgagcggttaggaaaatgtttttgataccaattgccaagcaatggccagcctttttctctttttttattcttcttaggtaggagtagagatcaggggatccgttgtcagttgtaacagaggggggtagtaatgtgaatgagtgtgtaaattaatttgcgttgccatgatactgatcagaagttagtcc

SEQ ID NO: 28728 - DNA, 616 bp, Panicum virgatum
  misc_feature: Ceres CLONE 1886698
  misc_feature: Encodes the peptide sequence at SEQ ID NO. 28729
atggccatggtcaagaagaaaagcgtcttgataaatactatttattatacaagttccctgactattttcgctggcactgaaatctttagccgctatagccatggcctaccttctcctcaagctcaagctcgcctacctcgtgttcgtttgtgtaactacccttccccatgccgcctcggttagcttcaactacaacttctccactcccggcgccctcaccagtcccgacctcaagtacatgtccaacgccacagccgccggcgatcggattgacctgaccgaggacacggtctggagcacggggcgcgtggcgtacgggctgccggtgcagctctgggacgacagcaccggcaaggtcgccagcttcacctccaacttcaccttcgtcatcaagccacacaacaccacctatgaccagggtgacggcatggcgttcttcgtcgcgacgtatcccccgagcctcccgaatgattccaacggcggcttcctcgggctcttcaacaaccccaacaactcggccaattccgacttcccgccgaccgtcgccgtcgagttcgacgcgttaaggaaccactgggaccccagcaacacggtgaaacacgtcggcgtggacttc

SEQ ID NO: 28729 - protein, 171 aa, Panicum virgatum
  misc_feature: Ceres CLONE 1886698
  misc_feature (25)..(170): Pfam Name: Lectin_legB Pfam Description: Legume lectin domain
MAYLLLKLKLAYLVFVCVTTLPHAASVSFNYNFSTPGALTSPDLKYMSNATAAGDRIDLTEDTVWSTGRVAYGLPVQLWDDSTGKVASFTSNFTFVIKPHNTTYDQGDGMAFFVATYPPSLPNDSNGGFLGLFNNPNNSANSDFPPTVAVEFDALRNHWDPSNTVKHVGVD

SEQ ID NO: 28730 - DNA, 692 bp, Panicum virgatum
  misc_feature: Ceres CLONE 1886755
  misc_feature: Encodes the peptide sequence at SEQ ID NO. 28731
ctagccccccgccgccgccagccctcgccctcttccaaaccctacccgcacccccgccgcggccgccatgccgccgaagctcgacccgtcgcaggtggtggaggtcttcgtccgcgtgacgggcggcgaggtcggcgcggcgtcgtcgctggcgcccaagatcggcccgctcgggctctccccgaagaagatcggtgaggacatcgccaaggagacggccaaggactggaagggcctccgcgtcaccgtcaagctcaccgtccagaaccgccaggccaaggtctcggtcgtgccctccgccgccgcgctcgtcatcaaggcgctcaaggagcccgagagggacaggaagaaggtcaagaacatcaagcacagcggcaacatcagcctcgacgacgtcatcgagatcgccaggaccatgagggctaggtccatggccaaggagatggccgggaccgtcaaggagatcctcggcacctgcgtcagcgtcgggtgcaccgtcgacggcaaggaccccaaggacctgcagcaggagattgacgacggcgaggtcgagatcccctcagcttaaaggctaaggagattgtcattgatgctgctgaagtggtgctctgttctgcatgctgttgttgtaccatcgacagcagagctcgcaaaacctccacaccttcctgaaatagccactagctttagct

SEQ ID NO: 28731 - protein, 166 aa, Panicum virgatum
  misc_feature: Ceres CLONE 1886755
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRARSMAKEMAGTVKEILGTCVSVGCTVDGKDPKDLQQEIDDGEVEIPSA

SEQ ID NO: 28732 - DNA, 2640 bp, Panicum virgatum
  misc_feature: Ceres CLONE 1886759
  misc_feature: Encodes the peptide sequence at SEQ ID NO. 28733
aagcggaggaggaaacgaggtccggaattcttggactcaccccaagtggccgagatttcagtgcactgcagtgtgaccgccccgttcctcttcctcctccgatttcaagcaccagcacaaaggtgaagagcaaatccttgtggagccaggttgtgaaaagtaccaggccgacaaacatgtccatttccgcaagaaacctccaaccacaagatcttggagctgtgatatttggttgcacaaacaataccattgcagagtgtcactcatggcaacttttcggcttgccaagagcgcatatctcctatgtacgaaacattaaggaaggactgcgtctcttcctattcaattatgatgatcgcagattgtatggcatatatgaagctgcaggcagtggtaagttctgtcctaaatcaaatgcatggtcaaatgatggccagggaaagacaagttttcctgcccaggttgcgatgcgggtaagggtgtggtgttttccgctagcagagaatcagttcagaaatgctattgtagccaactactatcagaacacacccactagtgtccctggcaagaagctgcatttttttcagtttgaattggatcatgctcagacacgtgttttgatggatatgtttactccatctcctcctcccaacaatgtttggatgccccctgttgcaacaccagctgatgagcatgtgagagagttagtatcgtcacctgtatgggcaccaaagcatgaagcgaaggtcaaaccaggaaaggttgcaaactcatatgcagacatggtaaagaagaacaaatttgaggaagtcgtgaaaggagatgtggatgaggaacatgcgagttcagataatgaatcttctaatggttttgatgatctggattgtggagacacagcaacggagagagaggggtgtgcattatcagatcaggaggttgaaatgaaacaacagcgacactctgataagaagacaaatgtgcttagtttcaaccaagtgttagaagggcatgcagctttgcctgtgcagcagtgtaatcctgatttgtatgccaatgctactgagactgaagacaatgatgcatatagcttcaagtatgcccaggaggtcaaatgtgcaattctggatggacactctaatttgccagaaaccttagatgttgaagctaatcagctctccatgggcccttctaatttgctggtgcaactattagactctgaatcatgtacagaagccaagctgatagatgtagttaaagagttatctgggcgcatagagctgatggagaagaagcaggcttggtccaacaaagaggtccaacacttacaaggggtgaatgagaggttactgaaaagaattgtggaactaaagggcacagtgaagacattgaattcaaaaataaaccctttaaccctagatgattcacttaaccagtttgttgagcaatatttgggctcagaagatgtcatttatctagttggtggttttgatggcttctcatttctgccatcactagactccttttccccttcattggatatactaacacctctcaaaccaatgcctgttgggaagtcatatgcttcaactgttgcattagatggcaaggtatttgttctcggtggtggtgatggtgcattagatggcaaggtatttgttctcggtggtggtgatggtgcttgctggtttgatacagttgactgttatgaccgaagccgtgatgattggaccacatgcccatcattgactcgtgacaaggggagccttgctggggttagtgttaatgggagaatctatgcttttggtggtggagatggaagtcagtgtttctctgacgttgagatatttgatcctcctcatggaaagtggataaagaatcagcctatgctagaaaagcgcttttctctagctggtgtagcacttaatggtgtgatttatgcagttggtggcttcaatggtgctcaatatctgagctctgctgagaggcttgatcctcgagagcctaactggaaaatgctcccaatgatgagtgcaagaaggggctgtcatacgcttgcagtgcttaatgagaagatattctcgattggtggttatgatactggggctaaagcaatggtagctaccgttgagatgtacgagccaaggatgccttcatgggtgatggttgaacccatgagctacaccagaggatactattcttcagctgtgcttggtggctcaatattcacatttggcggggtgaaaggtgaaggagatacaatcttggatgtggtggagcgatacaaggaaggctgtggctgggtgactactggtctgaagtcaattgggaagagatgctactgctccgccattgttcactgaccttatattgacatggtgaattgacgtagcttctgagatcgaatcaatgtgaatgacataacatgaatgaagatgctttacgctagtattcccttaacggccatgttgtcggcttttccggccggtcttctgcttgcttttggatatagaaaaggtatcaactccatttcagaaggaactttctggttcgagataagccatcactcgacaaaccttgtttgtgtctgtctgcagccatggaaattttgtttatatatagttaatcctccaaattaacctc

SEQ ID NO: 28733 - protein, 785 aa, Panicum virgatum
  misc_feature: Ceres CLONE 1886759
  misc_feature (523)..(582): Pfam Name: Kelch_1 Pfam Description: Kelch motif
  misc_feature (584)..(629): Pfam Name: Kelch_1 Pfam Description: Kelch motif
  misc_feature (631)..(676): Pfam Name: Kelch_1 Pfam Description: Kelch motif
  misc_feature (678)..(725): Pfam Name: Kelch_1 Pfam Description: Kelch motif
AEEETRSGILGLTPSGRDFSALQCDRPVPLPPPISSTSTKVKSKSLWSQVVKSTRPTNMSISARNLQPQDLGAVIFGCTNNTIAECHSWQLFGLPRAHISYVRNIKEGLRLFLFNYDDRRLYGIYEAAGSGKFCPKSNAWSNDGQGKTSFPAQVAMRVRVWCFPLAENQFRNAIVANYYQNTPTSVPGKKLHFFQFELDHAQTRVLMDMFTPSPPPNNVWMPPVATPADEHVRELVSSPVWAPKHEAKVKPGKVANSYADMVKKNKFEEVVKGDVDEEHASSDNESSNGFDDLDCGDTATEREGCALSDQEVEMKQQRHSDKKTNVLSFNQVLEGHAALPVQQCNPDLYANATETEDNDAYSFKYAQEVKCAILDGHSNLPETLDVEANQLSMGPSNLLVQLLDSESCTEAKLIDVVKELSGRIELMEKKQAWSNKEVQHLQGVNERLLKRIVELKGTVKTLNSKINPLTLDDSLNQFVEQYLGSEDVIYLVGGFDGFSFLPSLDSFSPSLDILTPLKPMPVGKSYASTVALDGKVFVLGGGDGALDGKVFVLGGGDGACWFDTVDCYDRSRDDWTTCPSLTRDKGSLAGVSVNGRIYAFGGGDGSQCFSDVEIFDPPHGKWIKNQPMLEKRFSLAGVALNGVIYAVGGFNGAQYLSSAERLDPREPNWKMLPMMSARRGCHTLAVLNEKIFSIGGYDTGAKAMVATVEMYEPRMPSWVMVEPMSYTRGYYSSAVLGGSIFTFGGVKGEGDTILDVVERYKEGCGWVTTGLKSIGKRCYCSAIVH

SEQ ID NO: 28734 - DNA, 691 bp, Panicum virgatum
  misc_feature: Ceres CLONE 1886761
  misc_feature: Encodes the peptide sequence at SEQ ID NO. 28735
atcgatgagatgtttcttgctcaaggacaaatcgtcgcttatggcggcaccgacaatcaagttcatcaaccttcccttgctgatcttccccatcctactccttttccatagagcctccggtgacggcgccattgcgtcggacacgctcagcaacggcggcaacatcaccgatggtgagacgacgctggtctcggccggtggctccttcaccctggggttcttctcaccggccggggtgccaaccaagaggtacctcgggatctggttcacctcgtctggtgtggacgccgtctgctgggtggccaaccgcgacgccccactcaacaacacctccggcgtactggtgatcggcgccggcgggagccttctcgtcctagacggccctcgaggtcagaccgcctggtcgtcaaacacgactaccgccggcgcctccgccgcctctacggtggcgcagctgctccactccggcaacctggtcatgagcgagaagagcagcggccgcgtcctctggcaatcgttcgatcacccatccaacaccttgctcgccggcatgaagttcggcaagagcctgaagaccggcacggagtggtccctcacgtcgtggcgcgagcgggacgacccggcgaccggggaataccgccgggtcatggacacgaagggcctgccggacatcgtcacctgacgtggcaag

SEQ ID NO: 28735 - protein, 213 aa, Panicum virgatum
  misc_feature: Ceres CLONE 1886761
  misc_feature (81)..(195): Pfam Name: B_lectin Pfam Description: D-mannose binding lectin
MAAPTIKFINLPLLIFPILLLFHRASGDGAIASDTLSNGGNITDGETTLVSAGGSFTLGFFSPAGVPTKRYLGIWFTSSGVDAVCWVANRDAPLNNTSGVLVIGAGGSLLVLDGPRGQTAWSSNTTTAGASAASTVAQLLHSGNLVMSEKSSGRVLWQSFDHPSNTLLAGMKFGKSLKTGTEWSLTSWRERDDPATGEYRRVMDTKGLPDIVT

SEQ ID NO: 28736 - DNA, 683 bp, Panicum virgatum
  misc_feature: Ceres CLONE 1886763
  misc_feature: Encodes the peptide sequence at SEQ ID NO. 28737
caaatggtgatactctggattgtaattggcttaatggactggctcatggaaaaggattttgcaaatatgcatcaggagcatgttacatcggtacatgggacagggggctcaaggatgggcatggtatgttttatcaacccgggagtaaaattccttgtaaccttgaagtgtctgagtgcgtaacagaccatgatgtttctagtgctgcaagttccggtaatgaaaatgtcaatagtggactcttgtttctgttgcaaaaactttgcaacacgtggagaatacgcaaccttttccatcgacccaggcgtatttcaaatggtactgcaccagtttttgatgataattctggaaatcacttgtcagaagattcatctactgaacctttgacaactggtgattgtctacaagatagtggagttgataaagtattagtctatgagcgggaatatgtacaaggagtacttatctcggaaaagccaaaaggtcatgattgcagattgccggatagtggtaaaacacaggagcatacctggcaaaaacaagctggtgggcccatggagactatttacaaaggccacaggagctattacctaatgcttaatctgcaactcggcatcaggtatactgtgggcaaaatcacccctgtgccattgcgtgaagtccgttcaaatgatttttggacc

SEQ ID NO: 28737 - protein, 226 aa, Panicum virgatum
  misc_feature: Ceres CLONE 1886763
  misc_feature: SWISSPROT Homolog: EC 2.7.1.68 1-phosphatidylinositol-4-phosphate 5-kinase
NGDTLDCNWLNGLAHGKGFCKYASGACYIGTWDRGLKDGHGMFYQPGSKIPCNLEVSECVTDHDVSSAASSGNENVNSGLLFLLQKLCNTWRIRNLFHRPRRISNGTAPVFDDNSGNHLSEDSSTEPLTTGDCLQDSGVDKVLVYEREYVQGVLISEKPKGHDCRLPDSGKTQEHTWQKQAGGPMETIYKGHRSYYLMLNLQLGIRYTVGKITPVPLREVRSNDFW

SEQ ID NO: 28738 - DNA, 1939 bp, Panicum virgatum
  misc_feature: Ceres CLONE 1886775
  misc_feature: Encodes the peptide sequence at SEQ ID NO. 28739
aaccgtcgccggcccacctcgacccaattaagccgcccgcccccgcggcgcgatccggtggccaccgccgccgctgccccgccggagcgacgaggaggaaaggaggggggagcgcgcggggggatgctggaggcgaagccgccgtcgccgggctccggcgcggcggcgcacatccacggccaccggcggtgggcggcgccgctgctcgcgtcggtcctgctctcctcgctcctcatctccgcgtcgctcttcttctcctcctcccgcgcgctgctcctctccttctcgccgctccccaccgcggcctccgccgagccgctcttcgtcgaggccaagctccgccagcagatgcgggccgaggagcgcccgccgccgcccgccgtgcccaggatcgcctacctcatctccggctccgcgggggacggcgccgcgctgcgccggacgctcagggcgctctaccacccggccaacacctacgttgtgcacctcgacctcgaggcccccgccgccgagcgcgccgagctcgccgccgccatccgagcggaccccgtctacgcccggttccgcaacgtcagggtcgtcacacgcgccaacctcgtcacctaccggggcccgaccatggtcgccaacacgctgcacgcggcggccatcctgctgcgcgagggaggcgattgggactggttcatcaacctctccgcatccgactacccgctcgtcacccaggacgatctattgcatgtgctctctgagttgcccaggcagcttaacttcatcgagcataccagcgacatcggatggaaggagtaccagagggcaaaaccagtgatcatcgatcctgggctatacagcctgcagaagtctgatgttttctggattacagaaaaaaggagtgtcccaactgcattcaagctttttactggttcagcatggatgatgcttactcatcagtttattgaatactgcatatggggatgggacaacctaccaaggacagtcctgatgtattatgccaactttctttcttcaccagagggttacttccacacagttatctgcaatgtcccagagttccgcaacaccacagtcaaccatgatctacatttcatttcttgggacaacccaccaaagcaacatcctcattatctcacagtcgatgactttgaaggtatgcttaacagtaatgctccctttgcaagaaagttcggaagagaagatccagtgctagacaagatcgaccaggaactattgggccgccaacctgatggatttgtgcctggtggatggacatatctgttgaatacaactgagaaaggaggacccttcactgttgaacgtgtgcaagatctccgcccagggcctggagtggacagattaaagaaacttgtcacaggcttgctcacccaagaaggttttgatgacaagcattgcttgtgaaactcccagtaagatgattctggggcattaggtttacacggtcaaatttgaggtgagggcattgagccatttgctagtaatctctactagctgaagaagcagcacgtaactcatgtccgcgtggatgcaacgataagataggtgctcttatagacagaccgcttgagttgagttaccgtacagcaggagaccacaaatgtagcaggcggagattatacagaactagtagctcattaggttatggtagatgattatatcagcccccaaccatcaataatcttggaatttttgacatctctgcgctgcgggttatgcaaggtggcccatagcttgtcttgtctgggagccatggcaccaaccaccgggtatttaccagctggtagcgcgggagacttcgttgtattgactagcagatatttctgggaaaactgatacatttgattgcacacatgtattcttttatttcttctcctttttgatgagtatagcaaaatgtttgtgctgt

SEQ ID NO: 28739 - protein, 436 aa, Panicum virgatum
  misc_feature: Ceres CLONE 1886775
  misc_feature (90)..(315): Pfam Name: Branch Pfam Description: Core-2/I-Branching enzyme
  misc_feature: SWISSPROT Homolog: EC 2.4.2.26 Protein xylosyltransferase
MLEAKPPSPGSGAAAHIHGHRRWAAPLLASVLLSSLLISASLFFSSSRALLLSFSPLPTAASAEPLFVEAKLRQQMRAEERPPPPAVPRIAYLISGSAGDGAALRRTLRALYHPANTYVVHLDLEAPAAERAELAAAIRADPVYARFRNVRVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTVDDFEGMLNSNAPFARKFGREDPVLDKIDQELLGRQPDGFVPGGWTYLLNTTEKGGPFTVERVQDLRPGPGVDRLKKLVTGLLTQEGFDDKHCL

SEQ ID NO: 28740 - DNA, 356 bp, Panicum virgatum
  misc_feature: Ceres CLONE 1886826
  misc_feature: Encodes the peptide sequence at SEQ ID NO. 28741
gatattgaaagaagggtcagagctgtgattgacaaatttgctgagcgtggtctgcgagcccttggtgtggcttaccaggaagtgccagatggaaggaaagagagtcctggaggaccgtgtcagttcatcgggctcttgccactttttgacccccctcgtcatgatagtgcacaaactatcagaagggcactcgatcttggtgtcaatgtaaagatgattacaggtgatcagcttgctattgggaaggagacagcacgtctgttgggaatgggtaccaatatgtacccttcatctgctttactcggacaggataaggatgagtcaattgcttctttgccagttgatgagttgatcca

SEQ ID NO: 28741 - protein, 118 aa, Panicum virgatum
  misc_feature: Ceres CLONE 1886826
  misc_feature: SWISSPROT Homolog: EC 3.6.3.6 Proton-exporting ATPase
DIERRVRAVIDKFAERGLRALGVAYQEVPDGRKESPGGPCQFIGLLPLFDPPRHDSAQTIRRALDLGVNVKMITGDQLAIGKETARLLGMGTNMYPSSALLGQDKDESIASLPVDELI

SEQ ID NO: 28742 - DNA, 1368 bp, Panicum virgatum
  misc_feature: Ceres CLONE 1886829
  misc_feature: Encodes the peptide sequence at SEQ ID NO. 28743
actactcgtcaacgaagctagctccttatccgcccatggctcctgccctccgcggctgccccggctacaccgcagtctcgtacatgctgccgccgcgagctcctgaagctggttgtctctcgctgctacactgcacggtcggccctccctgccgcagtctcgcgctcccgcagcaatcccccgccatcagcctcgtgctcccaccgccgcctcgagtttctgcagccgtctccggccgccgtcgcatgttgccgcagccggccatccacgccgcggcctcgcgctcccacgggtgctcgtctcccgccgccgtgtacgcgttgctcgcctggggcccgcctcctctgccttcgccgtggcccgccgccgcccggcctcccaccctgccgcgccatgggccacgagctcccgcccagccagccgccaaggaggcccggcgcgcgcagacgaggggcaaagatggcaggggtctcgcggagccgcccggagccacgtttttgtggctcctcctccacggaatcgctccagagaccaggattcccggggcttcaccgccggagccgtgcccctttagagggccgtcttctgctgaagccctcccaaggagggccgtctcgccaatcgccattattaagagctccgcggatccaaaatttcgccccccaaatccttgctgccagtgcccccctttcccttctctccgtgctttccctcgcgcttcagttacctctcccgcgcaaagcatcatcccccccagctggaacccaccgttgcctgcaagcttaaccttgaagcttccgattacctttccgctccttgtccatttgcgaagggatatagcgtgtagggcctgcggaaatgcgccttcacgcggaggtgctggacgagatggaggggcaggaggatgagggagctgtgatggcctcggcggctctgtcgccgccgctcatcggcgcggcggcggcggctgccacggcccccaggctagtggtgggctacgccctcacgaagaagaaggtgaagagcttcctccagcccaagatgctcctgctggcgaggaaaaacggaatcagttttgtctctattgatgagtctcttcccctctcagaacaaggaccttttgatgttattttgcacaagattactagcaaggagtggcagcaggttctggaggagtaccttgaagaacatccagaagttactgtcctcgaccctccaaatgctatcgagcatctgaacaatcgacaatcaatgcttgaggaagtagctgatttgaacctatcaaatttctatggagaagtttgtaccccacgccaactggtcattacgaaagatccatcctctataccaacagcagtagcaatggct

SEQ ID NO: 28743 - protein, 169 aa, Panicum virgatum
  misc_feature: Ceres CLONE 1886829
  misc_feature (36)..(169): Pfam Name: Ins134_P3_kin Pfam Description: Inositol 1, 3, 4-trisphosphate 5/6-kinase
MRLHAEVLDEMEGQEDEGAVMASAALSPPLIGAAAAAATAPRLVVGYALTKKKVKSFLQPKMLLLARKNGISFVSIDESLPLSEQGPFDVILHKITSKEWQQVLEEYLEEHPEVTVLDPPNAIEHLNNRQSMLEEVADLNLSNFYGEVCTPRQLVITKDPSSIPTAVAM

SEQ ID NO: 28744 - DNA, 542 bp, Panicum virgatum
  misc_feature: Ceres CLONE 1886829-R
tattgtagagcttcctccaaggccacttctagagaaactggggagggagcttcgtagccggctggggttgagattgttcaatgttgatatgattagagaacttggaaacaaagatcggtactacataattgacatcaactacttcccaggttttgggaaaatgccaggatatgagcacatgttcactgacttcttactgagtcttgcacaaagcaaggtcaaaaggtacttaagcgggacctgaagcgcaagggagtttgcgaagaggcgtcactgacaaaatggcatataacggtggcagctgtgcttccccaccgatgtacaaattccggagacataagcataagccggaggctcgaggaagttgcagtgtgtttcttcagaagtggtggtacatgctggatcctgagtaggaataaccaaggaaatgtttggatggcctatgcccatgtagtaaaatgttgtttactgaatgcataccttcttcgtgatggcctcctttcatcataatttggcgaccggtttttttggggccaagcttc

SEQ ID NO: 28745 - DNA, 550 bp, Panicum virgatum
  misc_feature: Ceres CLONE 1886856
  misc_feature: Encodes the peptide sequence at SEQ ID NO. 28746
gtcctctgcaatcgccaaggccaggcccgccgcgcagagtggactcactggtcactggtagctcgatcgatcggatcatcggaggcaggcatggcgtccgggaagcacttcaagtacgtcatcctcggcggcggcgtcgcggcggggtacgcggcccgggagttcgccaagcagggagttcagccaggggagctcgccatcatctccaaggaggcggtggctccatacgagcgtcctgccctcagcaagggttacctcttccctcagaatgctgcaaggctcccaggattttatgtgtgtgtcggaagtggtggagagaggctattgcctgaatggtactcagagaaaggtacaaatcaaaattctcttacagactttacagtgttaaatcgcgtttcaatgcttttggtactcagagaaagcgtttcaatgcttttgtaaaatccttcattttacactgtccatttgaacttagctgctgcctgctgggtagtcctttaaggagtatgcttgatggaacttcaaatttttccaacctagcttgtaaagc

SEQ ID NO: 28746 - protein, 116 aa, Panicum virgatum
  misc_feature: Ceres CLONE 1886856
  misc_feature: SWISSPROT Homolog: EC 1.6.5.4 Monodehydroascorbate reductase (NADH)
MASGKHFKYVILGGGVAAGYAAREFAKQGVQPGELAIISKEAVAPYERPALSKGYLFPQNAARLPGFYVCVGSGGERLLPEWYSEKGTNQNSLTDFTVLNRVSMLLVLRESVSMLL

SEQ ID NO: 28747 - DNA, 2254 bp, Panicum virgatum
  misc_feature: Ceres CLONE 1886869
  misc_feature: Encodes the peptide sequence at SEQ ID NO. 28748
aagatcgcacctccccgcgtggcgatgcgtggaggagacgcaggagcagcagcggaggcagggtccccgcgctcgccggacctctacgacctctccgacgactccgactacgccgcagccgcctccgaccacacggcgatgcggacggatttggtggacagaggctcggatgagacggcaaggattgacgtggtttatgagaaggagcgtgtgaccatccacccgacgcagtatggctctggcgggatcagtgggaagctgcgcctgtttctgcagcaaggatcattgttcctgagctgggagccaaatgaaggagccgactctttgtcaaccagttcatttggtgttgaaatagaaaaatatagaaatctgtacactatcaaggccttgcccttaagtgatgtccgcttcatccgtaagcataccccaacatttggattggactacataataattgttctatcatcaggcctggcttttcctccattctatttctacaatggcggaattcgtgaattgtttgcgacattgaaacaacacgtcttcattatcaggtcggatgacgatcctaatgtttttcttgtcaacgactttcaagatcctcttcagaaaagcttgtcatccctggagcttccaggagtggccacagtggcaaatgccatgtcacgacaaaattcactcagtttcactgggtcagttgatgagaccaggcatggggctgatgaaagacttggggaagcttctagtatgtctcagtatggctcaaagcaaaagcacaaatcaaatgacccaggtcgtgatctttcaattcaagtcttggagaaattctcattggttacaaagtttgcacgtgatactacatcaagcctctttcgagacaatagtggtgcccatggttatggacggcaacaacatgaatatgtctttgataataaagcaagtgataagtacaaaaaccagtatgtagcaccagaaaaggcttctataccctcagctccacttgagtcagatccattgcctctggtatggggaaaacaaagagattgcccattaagtgtcgcagagtggacagctttcttagatcctgaaggtagagttatggattcgaaggcgctgaggaaaaaggtcttttatggcggagtcgaacatgttctgagaaaagaggtgtggaagttcttgttgggctatcatgaatatgattcaacatatgctgagagggaataccttgctgccatgaaacgagcagaatatgaagctataaaatctcagtggaagagtatctcagccacccaagctaaaagattcaccaagtttagggaaagaaaaggcctcattgacaaagatgtggtgagaactgataggtctgttccctattatgaaggagatgacaatcagaatgttgtagttctacgtgatattctgttaacatattccttctacaatttcgaccttggttactgccaaggaatgagtgactttttggctcccatactttatgtcatggaggatgagtccgaatcattttggtgctttgcttccttgatggaacgtttaggagccaattttaatcgtgaccagaatggcatgcatgctcaactacttgcattatccaagctcgtggagcttcttgatcctccattgcataactattttaggcagaacgactgcttgaactatttcttctgtttccgctgggttcttatacagttcaaaagggagttcagttttgaccaggtcatgctcttatgggaagttttgtggacccattatttgtcagaacacttccacttgtacttgtgcgtagcaatcttgaagagataccgtcagcgtataatcggggagcagatggactttgataccctcctcaagttcatcaacgagctcagtggtcagatcaatcttgaccgggctatccaggatgctgaggcattgtgtactattgcaggagaaaacggggcatcttgtattccacctggaaccccaccttcaatgcccattgagaccgatggtggcctctacgtgcaagaagatgaggttttatgagatttcaccggtcacattagaaaataagtgcacagaagcatctcatcagtgtctatccggtactggtttcatgtatgtcataaatttgatgagttgtaagtttataccaatggaggaattataaagtcttagcgttgtgtgtatataatccctcgaccctcgttaagcctgtaattgacacttgctttcgctgaatggatacaggttatcc

SEQ ID NO: 28748 - protein, 672 aa, Panicum virgatum
  misc_feature: Ceres CLONE 1886869
  misc_feature (369)..(606): Pfam Name: TBC Pfam Description: TBC domain
MRGGDAGAAAEAGSPRSPDLYDLSDDSDYAAAASDHTAMRTDLVDRGSDETARIDVVYEKERVTIHPTQYGSGGISGKLRLFLQQGSLFLSWEPNEGADSLSTSSFGVEIEKYRNLYTIKALPLSDVRFIRKHTPTFGLDYIIIVLSSGLAFPPFYFYNGGIRELFATLKQHVFIIRSDDDPNVFLVNDFQDPLQKSLSSLELPGVATVANAMSRQNSLSFTGSVDETRHGADERLGEASSMSQYGSKQKHKSNDPGRDLSIQVLEKFSLVTKFARDTTSSLFRDNSGAHGYGRQQHEYVFDNKASDKYKNQYVAPEKASIPSAPLESDPLPLVWGKQRDCPLSVAEWTAFLDPEGRVMDSKALRKKVFYGGVEHVLRKEVWKFLLGYHEYDSTYAEREYLAAMKRAEYEAIKSQWKSISATQAKRFTKFRERKGLIDKDVVRTDRSVPYYEGDDNQNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQVMLLWEVLWTHYLSEHFHLYLCVAILKRYRQRIIGEQMDFDTLLKFINELSGQINLDRAIQDAEALCTIAGENGASCIPPGTPPSMPIETDGGLYVQEDEVL

SEQ ID NO: 28749 - DNA, 1421 bp, Panicum virgatum
  misc_feature: Ceres CLONE 1886871
  misc_feature: Encodes the peptide sequence at SEQ ID NO. 28750
gtttttagagggcgcatccttgacacaagctctcgcgaatctttagagtgaagctcccatcccatcagccgttgttcctcggcgttcctctgcttgtctctgtcgtgacaattgtggggtaataaaagaggaaacggtaaaggtctgaaacttgattccccaagatttgcctctgaatcttcccaagggccacacaaatctgaatctcgcccatggagacccttactgcatgacacttcatccgagtctagcgtgagacactagaagcagcaaaggagtctggtcggagttgggcgttcgcgtgacgttgctgatccaatgggggagacgaaccagccgccgccgcctcaggtggccgcgccgccgcccatgatgcccatgatggcgccggccgtcggcgccggcgccatccacccgccccatgagcagttccaccatctcgcctactgcgtccactccaatccgtcttgggttcaggtggcagcactggcattccttcactatcttgtgatgttgggctcaactgttatgcttgcatcaattattgttcctgcaatgggtggtaatcctggggataaggctcgagttattcaatcattcctatttatgagtggcataaatacattgctgcaaacacttattggaacgagacttccaacaattatgaatgcctcctttgcatttgttgtccccgtgctatcaatagccagagacatggatccaaataacttcacaaataatcaccagagatttctccatacaatgagaactacgcaaggagctctgattgttgcttccatcctcaacatgattcttgggttcagcacaatatggggggcatatgctaagaaattcagtcctgtaataatgacccctgttgtttgtgtcgttggtcttggactattcgaacttggttttccccaggttggtaaatgtgtggaaattgggttgccaatgctcattcttacggtgatcgtgcagcagtatgtgccacattacttcagtcatatccatgagcggatcacctacttgtttgagaggtattcgttgcttctttgtattggcattgtgtgggcctttgcagctatccttactgctgcgggtgcatacaatcatgtttcacctaagacgcagcagcactgccgcactgataggtctttcctgatgtcatctgcaccatggattaaaattccataccctttccaatggggtacgccaatcttcactgctggtcattcatttgggatgatgggtgctgtacttgttggagcctttgagtcaactggagcacactttgcaactgcacgtctggcgggtgctacaccacctccaggtcatgtccttagtcgaagtgttggcttgcagggtattgggatgttcctggaggggatcttcggtgctccagcaggttcatctgtatc

SEQ ID NO: 28750 - protein, 367 aa, Panicum virgatum
  misc_feature: Ceres CLONE 1886871
  misc_feature (52)..(367): Pfam Name: Xan_ur_permease Pfam Description: Permease family
MGETNQPPPPQVAAPPPMMPMMAPAVGAGAIHPPHEQFHHLAYCVHSNPSWVQVAALAFLHYLVMLGSTVMLASIIVPAMGGNPGDKARVIQSFLFMSGINTLLQTLIGTRLPTIMNASFAFVVPVLSIARDMDPNNFTNNHQRFLHTMRTTQGALIVASILNMILGFSTIWGAYAKKFSPVIMTPVVCVVGLGLFELGFPQVGKCVEIGLPMLILTVIVQQYVPHYFSHIHERITYLFERYSLLLCIGIVWAFAAILTAAGAYNHVSPKTQQHCRTDRSFLMSSAPWIKIPYPFQWGTPIFTAGHSFGMMGAVLVGAFESTGAHFATARLAGATPPPGHVLSRSVGLQGIGMFLEGIFGAPAGSSV

SEQ ID NO: 28751 - DNA, 697 bp, Panicum virgatum
  misc_feature: Ceres CLONE 1886871-R
tttgcatcaatttccactgccaatcttcgcagcaatttactgcatcttgtttggcatcgtagctgctgtgggagtctcattcatgcagtttgccaacaagaactcgatgaggaacatctacatcattggactctcgttgttccttggtatttcagtccctcaatactttaatgaatatacttcttctgctggccgtggacctgcccgaacaaatgctggatggttcaatgacattataaacaccgtgtttgcttctggcccaacagtggcgctgattgtctcctctgttctggataacacattggaggccaggggctacgactctgaccgagggctttcatggttcacgccgttcctgcgccgccacaaaggttactcggacccgagaaacgatgagttctacagtttcccaatcagggttcacgacttcgtcccgagtcggttcctctgactttctcatgagcgctgttactgcgcatgtaaatctctttgttcttggtagtcttactcctgtgacctgtagtgattggttctctacattctagtgggatatgggtacaagaatgtttaggaaatttgctttatttaccccttctgcgctaagaaatggtaacatgacaatgtagggctgcgtgcccaggcgtatggttttgggaaggattacagaagaatagcaccttacttgttgatgacttcc

SEQ ID NO: 28752 - DNA, 1511 bp, Panicum virgatum
  misc_feature: Ceres CLONE 1886872
  misc_feature: Encodes the peptide sequence at SEQ ID NO. 28753
ggggaatccgggagaagagaggcaggaaggaagggcgtccaccgaccgggctccccgctgctgctcccatggggaactgcctcggctcggaggaagccgaattggagctcgataagagcgccggccgccatgggcagccccacggtaccaccacttcctgatctggcttgcattacttcttgctagctagcagcaggcatcggtatatctcgcgctgatttccccaactggttcatgacgcgatttcgtttaacccaagcactcctcagattcagttttgctcacgatcgacgtgcaattttctcctcgtttctccagcggcacctgcgcgggcggtccccatggcgccaccagagcagccgggcccttccatgagcacgagctcgtcggggcaccccagcagcaggtccccgggctcgtccatgagcagcgccgcgaccacccggagcggcggcggcagcagcggcagctgcagcagcagcagcagcctggcggcggtggcggcgtccccggagggccgcatcctggaggcgcccaacctccgcgtgttcaccttcgcggagctgcgggccgcgacgcgcaacttcaagctcgacacggtgctcggcgagggcgggttcgggcgcgtgtacaagggctgggtcgacgagaagaccatgaaccccacgcgctccggcatcggcatggtcgtcgccgtcaagaagctcaaccccgagagcgtgcagggcctccaggagtggcagtcggaggtgaactttctcgggaggctgtcgcatcccaacctggtgaagctgctgggctactgcgtggaggatcgagagctgctgctcgtctacgagttcatgcccaagggcagcctggagaatcatctcttcagaaagggtggatccttcgaaccgattccctggaacctcaggctccggattgccatcggcgcggcccgtggcctcgccttcctccacacgtcggagaagcaaatcatctaccgggacttcaaggcctcaaacatcctcctcgacacgcactacaacgccaagctctcggatttcggcctcgccaagaacggccccaccggcggcgacagccacgtcaccacgcgcgtgatgggcacctacggctacgctgccccggagtacgtcgccacagggcacctgtacgtgaagagcgacgtgtacggcttcggtgtggtgctgctggagctgctgacgggcctgcgcgcactggacacgggccggcccgcgcagcagcacaacctcgtggactgggccaagccgtacctggccgaccggcggaagctggcccgcctggtcgacccgcggctcgagggccagtacccgtccaaggccgcgctgcaggcggcccagctcacgctgcgctgcctcgagggggaccccaggagccggccctccatggccgaggtcgtggcggcgctcgaggagatcgagcagatcagggcgcggccgcgggaggagcggcggcgggagcgggacgaggcggcggcgcacgggcac

SEQ ID NO: 28753 - protein, 389 aa, Panicum virgatum
  misc_feature: Ceres CLONE 1886872
  misc_feature (82)..(364): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
MAPPEQPGPSMSTSSSGHPSSRSPGSSMSSAATTRSGGGSSGSCSSSSSLAAVAASPEGRILEAPNLRVFTFAELRAATRNFKLDTVLGEGGFGRVYKGWVDEKTMNPTRSGIGMVVAVKKLNPESVQGLQEWQSEVNFLGRLSHPNLVKLLGYCVEDRELLLVYEFMPKGSLENHLFRKGGSFEPIPWNLRLRIAIGAARGLAFLHTSEKQIIYRDFKASNILLDTHYNAKLSDFGLAKNGPTGGDSHVTTRVMGTYGYAAPEYVATGHLYVKSDVYGFGVVLLELLTGLRALDTGRPAQQHNLVDWAKPYLADRRKLARLVDPRLEGQYPSKAALQAAQLTLRCLEGDPRSRPSMAEVVAALEEIEQIRARPREERRRERDEAAAHG

SEQ ID NO: 28754 - DNA, 1478 bp, Panicum virgatum
  misc_feature: Ceres CLONE 1886875
  misc_feature: Encodes the peptide sequence at SEQ ID NO. 28755
agtcacacaagcacacgagcttgatctcacactagctagctagccactcgagagcgaccgagcgagggggacagagaggaagagcgctcgtcacgagctagcctagctacacgacacagccagccagccagcggcgcgcgccagcagcagggagagagacatgccggaggcgccgggagccatgcgagaggcggcggcgcccgaggcgcaccgcgaggcgctcgagtacatcgagcgcgtgacggcgggcgcggcccaggtgcagcgcggcgtgctggcggagatcctggcgcagaacgcgccggccgagtacctgcgccgcctgggcgtcgcgggggacgcgccgggcgccgccgaggtgttcctccgcgccgcgccgctcgtcacctacgagaacatcctccaggacgtcctgcgcatcgccaacggcgacacctcgcccatcctctccggcaagcccatccgcgagttcctcaccagctccggcacgtcgggaggggagcggaagctgatgccgtcgatcgccgacgagatggaccggcgctcgctgctctacagcctgcttatgccggtcatgagccaggccgtgccggggctgaacaagggcaagtgcatgtacctctacttcgtcaaggccgagtcgcgcacgccggccggcctcccggcgcgcccggtgctcacgagcttctaccggagccgccacttcctcgagcgcccgcacgacccctacaccgtgtacaccagccccgacgaggccgtcctctgcgtggacgcctaccagagcatgtacgcgcagctgctctgcggcctcgtgcaccgcgccgacgtgctccgcgtgggcgccgtcttcgcgtcgggcttcctccgcgccatccgcttcctggagaagcactggcagcgcctgtgccgcgacatccgcgccggcgcgctcaacgccgagatcaccgaccgctccgtgcgcgccgccgtggagcgcgtgctgctccgcgccgacccggcgctcgccgacgcggtggaggccgagtgcgccaggccgtcgtgggagggcatcatccggagggtgtggcccaacaccaagtacatcgacgtcatcgtcaccggcgccatggcgcagtacatccccacgctcgagttctacggcggcggcctgccgctgacgtgcaccatgtacgcctcctccgagtgctacttcggcatcaacctcaacccgatgtgcaagcccagcgaggtcgcctacaccctcatccccacgatgggctacttcgagttcctccccgtcggctccgacgccgccgagccccagccccaccaccgcgacctcgtggacctcgtcgacgtcaagctcgaccacgagtacgagctcgtcgtcaccacctactccgggctgtatcgctatcgcgtgggcgacgtgctgcgcgtggccgggttcaagaaccaggcgcccatgttcagcttcgtccgccgcaagaacgtggtgc

SEQ ID NO: 28755 - protein, 439 aa, Panicum virgatum
  misc_feature: Ceres CLONE 1886875
  misc_feature (19)..(439): Pfam Name: GH3 Pfam Description: GH3 auxin-responsive promoter
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
MPEAPGAMREAAAPEAHREALEYIERVTAGAAQVQRGVLAEILAQNAPAEYLRRLGVAGDAPGAAEVFLRAAPLVTYENILQDVLRIANGDTSPILSGKPIREFLTSSGTSGGERKLMPSIADEMDRRSLLYSLLMPVMSQAVPGLNKGKCMYLYFVKAESRTPAGLPARPVLTSFYRSRHFLERPHDPYTVYTSPDEAVLCVDAYQSMYAQLLCGLVHRADVLRVGAVFASGFLRAIRFLEKHWQRLCRDIRAGALNAEITDRSVRAAVERVLLRADPALADAVEAECARPSWEGIIRRVWPNTKYIDVIVTGAMAQYIPTLEFYGGGLPLTCTMYASSECYFGINLNPMCKPSEVAYTLIPTMGYFEFLPVGSDAAEPQPHHRDLVDLVDVKLDHEYELVVTTYSGLYRYRVGDVLRVAGFKNQAPMFSFVRRKNVV

SEQ ID NO: 28756 - DNA, 525 bp, Panicum virgatum
  misc_feature: Ceres CLONE 1886875-R
  misc_feature: Encodes the peptide sequence at SEQ ID NO. 28757
cgtggaggaggccctgaacagcgtctaccgccagggccgcaccgccgaccgctccatcgggccgctggagatccgggtggtctcggagggcacgttcgacaagctcatggactacgcgctcgcccgcggcgcctccatcaaccagtacaaggcgccccggtgcgtgcgcccgggccccctggtggagctgctcgacggccgggtgcaggcccgctacctgagccccaagtgccccaagtggagccccggcggcggcaagcaatggagcagcaacgccgccgccgccgtcacgatggcggccgacatcaatgccggaggggcggtcgtcgcctgatggatacagctgctaggatatacactagccggtcaatcttggaagaaatcgttagtggccgatcgatccgagccgtgcatggcaatgagtgattatagctagctaatcatcgagtgcggtagcttcatcgtggcttttgtttctttctcttttctgtggttttgtaataaagatgtagttacttgtgcccc

SEQ ID NO: 28757 - protein, 110 aa, Panicum virgatum
  misc_feature: Ceres CLONE 1886875-R
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
VEEALNSVYRQGRTADRSIGPLEIRVVSEGTFDKLMDYALARGASINQYKAPRCVRPGPLVELLDGRVQARYLSPKCPKWSPGGGKQWSSNAAAAVTMAADINAGGAVVA

SEQ ID NO: 28758 - DNA, 2217 bp, Panicum virgatum
  misc_feature: Ceres CLONE 1886915
  misc_feature: Encodes the peptide sequence at SEQ ID NO. 28759
aagacaaaccgcacgcacgccgcccggaacgtcggatccacgcacaccagccgccgccgccgcctcatcctcccagatggcggcggcctcgccggagaagaggcctcctcgctcgctattcgaccttccgtctgagttcttcgattcaacagctctcctccgggctcatccctccacggccccctccgcagtggaaccgtccgagccctcccgcccaccgccgacgactcagcagcagcagcaaccgtcagaggctgtggggtccaggtggacgtgcaacacctgcgctgccgagtttgaatcgctgcaggagcagcgcgagcacttcaaatccgacctacaccgcctcaacgttaagttgagcattgctggtaaagctattataaaggaagaggacctagacaaagcagattctgattccctgtttgatgatttggagatatccagcgtatctggatcggaagatgaactagaaaatagacctgcatcagagcgtggactctcagttaaaggcaaggaagaattcaggaagaagctttattttcggcatcaattgggtgacacaatttcaatctggagatgcatactgttgaaagaacatgaagaaccatttattgattgcaagtctggtcagatggacagtgcatcttgtgtagaagaggatgaggtgataaatagggcgaagtgtttgacatgtgaacctcgtgatgcgtcacatttgaggattgttctactaacaagcggtggacattttgctggatgtgtttttgacggtaattccgtcatagcacataaaacatttcataggtatgtggtaagagcaaaggctggaaagaggcaatctggaaaagatgctactggcaaagttgcgcactcagcaggctcttctcttcgacgctataatgaagcagcattgaaaaaggaagttcaagaattaattgtttcgtggaaatcatactttgacacctgtgtttgtgcctttatatacgctccatcaaagaaccgccagatgctctttgatggcgataagactcagtcggtaattcaggcttgtgatattcgctcagttcccttgactgttcatcggcccaccctgaaggaagctaagcgagtatacagtaacctaacacagctccattatgagatggaatgtacaactacagatgaaaccttaccccatggtcaaagtgtgacaagtgttgaagaaagtgaagggaaaaagaaggaagtggctgtggacaccgaggaatctatttctaacttatctgtcagtttggagttgttgaacaaaaatgaagaagtaatcataccattatccaataagaaagaaacaacccctcttcacgaggcagcaaaatctggcgatgcacagctgaccctggagttacttgagcagggtttggatccttgcatcaaagatgcaaggggaaagactccttacttggtagcttcggataaggaagttagaaatacattcagaagatttatggctctcaaccttgacaaatgggattggcatgctgcagatgtgcctagtgcactgacaaaggaaatggaagaatcacaagctgcaaaacaggcagagaaggatgccaagaagaaagcgcgtgcgaaagaattgaagaagttaaagaaagcaagagaaaaggaggagaaggagaaggaaaaagaaaaggcaaaggctcaagcatcacaatcccaaacttcgatgggccaaatggccaacagaactacttctgtgccaggccttaaaccaaagcatcagacgccacagcagatccttattgcaaaggaggaggaacaacaaaggaagctagcggaagaaagagagaagagagcagcggcagcagagagaagactcgcggccctggctgctcaatctgcgggcacatcaggtgcagctgcagcaccaacaaactccgtgcagaaggcagcgccagacgacaattcttgttcgtgctgtttcacttccttggccggcaaagtgccgttccaccgatacaactacaaatactgcagcactacgtgcatgcatcttcattcagaaatgctgcaagatgagtgaggaaattgtatgctgagattcacatgattttttatggtatatttacctcatatcaatagcagacggttcacccagtttttcataattctcttgtgcgcatataaactcttggggtgcgaaatgtttttgttccgtgataatctttttgcttc

SEQ ID NO: 28759 - protein, 662 aa, Panicum virgatum
  misc_feature: Ceres CLONE 1886915
  misc_feature (417)..(449): Pfam Name: Ank Pfam Description: Ankyrin repeat
MAAASPEKRPPRSLFDLPSEFFDSTALLRAHPSTAPSAVEPSEPSRPPPTTQQQQQPSEAVGSRWTCNTCAAEFESLQEQREHFKSDLHRLNVKLSIAGKAIIKEEDLDKADSDSLFDDLEISSVSGSEDELENRPASERGLSVKGKEEFRKKLYFRHQLGDTISIWRCILLKEHEEPFIDCKSGQMDSASCVEEDEVINRAKCLTCEPRDASHLRIVLLTSGGHFAGCVFDGNSVIAHKTFHRYVVRAKAGKRQSGKDATGKVAHSAGSSLRRYNEAALKKEVQELIVSWKSYFDTCVCAFIYAPSKNRQMLFDGDKTQSVIQACDIRSVPLTVHRPTLKEAKRVYSNLTQLHYEMECTTTDETLPHGQSVTSVEESEGKKKEVAVDTEESISNLSVSLELLNKNEEVIIPLSNKKETTPLHEAAKSGDAQLTLELLEQGLDPCIKDARGKTPYLVASDKEVRNTFRRFMALNLDKWDWHAADVPSALTKEMEESQAAKQAEKDAKKKARAKELKKLKKAREKEEKEKEKEKAKAQASQSQTSMGQMANRTTSVPGLKPKHQTPQQILIAKEEEQQRKLAEEREKRAAAAERRLAALAAQSAGTSGAAAAPTNSVQKAAPDDNSCSCCFTSLAGKVPFHRYNYKYCSTTCMHLHSEMLQDE

SEQ ID NO: 28760 - DNA, 701 bp, Panicum virgatum
  misc_feature: Ceres CLONE 1886956
  misc_feature: Encodes the peptide sequence at SEQ ID NO. 28761
atacacacgcgcgcagccgcactccatctccagcgcctacagagagagagagagaattcgccgcggaaaaaagaaaaaaaaaatcgcctccttttgacagagggagggggagacggagggggaggaggaggaggtcgtgagctcgggagggagcgtgtgcgctgcgctgcagatcgggcggtgcctccgcgtagctcgggccgtttgagggggcccgcccgccccatgcgccggtgaggtggtggggcccgctctgcgcgcgagtcggaatggcggcggtgaggtggtgggcggcggtgacgctcgcggtggcggtggtgctcgggccggggcgggtcgtcgccaacaccgagggtgatgctctgtacagcctgcggcagagcttgagagatgctaacaatgtcttgcagagttgggatcccactcttgttaatccctgtacatggttccatgttacgtgtaacaatgataacagtgttatcagagttgaccttggaaatgcacaattatcaggtgtactagtcccccagcttggtcagctgaaaaatctccaatatttggagctttacagcaacaacataagtgggacaataccccctgaactgggcaacctaactaacctggtcagtttggatctgtatatgaacaacttctctggcaatatcccggacagccttggaaaactattgaagctgcgtttc

SEQ ID NO: 28761 - protein, 143 aa, Panicum virgatum
  misc_feature: Ceres CLONE 1886956
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAVRWWAAVTLAVAVVLGPGRVVANTEGDALYSLRQSLRDANNVLQSWDPTLVNPCTWFHVTCNNDNSVIRVDLGNAQLSGVLVPQLGQLKNLQYLELYSNNISGTIPPELGNLTNLVSLDLYMNNFSGNIPDSLGKLLKLR

SEQ ID NO: 28762 - DNA, 719 bp, Panicum virgatum
  misc_feature: Ceres CLONE 1886961
  misc_feature: Encodes the peptide sequence at SEQ ID NO. 28763
gtacaggagccgccaacactcaaactcaaacgcgtgcgctgcagcaatgctagcctcaacctgcctatccccttccttcctgcccaccgccaccgccgccacacacagactcctcgtcgtctccggcaactccggcagccgccgtcctccgcggcgcatgtcaggtggaggtggtctcgtccttcacgccaggctgggcgatggcgacggagccggcggcgagctcaccccgtcgcgacgacacgccctcctcgccgccgccacggccgccttcgcgctcgtgaacgcgccgtgcctccggtacatgaaccaggccgcgctcgggcggagcttcacgggcaccttctgcggcgacctgctggtcggggccatggcgcactcctggaggctgctcgtgcagggcctcacgtcgctcatgtttctctgtgcccgcgccgatgagtacgtccggccgccgcccagcccgctggtgctcatggcgcacgacaaaccggcgtcccatcctcagcaggtacacatctccgtcgtcggggcgaagaacatgcgcatctcatgggtcaccgacgaccggcgcgcgccgtccgtggtcgagtacggcagatccccgggcaagtacacggcgtccgcgacgggcgaccacaccacctaccactacttcttctacaagtccggcgcaatccaccacgtcaccatcggcccgctggatcccggcacgacgt

SEQ ID NO: 28763 - protein, 187 aa, Panicum virgatum
  misc_feature: Ceres CLONE 1886961
  misc_feature: SWISSPROT Homolog: EC 3.1.3.2 Acid phosphatase
MSGGGGLVLHARLGDGDGAGGELTPSRRHALLAAATAAFALVNAPCLRYMNQAALGRSFTGTFCGDLLVGAMAHSWRLLVQGLTSLMFLCARADEYVRPPPSPLVLMAHDKPASHPQQVHISVVGAKNMRISWVTDDRRAPSVVEYGRSPGKYTASATGDHTTYHYFFYKSGAIHHVTIGPLDPGTT

SEQ ID NO: 28764 - DNA, 2642 bp, Panicum virgatum
  misc_feature: Ceres CLONE 1886973
  misc_feature: Encodes the peptide sequence at SEQ ID NO. 28765
acgcaccaggggaacacagcccgcgctgctgcctgcaaccgccgccgccgtggctcctggccttgctccgacactcaccgtccgcttcttctttagctgagctaggcgaagcgaacctgcaaccgccaagctagcactgcgtgggttgctgcatcgcgtcgctgatggccgcggcgcacccctcgtcgtccgcgcgggcgcgcgcgccgctgccggcgccggcgccggcggctcgcccattgcatcccctcgccggcctggaggaaggggaagccgtggcggccgccgctcaccccggcgcgcaccgggtgcggcgcagggggaggaagcagaagcagctctggcccaagacggtgctgcggaagtggctcaacatcaggtcgccggagtccgacttcagcgccgacgagggcgacaccaccgacgacaccgacagcgaggtcgagtacgaagagatgtgtgcctgggaacgcaagttacatgatgaagagaggaaccaccgtggacttggtgctgaaactattggaaaccaactagggccagttccctatgggctccatagaaggcgcaagtcagagaccctccgtgcacaatatatagatgtcagggaactaaggatatgtgcgggaacatggaatgttgcaggcagacttccgcctgatgacttggatattcaagaatggttagatatggaggagccatctgatatatatgttcttgggtttcaagaaattgttccattaaatgctgggaatatatttggtgctgaagacaaccgtcctattgcaatgtgggagaatattattcgtgaaactttgaataagatcagcccagataaaccaaaatataaatgccatagtgatcctccttctccatcaaggttcaagccatctgttgatgctttcattatggaagatgaacttattagtgagtctgatagcgaaagtgatggggaggtgcatccgtttaatgaccaagatttgattgcttctgttgatggcattcatggtaacacatgtgaacgccccactgctgcacccgaaacaattttacaagatgataagttcagcaagctgccttcaatgaagacttttgatagatcccataacttaagttttaaagaatctaatttggaagagcagatctgacagaagatattaactaaaactctcagtcactcggagaggcttggaatggtttggcctgaaccaccattggatatgttggcacagtatcttcccgacagcacaaaatcattagcttcagggagagcattacgaacatatttgtctttcaagtcagtaaatggagactctggtccatttccagaggacaatttagttccagatttaaacattaactatgcagcagttaaaagtaaaaaaccatattttgtaaggataataagcaagcagatggtcggagtgtatctatcaatctgggtacgaagaagcctccggaagcatattcagagtctgaaagtatcaactgtaggggtcggtgccatgggctacattggtaataagggatcaatatcagtaagcatgtccatatatcaaacacacttttgctttatatgttgtcatctgacctctggagaaaaagagggagatgaattaaaaaggaatgctgatgttcaagaaatccaccgaaggaccgtatttaatccagtttccagagtcaacatgcctaagacaatatatgaccatgaaaggattgtgtggcttggtgatctcaactataggattaacttatcatacgagaagacccatgaactcatctccaggcaggactagaataaattatttgctttcgatcagctgaaagtagagctgaagaagggacatccatttgaagggtggaccgaaggggtcatcaactttcctccgacatacaaatacaaggttaactcaggaaaatacataagtgatgatcacaaatctggaaggaggacacctgcatggtgtgaccaaattctttcccatggtaagggtacgaggttactgtcatataagacagttgatctccggctgtcggatcaccgccctgtgactgctgtgtacatggtagatgttgaggttttctcttcaaaaaagctgcagagagctcttaccttcaccgatgcagaggttgaggaacagctttcctttgaggaagatagcacttctggaatatacaaccttggactatattgaagtccaaagtaatcttgcacacatgcacaatgaaattgatgtttttctcaagtatacgaggaaagattggcccacgttgccgcttaatctgtccagccagtgcctctctatttttcagagaccagcagttggaactttgaaataggtagttccacttccatgtacatttcccccatgctctgaccatatttcaaaatcttttgtcatgcattttgccattttcttttcctcccccctcttagtgttgtgcctcgaatgtggaaaaaataatctcctctgtaacgatcaaatgttggacagtgtaagtttcctgccgactgattgaggcattgtacggtttttttttttatccctgcggtgcagcaaatgtaccttttaacttaactgatccctgtttggtcaaactatcgtggagttgattagatttggaatcatttggactggagt

SEQ ID NO: 28765 - protein, 327 aa, Panicum virgatum
  misc_feature: Ceres CLONE 1886973
  misc_feature: SWISSPROT Homolog: EC 3.1.3.56 Inositol-polyphosphate 5-phosphatase
MAAAHPSSSARARAPLPAPAPAARPLHPLAGLEEGEAVAAAAHPGAHRVRRRGRKQKQLWPKTVLRKWLNIRSPESDFSADEGDTTDDTDSEVEYEEMCAWERKLHDEERNHRGLGAETIGNQLGPVPYGLHRRRKSETLRAQYIDVRELRICAGTWNVAGRLPPDDLDIQEWLDMEEPSDIYVLGFQEIVPLNAGNIFGAEDNRPIAMWENIIRETLNKISPDKPKYKCHSDPPSPSRFKPSVDAFIMEDELISESDSESDGEVHPFNDQDLIASVDGIHGNTCERPTAAPETILQDDKFSKLPSMKTFDRSHNLSFKESNLEEQI

SEQ ID NO: 28766 - DNA, 1449 bp, Panicum virgatum
  misc_feature: Ceres CLONE 1886980
  misc_feature: Encodes the peptide sequence at SEQ ID NO. 28767
agtagtgctgcgcacgtcaggagctctcccccctccccactgcatccgatattctggtttatgtgctaaaattgcgccttagttccttccaaatctgcagttggtttcagcaattttaccgttcctgttcgtatccgtttctgactttctgtagtgcatcgtgccaaatcgattgcacgattgcagccatgggaacccgcagcgtcgccctggtgctcctcgcggccgttctgctccaaaccctcctccccacctcggcggcggagggtttggtgcgggtctcgctgaagaagcagcccatcgaccagaacagccgcgtcgcggagcgcctctccgcggaggagaggcagcgccttctccgtggcgccaactcgctgggctcgagcgatgagggcgacatcatcgcgcttaagaactacatgaacgcgcagtactttggggagattggcgtcggcacgccagcgcagaagttcaccgtcatctttgacaccggcagctccaatctctgggtgccgtcctccaagtgctacttctcgatcgcttgctacgtccactcgcgctacaagtcagggcagtcgagcacttacaagaagaacggaaaacctgctgacattcactatggaactggtgcaattgctggttttttcagtgaggatggtgttaccttaggtgatctggttgtgaaagatcaggaatttattgaagctacaaaggagccaggccttactttcatggttgcaaaatttgatggtattcttggtctgggctttcaggaaatatctgttggcaatgcagtaccagtgtggtataacatgataaaacaaggtctcatcagcgaccctgttttctctttctggttcaaccgacatgctggtgaaggagaaggtggtgaacttgtgtttggtggaatggatcctaaccactacaagggtaaccacacatatgtcccagtcactcagaagggatattggcagtttaacatgggcgatgtcctggttgatgggaagtccactggtttttgcgctggtggttgtgctgcaatcgcggattctggaacttccttgcttgctggccccacagccataattactgaaatcaatgaaaagattggtgctactggtgtggtgagccaggagtgcaagacagttgtctctcaatatggacaacagatcctagatctgttgctggctgagacacaaccagcaaagatctgttctcaggttggtctgtgcacttttgatggcacccatggtgttagtgctggaattcggagcgtagtggacgatgaagctgggaaatctaatggtggtctccgaagcgatccaatgtgcaatgcctgtgagatggctgttgtatggatgcagaaccaactcgcgcagaacaagaccaaggagctcatcctgaactacattaatcagctgtgcgaccgtctccctagtcccatgggag

SEQ ID NO: 28767 - protein, 420 aa, Panicum virgatum
  misc_feature: Ceres CLONE 1886980
  misc_feature (81)..(363): Pfam Name: Asp Pfam Description: Eukaryotic aspartyl protease
  misc_feature (378)..(416): Pfam Name: SapB_1 Pfam Description: Saposin-like type B, region 1
  misc_feature (314)..(348): Pfam Name: SapB_2 Pfam Description: Saposin-like type B, region 2
  misc_feature: SWISSPROT Homolog: EC 3.4.23.40 Phytepsin
MGTRSVALVLLAAVLLQTLLPTSAAEGLVRVSLKKQPIDQNSRVAERLSAEERQRLLRGANSLGSSDEGDIIALKNYMNAQYFGEIGVGTPAQKFTVIFDTGSSNLWVPSSKCYFSIACYVHSRYKSGQSSTYKKNGKPADIHYGTGAIAGFFSEDGVTLGDLVVKDQEFIEATKEPGLTFMVAKFDGILGLGFQEISVGNAVPVWYNMIKQGLISDPVFSFWFNRHAGEGEGGELVFGGMDPNHYKGNHTYVPVTQKGYWQFNMGDVLVDGKSTGFCAGGCAAIADSGTSLLAGPTAIITEINEKIGATGVVSQECKTVVSQYGQQILDLLLAETQPAKICSQVGLCTFDGTHGVSAGIRSVVDDEAGKSNGGLRSDPMCNACEMAVVWMQNQLAQNKTKELILNYINQLCDRLPSPMG

SEQ ID NO: 28768 - DNA, 577 bp, Panicum virgatum
  misc_feature: Ceres CLONE 1886980-R
  misc_feature: Encodes the peptide sequence at SEQ ID NO. 28769
gagaggctcttccctcaggactcggcgagggagacggtgccgtggggcccgagcatcgcgtgcagcacgcccgcggccatcgagtgggtggagcagtggaaggcctccaacgacccttccggccgcttcatctcctcccacgacactgccaccggccacggcgccggaggcgcgcacgctaacggcaacggcgtggcggccgtggcgaacgggcacggcccggccaacggcgcggtcaacggcggcgaggtcgccgtggcgaacggtcacggcgcggcgaacgggaacgaggtcgccgtcgcgatcgcggtgtgactttgttggctcatcagggataaggacgacgagtaggttgcggcgtggcgtgtcagccggtcgccatgacatggtgcggtggcacacgtgctactagcctactattgtttttacgcggtgttgtactgtcactagcgtaagtgcgcgtgtgtgagcgagcgagcgagccatggaggcatgtgtgtgttgtgccgggttgatgtcctcgaactcgatctttctaaagacttgagctacggatcaatctaaagatgttttgttc

SEQ ID NO: 28769 - protein, 104 aa, Panicum virgatum
  misc_feature: Ceres CLONE 1886980-R
  misc_feature: SWISSPROT Homolog: EC 6.3.5.4 Asparagine synthase (glutamine-hydrolyzing)
ERLFPQDSARETVPWGPSIACSTPAAIEWVEQWKASNDPSGRFISSHDTATGHGAGGAHANGNGVAAVANGHGPANGAVNGGEVAVANGHGAANGNEVAVAIAV

SEQ ID NO: 28770 - DNA, 706 bp, Panicum virgatum
  misc_feature: Ceres CLONE 1887007
  misc_feature: Encodes the peptide sequence at SEQ ID NO. 28771
gtatctcccacgcacgacgtcctcagccgacgaatccatggagctcgggcaagctatggatctcccaactccgctgctgctctccacctttgcagtgtccgtggtcgtatactcgtatgctacttcctcttcaggcagccggcggccaggaagactgcgccgctgcagccgggcccgaggggctggcctgtcctaggcaacctgccgcagctcggcgggaagacgcaccagacactgcacgagatgaccatggtgtacggcccactgctgcggctgcatttcggcagctccaacgtggtggtggccggatcggccgccgtggcggagcagttcctccgcgtccacaacgccaacttcagctgccgcccgcccaactccggcggggagcacatggcgtacaattaccaggacgtcgtgttcgccccctacgggccccggtggcgtgcgatgcggaaggtgggaggggttctcaacgtcggcgacttcgtgccggcgctccggtggttggacccgcagggcgtggtggccaagttgaagaagctgcaccgccggttcgacgacatgatgaacgggatcattgctgagaggaaggccggggttaagccagccggagaggacggcaaggacctgctgggcttgctgctgccgatggtgcacgatgagcggcccctagccgatggcgaggaggatggggtcaccgaaaccg

SEQ ID NO: 28771 - protein, 235 aa, Panicum virgatum
  misc_feature: Ceres CLONE 1887007
  misc_feature: SWISSPROT Homolog: EC 1.14.13.21 Flavonoid 3'-monooxygenase
VSPTHDVLSRRIHGARASYGSPNSAAALHLCSVRGRILVCYFLFRQPAARKTAPLQPGPRGWPVLGNLPQLGGKTHQTLHEMTMVYGPLLRLHFGSSNVVVAGSAAVAEQFLRVHNANFSCRPPNSGGEHMAYNYQDVVFAPYGPRWRAMRKVGGVLNVGDFVPALRWLDPQGVVAKLKKLHRRFDDMMNGIIAERKAGVKPAGEDGKDLLGLLLPMVHDERPLADGEEDGVTET

SEQ ID NO: 28772 - DNA, 2270 bp, Panicum virgatum
  misc_feature: Ceres CLONE 1887009
  misc_feature: Encodes the peptide sequence at SEQ ID NO. 28773
aatcccaactggcatagatcctgctcctttgccatcaaccccatcgctgtctcctttccattccgccctgcatccgtcaatccaatcccccacggtgccgacgacttcgtcgtcccttcagcgggagcagcacgccgtggggagcgagcaagcgtccggagcagcagcgagtgacagcagccgcggaagaagtgggggagagcttggaggcgcgcagtacatagctaggcgggcgggtgggcagccaatgccgtggggcgcgcagggctaggaggatgggcggagggggcacgatcgtcgacggcttccgccgcttgttccaccgccgcaacggctccacctccaactcccaccagtcgtccgtcgccggcgagggggaggaaggctcgtccgatctcgaggtcatcgaggacccggatctcgtcggcctccgcgccatccgcgtgcccaagcgcaagatgccgctgcccgttgaaagccacaggaagaactcagtggaaatggagttcttcacagaatatggagaggcaagccagtaccagattcaagaagtcattggtaaagggagttatggagtagttgctgcagcagtagatacccgcacaggtgagcgggttgctatcaagaagatcaatgatgtgtttgagcatgtctcggatgccacacgcatattgcgcgagatcaagctccttcggttgcttcgtcacccagacatagttgagatcaagcacatcatgctccctccttctaggagggaatttcaagatatctatgttgtctttgagctcatggagtcggatctccatcaagtgatcaaggcgaatgatgaccttacccctgagcatcaccagtttttcctgtaccaacttcttcgtgctctcaagtacatacatgccgctaacgtatttcatcgcgatctaaagcccaagaatatactagctaactcagactgcaaactgaaaatctgtgactttggacttgcccgtgcatcatttaatgatgccccgtcagctatattttggacggattatgtggcaacaaggtggtaccgggcacctgaattgtgtggttcctttttctccaaatacactcctgcaattgatatttggagtattgggtgcatatttgctgaacttctcactggaaggccactgtttcctgggaagaacgttgtacaccaattagatctcatcacagatcttcttggaactccatcatccgagaccttatctcggattcgaaatgagaaggccaggagatacttgagctgcatgaggaaaaaacaacctgtgccgtttactcagaaatttcgaaatgctgatcctttggctcttcgtctgctagagcgtttgcttgcgtttgatcctaaagatcgacctacagcagaagaggctctggctgatccatacttcgcaagccttgctaatgtggaacgttagccctcaagacaaccaatttcaaaacttgaattcgaatttgaaagaaggaagctggcaaaagatgatgttagagagttgatctaccgagagattttggagtatcatccacagatgctggaggagtacatgaaaggtggagaacaaattagcttcctctacccaagtggagttgaccgcttcaaacggcagtttgcacaccttgaggagcattacagcaaaggtgaaagaggttctccactgcagagaaagcatgcttctttaccaagggaaagagtggctatgtcgaaggatggtaataatgaacaacatattggcgaacaggagagaagtgcagattctgtcgcccgcactactgtgagcccaccaaggtcagaagatgttggccaggatggcttgaaatccacaagcttaagctcccgaagctacctgaagagtgcaagcattagtgcttccaagtgtgttgtcattgcagataaacacccagaggatgatgaaatccctgaggaaatggaaggtgttgtcgatggattgtctgaaaaggtctctaggatgcactcctaggctccaatgaccgtgggctgacagcaatctcgtcgcaagatttctgtcaggtaaactgtatgccgatgataagacagccagggaaagcaaaacactgcattgaaaatctggactttgggcgttacttgaagaagaggaagacgcaggggcgtttttcaccctgtttgtactagcatgggcccagcatggatccatgaagaatccctgcaatgtaacactagttagccatggtggaaatctaatgaacaatggatcgtggtcagcttactc

SEQ ID NO: 28773 - protein, 387 aa, Panicum virgatum
  misc_feature: Ceres CLONE 1887009
  misc_feature (88)..(379): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MGGGGTIVDGFRRLFHRRNGSTSNSHQSSVAGEGEEGSSDLEVIEDPDLVGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKQPVPFTQKFRNADPLALRLLERLLAFDPKDRPTAEEALADPYFASLANVER

SEQ ID NO: 28774 - DNA, 2162 bp, Panicum virgatum
  misc_feature: Ceres CLONE 1887011
  misc_feature: Encodes the peptide sequence at SEQ ID NO. 28775
gcagcaagcatcccccattagcgtccaccggtcgccgctagcgtccaccggtcgccgctaatccgccgcagcatcagcagtaagctcgacttctcctccatctccggacgtccaggcagggccggggccggcttcctcacctcgccacgcccccgcctcacaagcgcctcggcctctccagactccaagctcgttggtttcgcgaatcctgtttggcacaattggaggcaataaggttctgaactacaagttccgatgacaatctgcagcaacgatgagatcattgaagagtttgagttgctaacgcgtgatgctgggcacgtgcagcaggatacgctaagaaagattcttgaacttaatgctgattctgagtatctgaatcgcttcaatcttgaaaggagaacagattccaagagcttcaaatcctgcattccactatgtgtgcatagtgacatagagtcctacatccaacggatagctgatggagataactcactggtgctaaccgggaagcccatcacttctctctccgtaagttctggtacaacacagggaaaatccaagttgctgccattcaatgacgaattgcttgagagtacaattcaaatattccaaacctcatatgcttttagaaaccgtgaatatcctattggtaatggaaaaactttgcagtttgtttatgggagcaagcaagtccttacccaagggggcattcttgctacaactgcgacgacaaatttgtacaggagctggcgtttcatggaagccatgaaggatatcatgtctcagtgctgcagtcctgatgaagtcatctttggtcccgacttccatcagtctttatactgccatctattatgcgggttgatctactcagatgaagttcagtttgttttctcaccatttgcacacagccttgttcatgcatttaataccctcgaggaggtatgggaagatctatgtgctgatataagacatggtgttctctcaaagcgaattaccacaccatctatccgtcaagctgtttcgaaaatcttgaggccaaatcctgagcttgctagctccatttacaataagtgccagaatttgagtagttggtatgggggaatcccagcactgtggccaaatgcgaagtacatctatggcatcatgacagggtccatggagccataccttaagaaattgagacattatgctggacacttaccactgatgagtgctgactacggtgcatccgaaggatgggttggctctaatgtaaacccgaccctgccacctgaggaggtgacatacgccgttcttccaaatattgcttattttgagttcattcctttggaaaaaccaaaaggggaggaaatggagaacagttcctctattcactacatagagtcagagcctgtaggcttaactgaagttgaggttggcaaaatctacgaagttgtaataaccaactttgcaggtctataccgatacaagctaggagatattgtgaagatagcgggcttccacaactggacaccagagctccagttcatctgtcgcagaagcctagtcctgagcatcaatatcgacaagaacacggagaaagacctgcagctggccgtcgaagaggcggagcagcttttggccgaagagaagctcgaggtggtggacttcacgagcctcgtggacagatcaagcgacccagggcactacgtcatcttctgggagctgagctccggtaacgccagtgaggagctcctgagcagctgcgcgaacagcatggaccttgcctttgtggacgcggggtacgtcggctcgaggaagatcaagaccatcggcgccctcgagctgcgcgtcctccgcaagggaacctttgggcaggtcatgaaccactacctgagcctcggtggcgccgtgaaccagttcaagacgccgaggttcgtgagccagtccaacagcaaggtgctgcagatactgaacaggaacgtcacccagagctacttcagcactgcatatgggatctgatcgtcgctatgcagacatgtgtactgatagctgaaattcagttatgttcttgttattttcatcagtaggtcatcagtatggttgctgcattcctagcgctgcatttagcatgcagccgttatcactcaagaaaattcagaaaaggcgtctgtgttctg

SEQ ID NO: 28775 - protein, 582 aa, Panicum virgatum
  misc_feature: Ceres CLONE 1887011
  misc_feature (8)..(566): Pfam Name: GH3 Pfam Description: GH3 auxin-responsive promoter
  misc_feature: Functional homolog of the protein sequence given in SEQ ID NO 50709
  misc_feature: Useful for making plants with modulated light quality sensitivity
MTICSNDEIIEEFELLTRDAGHVQQDTLRKILELNADSEYLNRFNLERRTDSKSFKSCIPLCVHSDIESYIQRIADGDNSLVLTGKPITSLSVSSGTTQGKSKLLPFNDELLESTIQIFQTSYAFRNREYPIGNGKTLQFVYGSKQVLTQGGILATTATTNLYRSWRFMEAMKDIMSQCCSPDEVIFGPDFHQSLYCHLLCGLIYSDEVQFVFSPFAHSLVHAFNTLEEVWEDLCADIRHGVLSKRITTPSIRQAVSKILRPNPELASSIYNKCQNLSSWYGGIPALWPNAKYIYGIMTGSMEPYLKKLRHYAGHLPLMSADYGASEGWVGSNVNPTLPPEEVTYAVLPNIAYFEFIPLEKPKGEEMENSSSIHYIESEPVGLTEVEVGKIYEVVITNFAGLYRYKLGDIVKIAGFHNWTPELQFICRRSLVLSINIDKNTEKDLQLAVEEAEQLLAEEKLEVVDFTSLVDRSSDPGHYVIFWELSSGNASEELLSSCANSMDLAFVDAGYVGSRKIKTIGALELRVLRKGTFGQVMNHYLSLGGAVNQFKTPRFVSQSNSKVLQILNRNVTQSYFSTAYGI

SEQ ID NO: 28776 - DNA, 681 bp, Panicum virgatum
  misc_feature: Ceres CLONE 1887012
  misc_feature: Encodes the peptide sequence at SEQ ID NO. 28777
attcccacgacccaaggcaacctgcgcaccgccatcaccgacgcaaccgccgccgcaatcccgattcccgcacacacctccctccttcccccaaccccaatcaaaggcaccgccgaatcaaacccactagcggcgctcgtcttaatccggcagcggtggctggacccgcgccctgctaacgtcgagcatccacggctcggagttcgcgggggcatcttcaatggcgtcggagtcgcgtcgccgggcataggagcctgagaggtgcccgcgcgatcagttgccaactcgctgctcctctctccgcggcgcattttgctgtctcgaggcatgcatacgtcgccggagatgaatggccgggctcggaggccgccggcggcggcgcacggcgcgaaggccgccccgaagagcgccagcagagtggcggagaaggatccgaggaagggcgcgacgccggtgaagggatcggcggccagcgcgggcgccaggggcgccatgaacagaattcagtcgaggagagagcggaagctcgcgctgcagcaagacgtcgacaagctgaagaagaagctgcgccacgaggagaacgtccaccgagctctggagcgggcgttcacgcggccgctcggcgccctgcctcgcctgccgccgtatctgccgtctcaaacgctagctcttctcgcggag

SEQ ID NO: 28777 - protein, 111 aa, Panicum virgatum
  misc_feature: Ceres CLONE 1887012
  misc_feature: Functional homolog of the protein sequence given in SEQ ID NO 51289
  misc_feature: Useful for making plants with modulated biomass
  misc_feature: Useful for making plants with modulated flowering time
MNGRARRPPAAAHGAKAAPKSASRVAEKDPRKGATPVKGSAASAGARGAMNRIQSRRERKLALQQDVDKLKKKLRHEENVHRALERAFTRPLGALPRLPPYLPSQTLALLA

SEQ ID NO: 28778 - DNA, 672 bp, Panicum virgatum
  misc_feature: Ceres CLONE 1887032
  misc_feature: Encodes the peptide sequence at SEQ ID NO. 28779
cgatccagctcgccgagcaggtaataaagtgggccgacgaggcctacacgttccggcaggagtgcatggagctcaaggccaaggtcgagcgcctcgccggcctcttccgccaggccgcgcgcgccgacctctacgagcgccccgcgcgccgcatcttcgacgacaccgagaaggcgctcgacaaggcgctcgccctcgtcgacaagtgccgcgcgcacggcctcgtccgccgcgtcttaaccatcatccccgcgggctccttcaagaagatgaccaaccagctcgacaactccatcggggacctctcgtggctcctccgggtctcctcgtccgccaacgacgacgacgacttcgacgcccacatcggcctcccgcccatcgcgcagaacgagcccatcctcttcctcatctgggagcagatcgccgtgctctacaccggcaacctcgacgcccgcgccgacgccgccgccagcctcgtctcgctcgcgcgcgacaatgacaggtactccaagctcatcatagaggaggacggtgtgccgccgctgctcaagctcgtcaaggagggccgcctcgagggacaggagaacgccgcgctcgccgtcgggctcctcggccgcgacccggagtgtgtcgagcagatggtgcaggtcggggcctgcctgggcttcgcgc

SEQ ID NO: 28779 - protein, 223 aa, Panicum virgatum
  misc_feature: Ceres CLONE 1887032
  misc_feature (165)..(205): Pfam Name: Arm Pfam Description: Armadillo/beta-catenin-like repeat
IQLAEQVIKWADEAYTFRQECMELKAKVERLAGLFRQAARADLYERPARRIFDDTEKALDKALALVDKCRAHGLVRRVLTIIPAGSFKKMTNQLDNSIGDLSWLLRVSSSANDDDDFDAHIGLPPIAQNEPILFLIWEQIAVLYTGNLDARADAAASLVSLARDNDRYSKLIIEEDGVPPLLKLVKEGRLEGQENAALAVGLLGRDPECVEQMVQVGACLGFA

SEQ ID NO: 28780 - DNA, 1445 bp, Panicum virgatum
  misc_feature: Ceres CLONE 1887047
  misc_feature: Encodes the peptide sequence at SEQ ID NO. 28781
gagacgctcgacgcttcagaagaagaaaaaaacagacccaatccagcgctccgcggccgccgagagctcccggcgagcgccacccatgctgcgcgtcctcgtatccaccctccccgccctccgcccgctcctccggcgccagcctctgctaaaccctaaacccctcactcgctctcgcctgccgcagcgggcgttctgcgcgctatcgtcctccgcgcctcccgccaccccggcgcccagcgccgcgggggcgggagaggcggttgaagtggaggagcacctgacgcggtgcgcggcggcgagccgggcgccgttgcgggtcgcggtgctggtgagcggtggggtggacagtagcatcgcgctccgcctcctccacgccgccggccaccgctgcaccgcgttctaccttaagatttggttccaggaagatttcaggaacttttggtccgagtgcccgtgggacgaggatttaaagtatgcgcaagctgtttgtgacaagattgatgtgccattggaggtggttcatctgtccgatgagtattggaaccatgtggtatctcacatcatcaatgagtatcgctgcggccgcacaccaaatcctgatgttctttgcaatacaagaataaagtttggggctttcttagaagctattgaaaatctgggatttgaccacatagcttcaggacattatgcacatgtaatccatccttctgatgaaaatactgaggcgccatcgctactacaattatcaaaggataagatcaaagatcagacctattttctctctcatctatctcagtctcaactaagaaggcttcttttcccgctaggatgtatgaaaaaggatgaggtgcgcagactggctgctcaaatgggccttcctaatcaaggtagaaaggactcacaagggatatgctttcttggaaaggttaagtttagtgagtttgttgaaagacatataggtgagatggagggaattatattggaagctgaatccggagattacctaggtaaccaccgggggttttggttctatacaattggtcaacgacaaggattgcggcttgctggaggaccttggtatgtagttgagaaagatgttcaaaacaatgtggttttcgtatcaaggaattactattcgctggataagcggaggcgcagatttcatgttggatcactaaactggtttgatgattctggtcctggaaacagtgaacaacttaaatgcaaggtgcggcatagccctgaattccatgattgcgtggtgacaaaagggcataccgaagaaaatggagatgttttggtggtgcacctctctgaagatgaccagggattagcagctggtcagtttggagcgttttaccgcgaagacttatgcctgggttcaggcataattttggattcgtgggatgagatgagctttcccgtctgctcaagggcacttg

SEQ ID NO: 28781 - protein, 453 aa, Panicum virgatum
  misc_feature: Ceres CLONE 1887047
  misc_feature (77)..(437): Pfam Name: tRNA_Me_trans Pfam Description: tRNA methyl transferase
  misc_feature: SWISSPROT Homolog: EC 2.1.1.61 tRNA (5-methylaminomethyl-2-thiouridylate)-methyltransferase
MLRVLVSTLPALRPLLRRQPLLNPKPLTRSRLPQRAFCALSSSAPPATPAPSAAGAGEAVEVEEHLTRCAAASRAPLRVAVLVSGGVDSSIALRLLHAAGHRCTAFYLKIWFQEDFRNFWSECPWDEDLKYAQAVCDKIDVPLEVVHLSDEYWNHVVSHIINEYRCGRTPNPDVLCNTRIKFGAFLEAIENLGFDHIASGHYAHVIHPSDENTEAPSLLQLSKDKIKDQTYFLSHLSQSQLRRLLFPLGCMKKDEVRRLAAQMGLPNQGRKDSQGICFLGKVKFSEFVERHIGEMEGIILEAESGDYLGNHRGFWFYTIGQRQGLRLAGGPWYVVEKDVQNNVVFVSRNYYSLDKRRRRFHVGSLNWFDDSGPGNSEQLKCKVRHSPEFHDCVVTKGHTEENGDVLVVHLSEDDQGLAAGQFGAFYREDLCLGSGIILDSWDEMSFPVCSRAL

SEQ ID NO: 28782 - DNA, 691 bp, Panicum virgatum
  misc_feature: Ceres CLONE 1887047-R
cggaagctatcgttgtgctgcccccaggccggaactccaggtctttgttgaaagatggcggtggcatgctgttggggagcttgcgtttcagaagaatagtgatcggctggtacaatgaatagtattctgtgagatggaataagtcgtaataagccagctgagcactgttcaatggccagccgaacaggctcaagctttgcttccggatagaaccggttttctggcgtcctcatccatgcaaggatgaaaggttgattggttgacctgacatcgacatagatcgttgacagttatttcccgatctggcgggaaaccacacgatggtttgggcccgccctctcctgggtcgaaggatctggattccttagccagcagtggtgcggtaaactaatgcagggaggtcgttgcgttgtatgatactgatacgactttgtaactagcataaatcgtgaggataacgtcggcgcgtgattcaacggtactggccattagacaaatcatgcgtggatcgaaatggacaatcagtgtcgtgtacttagcgtcggtgcgacgtgtacctgtcagtacagccagatgtaccgtaccatacgtctcgtactctgtttttttaggactgtggtactctggctcggcgtgcttgcgagttgtggcacagctgatacaagaagcgctcaattttcatgtctgatcg

SEQ ID NO: 28783 - DNA, 716 bp, Panicum virgatum
  misc_feature: Ceres CLONE 1887053
  misc_feature: Encodes the peptide sequence at SEQ ID NO. 28784
atcgtcttcctccctccacagtcgcccgggcgctgtgctcccttcctttcctgctgcctgctttcccctccaaaagccgcgccgcgccttatctctccggaaagccgggccggcggattccgtcctccctccctcccggcagccagcagtagccagcggccagcggccgggcagctgctgcacatgagatcaatgagctcggaggactcgctcaagtccctctcgctcgactacctcaacctgctcatcaacgggcaggccttcagcgacgtcgccttcagcgtcgagggccgcctcgtgcacgcccaccgctgcgtcctcgccgcgcgcagcctcttcttccgcaagctcttctgcggcctcgaccccaaccaccagcccccgccgccgccgcagctggggtcccccggcgcccggcccgcgggcgccgcgccggagctggtcatccccgtcagctccatccgctacgaggtgctcgtcctcgtgctgcagttcctctacagcggccaggcgtcggtggcggcgcccaagagcgggccgctccccggctgcggcgccagggggtgctggcacacccgctgcggcgccgccgtcgacctcgccctcgacaccctcgccgccgcgcgctccttcggcgtcgagcagctcgcgctgctggtccagaagcagctggagaccatggtgaaggaggcgtccgtggacgacgtgatgaaggt

SEQ ID NO: 28784 - protein, 174 aa, Panicum virgatum
  misc_feature: Ceres CLONE 1887053
  misc_feature (15)..(164): Pfam Name: BTB Pfam Description: BTB/POZ domain
MSSEDSLKSLSLDYLNLLINGQAFSDVAFSVEGRLVHAHRCVLAARSLFFRKLFCGLDPNHQPPPPPQLGSPGARPAGAAPELVIPVSSIRYEVLVLVLQFLYSGQASVAAPKSGPLPGCGARGCWHTRCGAAVDLALDTLAAARSFGVEQLALLVQKQLETMVKEASVDDVMK

SEQ ID NO: 28785 - DNA, 497 bp, Panicum virgatum
  misc_feature: Ceres CLONE 1887057
  misc_feature: Encodes the peptide sequence at SEQ ID NO. 28786
atacaaaggggtgctcttcccttccgactcctagcgttttcgttagggggaaggaggagggggaaggagagcattgccgcgcggggatggggaggaggagcggaggcggtggtgggacggtgggcgtgccatggctgctgctgctcctcggatgctgctgcagcagcatacggatcttcgctgctgcggacacggaccccaacgatcttgctgtcctcaatacactctttactagtctgaattctcctgggcagctctatggttggcaggcaaatggtggtgatccttgtggccagtcatggaagggggtaatttgctcatgatctggggtcactaatatcttattgccgatcttgggactctccgggaatctggcctacaacatgaataacttgggttccttgactgagcttgacatgagccaaaacagccttggcggtggaaaccaaatacagtacattcttccctatatgaagcttgagaaactcaatcttgca

SEQ ID NO: 28786 - protein, 78 aa, Panicum virgatum
  misc_feature: Ceres CLONE 1887057
  misc_feature (37)..(78): Pfam Name: LRRNT_2 Pfam Description: Leucine rich repeat N-terminal domain
MGRRSGGGGGTVGVPWLLLLLGCCCSSIRIFAAADTDPNDLAVLNTLFTSLNSPGQLYGWQANGGDPCGQSWKGVICS

SEQ ID NO: 28787 - DNA, 2552 bp, Panicum virgatum
  misc_feature: Ceres CLONE 1887059
  misc_feature: Encodes the peptide sequence at SEQ ID NO. 28788
aaactttattgcttgtccttctgccacacgcacctcctccctcccctccctcctcttccgcgtcgccgccgccaaattccaacagcaatcccgccgcaatttgctcctgcgcgcgaaatcggctcaagcatcctcaatttttcagctcaggggtcgctgagttccgttcagatacccgcttctaatccacaagtctcttctcaaggttgcaagaagcgcgagctgcagaaatcttccagtgcttcctccgtcgtctcggcctctgaatcccctagcggagctagctgagagggcggggcttcttcaaatttcaagtctttggccgctcggagctgctccgggctcctcaagatcgaggcagtcgaagagtcggcagcattcctcttagggtttccccgctgtctgatggtcggtaatggcgcttaaggcctcggctcagggcgccgcggaggcggccatagcggccatcggccgcggctacgacgttgtctcggacgtccgcctcaagtactgcaagggcaggctcgcggatcccgacgcgcgcctcattgacctcagccgcgatgaggttaaggacgtcgtgctccccggcgggatcaaggtcgccaccgtccccaagtccatcaagtgcgacaagggcgagcggacgcgcttccgctccgatgtcctctccttccagcagatgtctgagcagttcaaccgggagctttcgttgactggaaaaattccatccggcatgttcaatagcatgtttgatttttctggctgctggcagaaagatgcagctggcaccaagtcgcttgctttcgatggctggtacatttcgctgtattcagttgcgctgtccaagtctcgtattctactgcgtgatcatgttactcaagcagtgccttcaacctgggatcctgctgctctggcaaggttcattgaaaagtttggaactcacatagttgttggtattaaaatgggagggaaagatgttatttatctgaaacaacagcattcatcaagcttgcaaccagctgttgttcagaaacgacttaaggacatgtcagacaggaggtttctggatgcaaacgagcatgatatgaacatcaaggctgcatatggcaaggataagaatgatgcaagagagcaacggctaagatttgtggaatcaagcccatcaagttcttactgctcgaaggaggacttggtgatggtggttaagcggagaggtggaagggaatgggacaaagagatgcctcacattgaatggataaacactgttcagttagaacctgatgtcatctcaatgtcctttctacctattacttcattgttgaatggagtacctggctgtgggtttctgaatcacgcaattaatctgtacctacgctataagcctcctattgaagaacttcaccaatttttggagttccagctaccaaggcagtgggcgcctgtgtacagtgacctccctcttggccctcagaggaagagacagagtagtgcatctttgcccttgagtttcatgggaccgaggctctatgtctgcactagtatggttgatgtgggtgaaagacctgttactggattgcggttgtatcttgagggaaagaaaaacaacatgttggctatccatcttcagcatctatgctcgcttcctcaaattctgcagcttcaggatgacccatacaatcaccgaactcctgaatcatatgacagcaagtacttcgaaccatttggatcctggaagcgtttctctcatgtctacacggaaccagtggaatctgacgatgactcctcaatcgtgactggggcacagttacacgtgagcagccatggattgaggaaaatcctcttcctccgcctccgtttctccaaagtcatcaatgctgcacttgtcaagaatcctgaatgggaaggatcacgaaatttgggtcagaagtctgggctcatctcgacgctcattagcacgcatttctccacggcggctcagaagcctgcccctcgcccagctgatgtgaacatcaattcggctgtgtaccctggcggtccacctgtgcctgtgcaggccccaaagctgctcaagtttgtggacacagcagagatgttgcggggaccgcaggacacgccgggatactgggtggtctctggtgcgaaactgcagctcgagaggggcaagctatcactgcgggtgaagtattcgctcttgacagccatggtacctgatgatgagtatccactcgatgaacatagttgaaactcagtacctggagacgctaatgtgcaattaatcatatggtgatggtgcatgcaagtaaaggttttgaatgtatgttttaggaaggctctccaacatgtacatcacttctcttttcattctgcctatttctctcaccagagcgtgtgctgtctgtagttcaatatcgggcgttcaatttgttttgcagagggtgaagtgtataacattctttgtatatacgtgctgtttgtacttgcagcaagggagagagagcacttgctattctgctcctatcttttctgaacattgtcgtgcgtgctctggc

SEQ ID NO: 28788 - protein, 609 aa, Panicum virgatum
  misc_feature: Ceres CLONE 1887059
  misc_feature (126)..(321): Pfam Name: MACPF Pfam Description: MAC/Perforin domain
MALKASAQGAAEAAIAAIGRGYDVVSDVRLKYCKGRLADPDARLIDLSRDEVKDVVLPGGIKVATVPKSIKCDKGERTRFRSDVLSFQQMSEQFNRELSLTGKIPSGMFNSMFDFSGCWQKDAAGTKSLAFDGWYISLYSVALSKSRILLRDHVTQAVPSTWDPAALARFIEKFGTHIVVGIKMGGKDVIYLKQQHSSSLQPAVVQKRLKDMSDRRFLDANEHDMNIKAAYGKDKNDAREQRLRFVESSPSSSYCSKEDLVMVVKRRGGREWDKEMPHIEWINTVQLEPDVISMSFLPITSLLNGVPGCGFLNHAINLYLRYKPPIEELHQFLEFQLPRQWAPVYSDLPLGPQRKRQSSASLPLSFMGPRLYVCTSMVDVGERPVTGLRLYLEGKKNNMLAIHLQHLCSLPQILQLQDDPYNHRTPESYDSKYFEPFGSWKRFSHVYTEPVESDDDSSIVTGAQLHVSSHGLRKILFLRLRFSKVINAALVKNPEWEGSRNLGQKSGLISTLISTHFSTAAQKPAPRPADVNINSAVYPGGPPVPVQAPKLLKFVDTAEMLRGPQDTPGYWVVSGAKLQLERGKLSLRVKYSLLTAMVPDDEYPLDEHS

SEQ ID NO: 28789 - DNA, 2176 bp, Panicum virgatum
  misc_feature: Ceres CLONE 1887068
  misc_feature: Encodes the peptide sequence at SEQ ID NO. 28790
aaccacccctccgtatttacctccccatctccccaccccctccatcgctacttcagaaacggcgactacacgggcgtctcctccctgtggccgcgacgaaccacagcaatcgacgatttgaagtacatctgcgcaggctgcggggagagacggccagccctcaattgcccaggactgtcaaggatgccctcacagcagccacacttcggttagtcaagtgtgaccctgcagttctgctcctaaatcagagaaaatcatggcaacaaggcctcgaagagtaaggaacttgaacctcccagaagtagaagatgtagaacctgctgaggatgagcatgacaattcagcggagaatgagaacaatgaaaatttacagtgtcctcctgatattgatggtttattagctcgcatgccacgctaccatcctcgaagtccaattaagataatatggccaaatggagaggtgcggcaagttttaggtgatttcacaatttcaaatctattggaattagaaggaggaaaggtaattgttgggactgatgaaaatggagtcccaaatgaaaggtcagcctccattcttggtcaacaccttggacaaatagcagaaaagccatcattagctcctttacacattcaaagatgggacaatgctctgttcaagacacacaaggaacaaataatcaaggatgttgaggaaaagtttgacttccctcgctcaactagacagctctcaagggattggatcctaaggactgttaacaatagatggagagcctacaaatctaagttgaagaaacaatatttcaatcctgaagatagatctctagatgaaatcataaaagggaaaccaccaactgtaaatgaacatcaatggagagctcttgttggattttggtgccaggaatcacataagaaactatgtgccacaaactcccgatctgcaaaagaacagaagaatacccacacaacagggcgaaaaagccatgctaggctgaaaaaagagatggaagacaaaaagaaaagaaaggttcataggctagaattgtgggaggttgctcataaaaaaaagaatggtagatacactactgacaaagtagagacattagtggatgcatcttttgaggaattacaaaaaaggaaagagaacaacaatggtgatctttcagctcaagattttaatgaggtgttcaatgagatagttgctaaggagttaaaagcacgtgggtactatggtgataagtattggagtcaaatgcgagtttctcaaggtgtaacctttgttactccaactgaggaagaaattaggtaccaagagaaagtaaatgcaatggagaataagatgcaccacatgactggtctgatgaagcactggcttgctttcatgtcaaaaaaatttccagaagaggatttcataaatgaaatggaaggagccctagaggatgatgaagatggtcttatggaaacaaaatgtgatactgaaaaaagccctgaacactcaagtggtaatgacaactctccatcaattgatgcgcagcaagcacctgtccagataaataatggagccactgaagaccacacatctttatcaaatgagcagagaattgcaatggagggtcatgcagataagggtgatgcaggcactaacttgcgatctgatactatacagaccaacatgagatctcgaagagttaaagcccccagtttgaaccgatcggaatcgtgtgaaatggaagtctaccttatttcactgagaaacaaagggagagtggcggcgaaaggaacattaaagactactgatagcaaacgagttattggtggaagcatgcttggaacggaatttgttggtgtttatgttgatggaattgaaaataagggagatgaggagttacctcgaccactctatagtatttgtactctaatagatgctgttggctttattattccttggcccaaatcacatgtgaaaaaagtcatgagttcaaatcatacctgaaccagcttggaaagaagttcaagccatgagtggaaaggagaaagaaagggcaacgaaagatagatatattttagttgttacagaaaattctagaaatatttgtatgatactgctactttctatgtttctttgagaacaaatttgtcttgttcagtgtacttcaattaatcgatgagttggttccag

SEQ ID NO: 28790 - protein, 577 aa, Panicum virgatum
  misc_feature: Ceres CLONE 1887068
  misc_feature (201)..(332): Pfam Name: Transposase_24 Pfam Description: Plant transposase (Ptta/En/Spm family)
MATRPRRVRNLNLPEVEDVEPAEDEHDNSAENENNENLQCPPDIDGLLARMPRYHPRSPIKIIWPNGEVRQVLGDFTISNLLELEGGKVIVGTDENGVPNERSASILGQHLGQIAEKPSLAPLHIQRWDNALFKTHKEQIIKDVEEKFDFPRSTRQLSRDWILRTVNNRWRAYKSKLKKQYFNPEDRSLDEIIKGKPPTVNEHQWRALVGFWCQESHKKLCATNSRSAKEQKNTHTTGRKSHARLKKEMEDKKKRKVHRLELWEVAHKKKNGRYTTDKVETLVDASFEELQKRKENNNGDLSAQDFNEVFNEIVAKELKARGYYGDKYWSQMRVSQGVTFVTPTEEEIRYQEKVNAMENKMHHMTGLMKHWLAFMSKKFPEEDFINEMEGALEDDEDGLMETKCDTEKSPEHSSGNDNSPSIDAQQAPVQINNGATEDHTSLSNEQRIAMEGHADKGDAGTNLRSDTIQTNMRSRRVKAPSLNRSESCEMEVYLISLRNKGRVAAKGTLKTTDSKRVIGGSMLGTEFVGVYVDGIENKGDEELPRPLYSICTLIDAVGFIIPWPKSHVKKVMSSNHT

SEQ ID NO: 28791 - DNA, 571 bp, Panicum virgatum
  misc_feature: Ceres CLONE 1887093
  misc_feature: Encodes the peptide sequence at SEQ ID NO. 28792
aaccaaaccaaaccccaaggccaaaccggaggagagaggtagcagcaaagcgagcgcggggcggcggccggcaccgggcggcggccatgtcggcgctgcagagctggcgcaaggcgtacggcgcgctcaaggactccaccaccgtcagcctcgccaacctcaactccaacttcaaggatctcgatgtggcgatcgtgagggccaccaaccacgtggagagcccgcccaaggagcgccacctgcgcaagattgtggcagccacctccatcgcgaggccccgggcggacgtcacctactgcatccatgcgcttgcccggcgactagccaagacacggaattggatcgttgccctgaagacacttgtggtgattcataggcttctccgccaaggtgatcctgcattccgtgaagagtttcttacgtttacacagagagtgcggattttgcagctgtcaaacttcaaggatgactccagccctgttgtataactagagaattaaattctgaggacttgctggatcaattgccggcgctgccgcaattattatatcgacttattgcatgtcggcca

SEQ ID NO: 28792 - protein, 133 aa, Panicum virgatum
  misc_feature: Ceres CLONE 1887093
  misc_feature (29)..(129): Pfam Name: ENTH Pfam Description: ENTH domain
MSALQSWRKAYGALKDSTTVSLANLNSNFKDLDVAIVRATNHVESPPKERHLRKIVAATSIARPRADVTYCIHALARRLAKTRNWIVALKTLVVIHRLLRQGDPAFREEFLTFTQRVRILQLSNFKDDSSPVV

SEQ ID NO: 28793 - DNA, 700 bp, Panicum virgatum
  misc_feature: Ceres CLONE 1887116
  misc_feature: Encodes the peptide sequence at SEQ ID NO. 28794
tctgtccctcccgctctgctccgcacactcggtgcaggtgcaggtgcagcgtcgtcccctgctttgctccccacaccacccagcgcccgcattgccgccggtgagcggaggcggaccgcccgcggcggcgcgggggaggaaccaggaggaggagggcgcgggaagagaggcggcaggatgttcgggcgggacccgtggggcgggccgctggagatctccaacgccgactcggcgacggacgacgaccggagccgggacctggaccgggcggcgctgatgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaaactcgtaccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggatggtctctcggacagcaccgtccggcggagcttggtcgggggcttctacgatgcaggggacgccatcaagttcaactaccccatggcct

SEQ ID NO: 28794 - protein, 174 aa, Panicum virgatum
  misc_feature: Ceres CLONE 1887116
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWRGNSCMKDGLSDSTVRRSLVGGFYDAGDAIKFNYPMA

SEQ ID NO: 28795 - DNA, 712 bp, Panicum virgatum
  misc_feature: Ceres CLONE 1887122
  misc_feature: Encodes the peptide sequence at SEQ ID NO. 28796
atttgatccgagcctgctaattctcttctccctcccctccacgatcgagctgccgttgatggcccatgccagcaccgccacgtcacctctgctcgcctcgctcctcttcctcctcctccatgtcgccgcccgggccgacgcggcggcgacgctgtcgcagggccagtcgctgggcgcgggagaccgcctcgtgtcgcccggcggcaccttcgcgctggccttcttcgctccggcggggggcgacccgtcgcgacggtacctgggcgtcatgtacgcgcaggccgcggagcagaccgtgtcgtgggtggccaaccgcgacgcgcccgtgagcgccgcggcggcgtactcggcggccgtcacggcgtccggcgatctgcaggtgctggagggcgaccgcgtcgcctggagcaccaacacgtcctcgccgctgcggaacgtcaccctcgccatcgacgacgacgggaacctcaagctgacggccggcggcggcgggcagccggtgctgctctggcagagcttcgaccacccgggggacacgttcctccccggcatgggcatcaccctcgaccggcgcggcggcgccgtcagccggacgctgttcacgtcgtggcggagccccggggacccggccaccggcgacttcacgctcggccaggacccgctcggctccgcgcagctgtacatctggcgccggtccccgggcggcgccgcc

SEQ ID NO: 28796 - protein, 217 aa, Panicum virgatum
  misc_feature: Ceres CLONE 1887122
  misc_feature (77)..(191): Pfam Name: B_lectin Pfam Description: D-mannose binding lectin
MAHASTATSPLLASLLFLLLHVAARADAAATLSQGQSLGAGDRLVSPGGTFALAFFAPAGGDPSRRYLGVMYAQAAEQTVSWVANRDAPVSAAAAYSAAVTASGDLQVLEGDRVAWSTNTSSPLRNVTLAIDDDGNLKLTAGGGGQPVLLWQSFDHPGDTFLPGMGITLDRRGGAVSRTLFTSWRSPGDPATGDFTLGQDPLGSAQLYIWRRSPGGA

SEQ ID NO: 28797 - DNA, 708 bp, Panicum virgatum
  misc_feature: Ceres CLONE 1887122-R
  misc_feature: Encodes the peptide sequence at SEQ ID NO. 28798
cgtgacctcaaggccagcaacatcctgccggacggcgacatgaaccccaagatctccgacttcggcatggcgcgcatcttcggcggcgagggcgaccacaaccaggtgaacaccaaccgcgtggtgggcacgctggggtacatgtcgcccgagtacgccatggagggcctcttctcggtgcggtcggacgtgtacagcttcggcatcctcatcctggagatcgtgtcggggcggaagaacagcagcttccaccacatggagggctccctcaacatcgccggctacgcgtggcagctgtggagcgccggcaagggggagcagctggtcgacccgtcggtcctggaggcggcggagggcggcgcggcggcggcggcgctgcggtgcgtgcacatggcgctgctgtgcgtgcaggaccacgcgtgcgaccggcccgacatcccctacgtggtgatggcgctggggagcgacagctccgtgctgcccatgcccaggccgccgaccttcacgctgcagtgctcgtcgtcggaccgggacgggctattccgggacaaggccgacgagtcctactccgcctgcgacctcaccgtcagcatgctgcacgggaggtagagactcaaatagtcaaatgggctgcgccccaattggtagcaggctacatgggctgtacgttttgagggccgcattgtctaatctaatcatctctcatcc

SEQ ID NO: 28798 - protein, 202 aa, Panicum virgatum
  misc_feature: Ceres CLONE 1887122-R
  misc_feature: SWISSPROT Homolog: EC 2.7.11.1 Non-specific serine/threonine protein kinase
  misc_feature: Functional homolog of the protein sequence given in SEQ ID NO 50655
  misc_feature: Useful for making plants with altered cell wall content and/or composition
  misc_feature: Functional homolog of the protein sequence given in SEQ ID NO 50856
  misc_feature: Useful for making plants with modulated biomass
RDLKASNILPDGDMNPKISDFGMARIFGGEGDHNQVNTNRVVGTLGYMSPEYAMEGLFSVRSDVYSFGILILEIVSGRKNSSFHHMEGSLNIAGYAWQLWSAGKGEQLVDPSVLEAAEGGAAAAALRCVHMALLCVQDHACDRPDIPYVVMALGSDSSVLPMPRPPTFTLQCSSSDRDGLFRDKADESYSACDLTVSMLHGR

SEQ ID NO: 28799 - DNA, 1717 bp, Panicum virgatum
  misc_feature: Ceres CLONE 1887132
  misc_feature: Encodes the peptide sequence at SEQ ID NO. 28800
acgacttcacctgcttctccactccgcgcccccgcccgctccaccgttcgacgctcgtcttgctcagatccggcgcagcggcgctcccccacctctgcaccaaggtggcgactgggcgggcggcggcgcgtgcgcagttcatgcaccggtaggtctaacttccaagatccgcaaccgggatggttcgccggttaggacgtggatattctttatcttgtattgtatggagcttggtgggtttaggacttgttgtctgcttcctttcctttaaacatcaagcagacagtgggcaggcccatatttatttgagcgatctacctgcaaccagagaattagaggacattgaggaggatcatttccgcttgccacctcctcacaaggtaaatcctcgtgcagtgaaaaggcgggggcctcataagcaacgaaaggttatagatgattatctggaggagtcttcagcagtacatgcattgttcttccctgatcaaagaactgctttggacccaacaaaaggrggraatgataccatgtacttttatcctggtagagtgtggctagacaccaatggaaatgccattcaagcccatggtggcggggttatgtatgatgacaagactgccaaattctactggtatggagaaaacaaagatggaccaacataccaagctcaccccaaaggggcacagcgggtcgacatcattggagtaagctgctactcatcgaaggacctatggtcatggactcatgaaggaattgtgcttcctgtagagcctactaatgtcacccatgaccttcataaatcgaaggtgcttgagagacctaaggtgatatataatgatcacacagggaaatatatcatgtggatgcacatagatgatgccaactacaccaaagcttctgttggtgtggctgtcagcaactctccaactggaccttttacttacctttacagttttcgcccgcatggttttgagagtagagacatgacggtcttcaaagatgatgatggagcagcttacctcttctactcttctcgtgacaatactgagctccacattagtccattgacggaggactatcttcacatcacagcatcaatgaagagaatactaataaggcgacatcgggaagctccagctgttttcaagcaccaaggaacctactacatgatcacctctggttgctcaggctgggctcccaacagggcactggcacatgctgcagactcgatcatgggcccgtgggagacactgggaaacccttgcgtcggaggcaacaggttctaccggctgacaacattcttatctcaaagcacatttgtgcttcccctccctggtttgcctggtacatttatcttcatggcggatagatggagtccatcaaacttgagagactcccgttatgtttggcttcctctgttcattggagggctggcagatgaacctttagactacagttttggtttcccttcgtggtcaagggtgtcaatttattggcataagaaatggcgcctcccagaggcttggagggtggggtatacctaactactgatcgctgctgcagtgaatacataggatagctatacttcgacagctagattgttcagaaacttgcttaaggttcctaatcagttcttcctcgagcttttgtacacttaggccaactaaacatactttaaagatgtgtgtgtgtgtggtgtgtcactaacttcagctag

SEQ ID NO: 28800 - protein, 454 aa, Panicum virgatum
  misc_feature: Ceres CLONE 1887132
  misc_feature (136)..(404): Pfam Name: Glyco_hydro_43 Pfam Description: Glycosyl hydrolases family 43
MVRRLGRGYSLSCIVWSLVGLGLVVCFLSFKHQADSGQAHIYLSDLPATRELEDIEEDHFRLPPPHKVNPRAVKRRGPHKQRKVIDDYLEESSAVHALFFPDQRTALDPTKGGNDTMYFYPGRVWLDTNGNAIQAHGGGVMYDDKTAKFYWYGENKDGPTYQAHPKGAQRVDIIGVSCYSSKDLWSWTHEGIVLPVEPTNVTHDLHKSKVLERPKVIYNDHTGKYIMWMHIDDANYTKASVGVAVSNSPTGPFTYLYSFRPHGFESRDMTVFKDDDGAAYLFYSSRDNTELHISPLTEDYLHITASMKRILIRRHREAPAVFKHQGTYYMITSGCSGWAPNRALAHAADSIMGPWETLGNPCVGGNRFYRLTTFLSQSTFVLPLPGLPGTFIFMADRWSPSNLRDSRYVWLPLFIGGLADEPLDYSFGFPSWSRVSIYWHKKWRLPEAWRVGYT

SEQ ID NO: 28801 - DNA, 1848 bp, Panicum virgatum
  misc_feature: Ceres CLONE 1887143
  misc_feature: Encodes the peptide sequence at SEQ ID NO. 28802
gaaaaggcaaaggagatttcgaacgcttccagaaacttcttccccaccccacatcgccgccgtgcgccggcgatccaggttccgcctccgtccgccgcgcctgactcgccctagtggtagttcccgttcgccgattcgcccaccccccggcggcacccatggcggtcgaggggatggggtccgtggtcgcgacggtgagcgggtaccacggcgacgagcggcacaggctcatcaagctcatctcggagtccggcgccagctacgtcggacccatgagcaggtccatcacccacctggtgtgctggaggctcgaggggaagaagtacgacatcgcgaggaagttccggacgcgcgtcgtcagccaccggtggttcctggagtgtctcagggaggggaggcgtctcccggaggacccctacttgatggaaagtggtgaagaagcaggaccagtcccagagcttcctgctcgtccttgtacacgaggcaagaaaaatgcagtcacagagggtagagttttgaaagagttacctgatgatttctgtgatactcctacggccagccatactattaagcttgatgattcagattctgatatggagcatcagacattgtctgaatcagccctactaaaagaaaattttggtgattgggaatctgagaagaatgatttatcagatgttaagcaaagaagaaaacgtttgaagagtgttaaaaaatcaatggataaagatgttctacacctgcaggacaatgtgtcaagtgtcatggcaagacaatgccttcatgagtcaagtcacacatcgaaacagaagggagaaaggaacgatctcacagaaagtgatagtttgtctgacagctttgatgaacctcagactttggatactctgtctataggagcgggaagaaaatttaccaagacaaaagtatcatcatcatcccttcgacaaagtaccctggattcattgtacgaatatggcgaaactagtaggcatgaaccagacagaagaaaagagcaaaaaaacgctgacttaagggagagttcaacaagcttgcctccatttgatttgtctggacagggaccagctttctgtactcaggagcaaaaagacaaatatagccttgacactccagctgatgatgaattgggagacgacaagaaactcatggaaaaatcatctaatttagaaaggcaagaagaattatcatgcgtgatatgttggacagatttttcttctacaaggggaatcttaccatgtggacaccgattctgttattcatgcattcaaggatgggcagattgtctgacttccgggaggaaagtctcaacatgtcccctttgtaaagccagtttcacatcgatcactaaggtggatgaggcaggcacctctgatcagaagatatactcacagaccattccttgtgaagcttctaccgaggtttctgtgttccataatgaaggctatgtttctgtgtttcataatgagggctatgacttctctcgattctggactcggccaggagcatgcttccagtgcaacagctgtgaacctgaggagcttcttctaagctgccatgtctgcaggtcgcggtgggtgcactcatactgccttgatcctccaatgaccccgtggatatgtgtgcattgcaggggtatgcgtatgatgtatcaccgctatcactagtctgaaattggaatactcgtgccatggtctgaacgctgctcttttcttattccttagaatagtctgtttgagattgtatccgtagtttgtgacagttctcgccaaagagcgaataaattgatgtgtacctataagttgatatgatagagattcgggatgtactgtc

SEQ ID NO: 28802 - protein, 507 aa, Panicum virgatum
  misc_feature: Ceres CLONE 1887143
  misc_feature (350)..(394): Pfam Name: zf-C3HC4 Pfam Description: Zinc finger, C3HC4 type (RING finger)
  misc_feature (1)..(76): Pfam Name: BRCT Pfam Description: BRCA1 C Terminus (BRCT) domain
  misc_feature (455)..(499): Pfam Name: PHD Pfam Description: PHD-finger
MAVEGMGSVVATVSGYHGDERHRLIKLISESGASYVGPMSRSITHLVCWRLEGKKYDIARKFRTRVVSHRWFLECLREGRRLPEDPYLMESGEEAGPVPELPARPCTRGKKNAVTEGRVLKELPDDFCDTPTASHTIKLDDSDSDMEHQTLSESALLKENFGDWESEKNDLSDVKQRRKRLKSVKKSMDKDVLHLQDNVSSVMARQCLHESSHTSKQKGERNDLTESDSLSDSFDEPQTLDTLSIGAGRKFTKTKVSSSSLRQSTLDSLYEYGETSRHEPDRRKEQKNADLRESSTSLPPFDLSGQGPAFCTQEQKDKYSLDTPADDELGDDKKLMEKSSNLERQEELSCVICWTDFSSTRGILPCGHRFCYSCIQGWADCLTSGRKVSTCPLCKASFTSITKVDEAGTSDQKIYSQTIPCEASTEVSVFHNEGYVSVFHNEGYDFSRFWTRPGACFQCNSCEPEELLLSCHVCRSRWVHSYCLDPPMTPWICVHCRGMRMMYHRYH

SEQ ID NO: 28803 - DNA, 2506 bp, Panicum virgatum
  misc_feature: Ceres CLONE 1887150
  misc_feature: Encodes the peptide sequence at SEQ ID NO. 28804
tccctgataggcggaggcggcctggtctggagaacaccccaggctcgagcaaagccaccgccgatccgctgctcctgacccttcttcgtgggccgcgcaggcatgaggctcctcctcgtcgccgccctcctcctctgggcctccgcggcggcggcgtccaagccgcccctcgacaccctcggcatccccccgcaagatgaggcgtactacaggggcggggtgatcaagtgcagggatggatcgggcaagttctccagggaccagctcaacgacgacttctgcgactgccccgacggcaccgacgagcccggaacatccgcgtgccctgaaggcaagttctactgcaagaatgcaggccacactccaatcacgatcttctcatcacgagtgaatgacggcatttgtgattgctgtgacgggagcgacgaatatgatagcaatgtcacctgtaagaacacttgctgggaggctggcaaggcggcaagagataaattgaagaagaaaatcgctacgtacaaaagcggtgtcgttattcgaagacaggaagttgaaagggcaaaagaggcttttgctaaagatgaagcggagttagcaaaattgaagggtgaagagaaattactccaaggacttgtcgataagctcaaagagcaaaagaaattaatagagaaggcagaggaagaagagcgtctaagaaaagagaaggaagaaaagcgaataaaagaagaagctgaaaagaaagccactgttgaaaaggaagcacaggatgcttctcaggaagtagaatctaaggaaactgtcccccctgtgcaagaagatgaaagcaaggtcggtgaacaacatgatgggcatgccacggaccatgataatcatgtgccagaaagcaggatatctgttgagcagcatggttctgaaagccaagatgatagtggagctgtagtcgaatcgccaccaaaggagtctacacctattttagagaaggaaactagctctgacaatcctgagggtttatcaagggaggagttaggtcgtttggtggcttctcgctggactggagaaagtgtaaatgaggttagtaaggacgataagaaggggcatgaagatgtacatgaaataccagaaccaccagaagaagcatctgaagacgaattagaaataccagaacctgctgaggaaagttatggtggttatcattcagaagttgaggacgacaggcataaatatgatgatgacgagtttggtcatgaatcagaagatgaatatgctgatgatcatgatgatcatgttggatcttataaatctgatgatgaccagaaaggtggtcaccattcagatttaactgcatcaagacattcctcgtggatggacaaaattcagcagactgtacaaaatgttctccaaaaattcaactttttcaaaacccctgtggatttatcagaggcttctcgtgttcgcaaagagtatgatgatgccagctcgaagctttcaaaaatccagtccaaggtatccacgctaactgagaagctaaagcacgactttggtaaggacaaggagttctattccttttatgatcagtgctttgagagcaaggagggcaaatatacttataaggtctgcgcatacaagaaagcaacacaagctgaaggacacagttccacaaacctggggcgttgggacaagtttgaagagtcataccgagtaatgcagttttcaaatggggacagatgctggaatggaccagaccgaagcctgaaagttaggcttagatgtgggctgagtaatgagcttaatgatgtcgatgagcctagccgatgcgaatatgtggctgtattgtcaactcctgcactttgcatcgaggagaagctgaaggagctgcagagctaacttgacgccatgtctttgaaacagcccgggcatgacgagctctaaactatcctggtgtgatgcaagaaacaataaagaacatgtcacaccgggaagcataactctcacatttacattcataaccaaagagtggcagtctgtgaggtatatgaagagtgaaggtccaagctggggaaatggtatgtagtgttcagatcaccaccgaggcaatgttaggttgcatagaaccctatttttagctgaattcttaggacgttgcaattttccagcctcgtcctgacttttgtttggtagaggcgactgcaactgagctttaatttgtgaattaacattgctatatcctctatgttagggaaagatgcgggacccgtgttgtgtctccagcttcattgccaaccggacatcagaaattcagaatgtcttagaacttgttacacatttggtgaaaaccagttagaaacagtacacatccggaaacatcataatctgaagccccaggttgttacggaatccttcgttccagtcatttgaaaatcgagggaatttgcctggttaccatcaatgaaaccctacgtactttgccgtagcttaaatggcattctggcaatcgggatccttttgaatc

SEQ ID NO: 28804 - protein, 592 aa, Panicum virgatum
  misc_feature: Ceres CLONE 1887150
  misc_feature (489)..(538): Pfam Name: PRKCSH Pfam Description: Glucosidase II beta subunit-like protein
MRLLLVAALLLWASAAAASKPPLDTLGIPPQDEAYYRGGVIKCRDGSGKFSRDQLNDDFCDCPDGTDEPGTSACPEGKFYCKNAGHTPITIFSSRVNDGICDCCDGSDEYDSNVTCKNTCWEAGKAARDKLKKKIATYKSGVVIRRQEVERAKEAFAKDEAELAKLKGEEKLLQGLVDKLKEQKKLIEKAEEEERLRKEKEEKRIKEEAEKKATVEKEAQDASQEVESKETVPPVQEDESKVGEQHDGHATDHDNHVPESRISVEQHGSESQDDSGAVVESPPKESTPILEKETSSDNPEGLSREELGRLVASRWTGESVNEVSKDDKKGHEDVHEIPEPPEEASEDELEIPEPAEESYGGYHSEVEDDRHKYDDDEFGHESEDEYADDHDDHVGSYKSDDDQKGGHHSDLTASRHSSWMDKIQQTVQNVLQKFNFFKTPVDLSEASRVRKEYDDASSKLSKIQSKVSTLTEKLKHDFGKDKEFYSFYDQCFESKEGKYTYKVCAYKKATQAEGHSSTNLGRWDKFEESYRVMQFSNGDRCWNGPDRSLKVRLRCGLSNELNDVDEPSRCEYVAVLSTPALCIEEKLKELQS

SEQ ID NO: 28805 - DNA, 657 bp, Panicum virgatum
  misc_feature: Ceres CLONE 1887156-R
  misc_feature: Encodes the peptide sequence at SEQ ID NO. 28806
gtgcccgccgggatgctcctgggcgggccccccgagctggcggccggcctgctgcagaaggccatcgacgaccacgacgccgccgccgtcacgcggaggctcgaggagtacgaggccgcgcccaagctcttccactacagcgacgccgggcccaactgcgtcgccgtggggagctccccgcgcttcaaggtgtacgacgtcgacttcggcttcggcaggcccgagcgcgtgcgcagcggcggcaacaacaagttcgacggcatggtctacctctacccggcccgcgccggcgacggaggcatcgacgtcgagctggcgctgcagccggagccgatgcagaggctccaggaggacgccgacttcctcctccaccagccggcctagccacctgctcatttaattaattgttaactaattggtattggattgacagtactgtactgtagtattcgatccttgttgcattgcttcgtcaccattcaattccgtatgtttcatcagtcggtgttgtactcttgtaccttttttttgtgactttgtactcttgtgtcttgttatatatacttatgtaccactggatttttttttttgaaagttatgtaccactggatttgatcgtcaagaataaataaatctagtaataatcaattctcacgc

SEQ ID NO: 28806 - protein, 127 aa, Panicum virgatum
  misc_feature: Ceres CLONE 1887156-R
  misc_feature: The sequence is a functional homolog of SEQ ID NO 34 in US patent 7105719
VPAGMLLGGPPELAAGLLQKAIDDHDAAAVTRRLEEYEAAPKLFHYSDAGPNCVAVGSSPRFKVYDVDFGFGRPERVRSGGNNKFDGMVYLYPARAGDGGIDVELALQPEPMQRLQEDADFLLHQPA

SEQ ID NO: 28807 - DNA, 1504 bp, Panicum virgatum
  misc_feature: Ceres CLONE 1887156
cactaccatactagtgctagctagctcatcagctcgaagctgcaggtaacaagcaagcaagcacagctagcgacaatggcggccgtcgagaatggcagcagcagcagcaaggagcaggtagcagcagtgagcgtgacgggcaggcgcacggtggcgcccggcaagagccggtgcgtcctggccaccttcgacctcccctacatcaccttctactacaaccagaagctgctcctgtaccgcacggtcgacttccccgacgccgctgcgcgcatcacggccgcgctctccgacgcgctccgcgtcttctacccgctcgccggccgcatccgccaggacgccgacggcgcgctcgccgtggagggcgacgagggcgccgaggtcctggaggccgaggccgagggcgtcgccgtggacgaactcgccggatccggaggggactgcggcgagagggtcatgcagcagctggtgccatacaccggcgtcatgaacctcgaggggctccgccgcccgctgctggctgtccaggtcagtatacgatacgtatatgcattatatatatttggatcatttatttgcgtgcatatatcacagccagccatcatgcatgccagatagatagatagatctgcgcatacgacatacacatgattatcgtccaaaatcaaaacaaattaaatcccttgatgatgttatatatataattataattatatatattagtgttctgtatttgtaagtcggagtatatcagactagaatatataggaagatgatatggcagtagttttatttgaagctggtcccaaagtggaccggtccgcaataaatcccagagtaaatgagtcttgaatacaaatgcaccgctgcattcactactactcgctgctattttttttttacatcgcccatgcttgcttgtttgtttggtttcctggaatttcaggaatagtaacaatttgatcgttaattacgagtcaaataaagtcagtttacaaaaccagctctagaaataggttactatagcatgagacggatctaacgaggctcttgactgtgtgattagagaatggttactgtagcaccgtcattagattcatcgcgaaaatttgcacccatctctgtagaggttttgctgatagacttaatttaggtcttgatgcggagtatagaaaacgtacctttgctagaattctaggaaaggaaacaggcccttgacagtaccagtggaagtgtattgctgtcgtaaaattgtaaatagtagatcttggtggtttgtatgcattgttacccaacccaacccaagctcctatgcatgcatgcatgcagctgacgaagctcaaggacggcctggccgtgggctgcgccttcaaccacgccgtgctggacggcacctcgacctggcacttcatgtcctactgggcccagctctgccgcacgagcagcccatcatccctggtgccgcagcccatccacgagcgctccctggcccggcccgtccgcgtgc

SEQ ID NO: 28808 - DNA, 1964 bp, Panicum virgatum
  misc_feature: Ceres CLONE 1887157
  misc_feature: Encodes the peptide sequence at SEQ ID NO. 28809
agtttgaatttcgcttttgcaggttggctgggagaattcgagttaacaatttttttgatgcaataaacattcgttcttaaaaccttgcacattattgtgtttgatggggcttctcatgctgacggacatcttatgctaacttatgcttcgtgttacagtttcatgctaattgaaatattgtgcataccatgttcttcgtttgaagttattgcgtgtcatcattctggaggcaatgctaacatgggaccttgacaatacaaagttcatccttcatgttacaattttcatatttttttgaggggagattcagattgtatacacagaaattggaacattgaacgttccattcactcctgtatactgtccatgaaaatagaaaccctgccaaaactaacatgtaaggctaatagtgaagtcaattacaagggcgtgagagtcaaacatttggattagcatctgcaattttctcgtttgcctgtatacctgtgtttgtctgtgtgcaagaacactagatgctgtttgttggttctgcgcttatgaaatgggatcacacagagagacataaagttcaccttatttcttccatatgtacatggtggataactgaatgaatgaaagaattgcatgacactttcaccattatgaaaaaagacaagtgacacgaaaccaggaatcatgcatcatcgcatctttacacaatgttctatctgtttccttttttgcgttctctgaaatcaagtgtaatgaccatgttccaaacatgcgcagctgaggaacctcctgtgggctacttcgaagcacgacgtgtacctggtgcagaactactcggtgatgcactggtctcctctgcaccagagagggagagaagtgctcaatgtggccggacaattgactccaacagagaatgtcaaaggggctaggccactgtcgagggttcagatcagcaccatggcactgaaggacaacctcatggtggccggtggcttccagggagaactcatatgtaagtttgttgataaacctggagtggcgttctgcacgaacctgaccggcaacaacaactccatcacgaacgccgtggacatctaccaggcgcccaacggcgccacccgagtgacggccgcgaacaacgactgcgtcgtcaggacgttcgacgccgagagatacagcctcctcacccagttcaccttcccgtggtccgtcaataacacgtcggtgagcccggacggcaagctgatggcagtcctgggcgacagctccgactgcctgctcgccgactcgcagtccgggagggagatcgcggccctgcgcgggcacctggactactcgttcgcgtcggcgtggcaccccggcgggcacgtcgtggcgacggggaaccaggacgcgacgtgccgtctctgggacgtccgcaacccgtccgcgtcgctcgccgtgctcccgggccggatcggcgccgtccgggggctccggttctcccccgacgggcggttcctggccgcggccgaggcggccgacttcgtgcacgtgtacgacgccgcggccgggtacgccggcgccgagcaggaggtggacctgttcggggaggtggccggcgccgcgttcagccccgacggggaggccctgttcgtgagcgtcgccgaccggacctacggcggcgtgctcgagttccggcggcggcggtcgtacgggtgcctcgactcgtgcttcttctgaggtgcccggtccgtgtggcgtgcccggactatatagagcgtgttctgtgtactgttggtattttctgtagtgtatgggaaagcgcagtgtttttggcgtgcgcgggtcctgagatgactggtgctgcctgcatttcgctcttttagaactgcggagtgacaggtgctatcaggaggtttgtttgggtatatagacaagacaccttaaacgtgctgttttaggcactgtagcgtcaagaattgtaaatctgc

SEQ ID NO: 28809 - protein, 293 aa, Panicum virgatum
  misc_feature: Ceres CLONE 1887157
  misc_feature (153)..(191): Pfam Name: WD40 Pfam Description: WD domain, G-beta repeat
  misc_feature: SWISSPROT Homolog: EC 2.3.1.48 Histone acetyltransferase
MHWSPLHQRGREVLNVAGQLTPTENVKGARPLSRVQISTMALKDNLMVAGGFQGELICKFVDKPGVAFCTNLTGNNNSITNAVDIYQAPNGATRVTAANNDCVVRTFDAERYSLLTQFTFPWSVNNTSVSPDGKLMAVLGDSSDCLLADSQSGREIAALRGHLDYSFASAWHPGGHVVATGNQDATCRLWDVRNPSASLAVLPGRIGAVRGLRFSPDGRFLAAAEAADFVHVYDAAAGYAGAEQEVDLFGEVAGAAFSPDGEALFVSVADRTYGGVLEFRRRRSYGCLDSCFF

SEQ ID NO: 28810 - DNA, 714 bp, Panicum virgatum
  misc_feature: Ceres CLONE 1887165
  misc_feature: Encodes the peptide sequence at SEQ ID NO. 28811
accgctagcgcgctgagctgtggcgtctgagggaagccttccactccccagcagcagccttgacccgaccgccgtccgctgggggcgtcgctggagacgcgcccgcctcgggttcttcgccgtccccctccccggccggcgtcctggtgccagtcgggcccgatcggccgcgtagcctccgggcatccgcagagatatattgtaaaatggaagcactacgtaatatgaaactgcccccaggatttggattctatccttccgataccgaactcattggtcactatctaaagaggaaaatacatggccagaaaattgaacacgatcttataccagaggtggatatatacaagcacgaaccatgggatttacctgcaaagtgcaattttccaatcgaggacaacaagtggcatttcttctcctctcgtgataggaagtaccctactggttctaggtcaaacagggcaacagttgctggttactggaaatcaactgggaaggaccgaggcataaagctgaacaagcgaactctaggaacaaagaagactttagtttttcatgcaggccggcctccctctggtagacgcactgaatggattatgcacgagtactacatagatgagaaggaatgtcaagtcagccccgatatgaaggatgcttttgttctctgtcgtgttactaaaagaagtgactgggcattggataatgataatgagg

SEQ ID NO: 28811 - protein, 169 aa, Panicum virgatum
  misc_feature: Ceres CLONE 1887165
  misc_feature (9)..(137): Pfam Name: NAM Pfam Description: No apical meristem (NAM) protein
  misc_feature: The sequence is a functional homolog of SEQ ID NO 612 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Functional homolog of the protein sequence given in SEQ ID NO 51018
  misc_feature: Useful for biocontainment applications
  misc_feature: The sequence is a functional homolog of SEQ ID NO 854 in the 11/435,388 US patent application
  misc_feature: Functional homolog of the protein sequence given in SEQ ID NO 51290
  misc_feature: Useful for making plants with altered lignin content
  misc_feature: Functional homolog of the protein sequence given in SEQ ID NO 51291
  misc_feature: Useful for making plants with altered cell wall content and/or composition
  misc_feature: The sequence is a functional homolog of SEQ ID NO 344 in the 10/666,642 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: Functional homolog of the protein sequence given in SEQ ID NO 51020
  misc_feature: Useful for making plants with altered alkaloid content
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: Functional homolog of the protein sequence given in SEQ ID NO 50907
  misc_feature: Useful for making plants with altered carbohydrate content
  misc_feature: The sequence is a functional homolog of SEQ ID NO 1438 in the 10/666,642 US patent application
  misc_feature: The sequence is a functional homolog of SEQ ID NO 208 in the 10/666,642 US patent application
  misc_feature: The sequence is a functional homolog of SEQ ID NO 2100 in the 10/374,780 US patent application
  misc_feature: The sequence is a functional homolog of SEQ ID NO 270 in the 10/714,887 US patent application
  misc_feature: The sequence is a functional homolog of SEQ ID NO 270 in the 11/435,388 US patent application
  misc_feature: The sequence is a functional homolog of SEQ ID NO 854 in the 10/374,780 US patent application
  misc_feature: The sequence is a functional homolog of SEQ ID NO 582 in the 10/666,642 US patent application
  misc_feature: Functional homolog of the protein sequence given in SEQ ID NO 50639
  misc_feature: Useful for making plants with altered terpenoid content
  misc_feature: The sequence is a functional homolog of SEQ ID NO 476 in the 10/666,642 US patent application
  misc_feature: The sequence is a functional homolog of SEQ ID NO 1012 in the 11/435,388 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 851 in the 10/374,780 US patent application
MEALRNMKLPPGFGFYPSDTELIGHYLKRKIHGQKIEHDLIPEVDIYKHEPWDLPAKCNFPIEDNKWHFFSSRDRKYPTGSRSNRATVAGYWKSTGKDRGIKLNKRTLGTKKTLVFHAGRPPSGRRTEWIMHEYYIDEKECQVSPDMKDAFVLCRVTKRSDWALDNDNE

SEQ ID NO: 28812 - DNA, 1958 bp, Panicum virgatum
  misc_feature: Ceres CLONE 1887172
  misc_feature: Encodes the peptide sequence at SEQ ID NO. 28813
ttccccattcctctcccgtagttgatagtcccacccttcccttcccagatcggcagatccgcccccacctaacccccgcgcgcggcgcgcctcccgtcccggatggccaccgtctcccccgcccgccccgggccgccgtagcatgggcctctccccctcctccctctccaaatccagcaccaactccccgccgcgccgcagcaggtcgctctccccgatggcgccgccgccgcagccgcgggcgaccgtgcccgtgatggtcgccgcggggggcagcggcagctcctccgcctcctcctcctgcctgttcgccccgcccgcgcgggactacacgcaggacctgccggacgagatcctcgcgctcgtcttcgcgtcgctctcgcccgcggaccgcagcgcctgctccctcgcctgcgcgcgctggaaggaggtcgacgccgccacgcgccaccgcctctccctcgacgcgcgggccgggctcggccacgccgcgcccgccctcttcgcgcggttcgcggccgtcaccaagctcgcgctccggagcgcgcggggctccggcgccggcagcctcgccgacgacggcgccgcggcggtggccgctgcgctgccctcggaccgcctcggcaggctcaagctccgcgggctgcggcagctgtctgacacggggctgtcctcgctcgccgccgccgcgccggctctccgcaagctctctgttgcttcctgcaccttcgggcccaaggccttcgtcgctgtgcttcaggcctgcccgctcctcgaggacctctccgtcaagcgcctccgcggcctaccagacacggctggtgccgctagtgccattgctgaggagatcaaatttccacaggcgttatccctgcgttcagtttgcctaaaggatctatacagcgcactgtgctttgtgccgcttgtggcgtcctcgccgaacctccgcacgctcaagattctgcggtgctccggcgcctgggacctgccattggaggtcatcactgcgcgtgctcctggtcttgttgagcttcaccttgagaagctccaggtgggtgaccgtggcctagctgcgctctcggcctgcagaaatctggaggtgctgttccttgtcaagacccctgagtgcactgactcgggcatcatcagtgttgctgaaaagtgccacaaactccgcaagctgcatattgatggatggcgcacaaaccgaattggggatttcggactcatggctgtggcacgaggatgtccggacctgcaggagcttgtcttgattggggtcaaccccactgtgttgagcctcaggatgcttggtgagcactgtcgtgcattggagcggcttgcgctttgtgggtgtgaaactgtaggggatgcggagatcatttgcctggctgagcgatgtgctgcgctcaagaagctctgcatcaagggatgcccggtgtcagatcgtgggatggaagcactgaatgggggctgccccagtttagtcaaggtgaagctgaagagatgccgtggagtgtcctatgagtgcgtcgagagtctgaaggttaccaggggggaatcattttcgatcagcttggatattgtgttggagcctgatgctgggagtgctagtgaaaatggtgtccaggagacaggccaggcacaaatcaccgagctgaccgatcagatggctggcatggaccttccaaccaatgctgctggagcacaatcatcgacaaatactattaacagggtgaggagtgtcgtgacagcgatccggcgtcggtttgggcaccctcaatcacagtgatatgagatggcaattttatgaactgttgtaatcctttcccattttctaatcacatattcatgtttcctaaactgatcacattgcctggccagtccgtgcgagataaccgtctatggatgtttcttaaggttgttttatcggctaattgcatcaatcccattaactc

SEQ ID NO: 28813 - protein, 524 aa, Panicum virgatum
  misc_feature: Ceres CLONE 1887172
  misc_feature (37)..(83): Pfam Name: F-box Pfam Description: F-box domain
MAPPPQPRATVPVMVAAGGSGSSSASSSCLFAPPARDYTQDLPDEILALVFASLSPADRSACSLACARWKEVDAATRHRLSLDARAGLGHAAPALFARFAAVTKLALRSARGSGAGSLADDGAAAVAAALPSDRLGRLKLRGLRQLSDTGLSSLAAAAPALRKLSVASCTFGPKAFVAVLQACPLLEDLSVKRLRGLPDTAGAASAIAEEIKFPQALSLRSVCLKDLYSALCFVPLVASSPNLRTLKILRCSGAWDLPLEVITARAPGLVELHLEKLQVGDRGLAALSACRNLEVLFLVKTPECTDSGIISVAEKCHKLRKLHIDGWRTNRIGDFGLMAVARGCPDLQELVLIGVNPTVLSLRMLGEHCRALERLALCGCETVGDAEIICLAERCAALKKLCIKGCPVSDRGMEALNGGCPSLVKVKLKRCRGVSYECVESLKVTRGESFSISLDIVLEPDAGSASENGVQETGQAQITELTDQMAGMDLPTNAAGAQSSTNTINRVRSVVTAIRRRFGHPQSQ

SEQ ID NO: 28814 - DNA, 2111 bp, Panicum virgatum
  misc_feature: Ceres CLONE 1887178
  misc_feature: Encodes the peptide sequence at SEQ ID NO. 28815
tcatcgctgcctcctcctcgagtcgtgcgggtcaagcccgccgctcagcttcctcgactcgccccgcgtgaaggggccagcgagcggcgacctcctcggcggcgcgctccccggcggcgtctctccccaggcagcagcgcgctacgccggcggcggtcgccttctccgtcctcccatccaggttgtgactggcacaatagattgtgattcacgggaggcgcattggcctcaatggctctaacgctcctccgagggatgaggacgccgatctcatttagatcaaatacaggcttattctttaccgttctacgacctcggttggcccgcttcacgaccagggcggagagtgcgcaggcaaccgaggccaaagcagcagccaaatcaattcagctggcgaccaaggaggcggcagagcagaagacacaagggtttgaagcgatcattggaattgagacccatgtccaactctcgaccgtcacaaaagcattttgttcttgcccgtacaactacgggtcccagcccaataccactatctgccccacctgcatgggccacccagggacactgccagttctgaatgagaaggtcgttgagtgtgctgtgaagttgggccttgctctcaactgtgagatctcgatgacatccaagtttgatcggaagcagtatttctacccggacctccccaaggggtaccagatttcccagtttgacattcccattgccaagaagggctatgttgatttggatcttccagtggaatttggtggtgggcacaggaagtttgggatcacaagggttcacatggaagaagatgctggcaaactgcttcattccgaatccggcagttactcgcaggttgacctaaacagggctggtgtacctttgcttgaaattgtctcggagccagacatgagaacagggatagaggctgctgaatatggtgctgaactgcaaaggatcgttaggtatctgggagtgagtaatggtaacatgcaagaaggttcccttcgttgtgatgtgaatgtttctgtccgacctgttggacaatcagaatttggtacaaaggtagaaataaagaatatgaactcattttctgagatcaatagggcaatcgattatgagatatcccgacaaattctgctccataaagaaggtcaggctgatcaaattgtgcaagaaacccgtctatgggatgaatcttctcagaaaacttttacaatgcgaaaaaaggagggacttgctgactacagatattttcctgagcctgatcttcctgaagttgttctcactactgactatattgatgaaatcagcaagtccttgccagagcttccagaagcaaaacgtaggcggtatgagaatatgggacttagcatgcaagatgttttgttccttgctaatgacgacaatgttgctcatttctttgattctactcttgagcatggtgctgatgcaaagttggcttgtaactggatcatgggtgacattgctgcttatctaaaaaatgaaaagctgtccattgatgaaactaaattaacacctctggagctttctgaacttatcgcatccatcaagaacggaactatcagtgggaagattggcaaggagatactggttgaactcatttccaaaggtggcaccgttaagggtgtgatagaggagaaagatttggttcagatagcagatccagcagaaatcgaggcaatggtagataaagtaattgctgagaatccaaagcaacttgagcagtaccgtgctgggaaaactaagttgcaaggattttttgcaggccaggtgatgaaagcatcgaagggtaaggccaaccctgatttgttgaataaaatccttggagagaagttaaatgccaattagttctattgattaatgagcacaacattgggtgaaatctcagagaattatttgccggttaggctaggaaatcccttggttggtctggaaattgttatctctattaaattcagaatgtgattatctatttcgtttccttgtggatattgtagaagtccagttcgcaattcgcatctttgtacttgactcagctcatttgaaaaggaagcataccgcttgcatctcatgcaagcagcaagtgg

SEQ ID NO: 28815 - protein, 546 aa, Panicum virgatum
  misc_feature: Ceres CLONE 1887178
  misc_feature (65)..(308): Pfam Name: GatB_N Pfam Description: PET112 family, N terminal region
  misc_feature (396)..(543): Pfam Name: GatB_Yqey Pfam Description: GatB/Yqey domain
  misc_feature (327)..(394): Pfam Name: GatB Pfam Description: PET112 family, C terminal region
  misc_feature: SWISSPROT Homolog: EC 6.1.1.18 Glutamine--tRNA ligase
MALTLLRGMRTPISFRSNTGLFFTVLRPRLARFTTRAESAQATEAKAAAKSIQLATKEAAEQKTQGFEAIIGIETHVQLSTVTKAFCSCPYNYGSQPNTTICPTCMGHPGTLPVLNEKVVECAVKLGLALNCEISMTSKFDRKQYFYPDLPKGYQISQFDIPIAKKGYVDLDLPVEFGGGHRKFGITRVHMEEDAGKLLHSESGSYSQVDLNRAGVPLLEIVSEPDMRTGIEAAEYGAELQRIVRYLGVSNGNMQEGSLRCDVNVSVRPVGQSEFGTKVEIKNMNSFSEINRAIDYEISRQILLHKEGQADQIVQETRLWDESSQKTFTMRKKEGLADYRYFPEPDLPEVVLTTDYIDEISKSLPELPEAKRRRYENMGLSMQDVLFLANDDNVAHFFDSTLEHGADAKLACNWIMGDIAAYLKNEKLSIDETKLTPLELSELIASIKNGTISGKIGKEILVELISKGGTVKGVIEEKDLVQIADPAEIEAMVDKVIAENPKQLEQYRAGKTKLQGFFAGQVMKASKGKANPDLLNKILGEKLNAN

SEQ ID NO: 28816 - DNA, 601 bp, Panicum virgatum
  misc_feature: Ceres CLONE 1887185
  misc_feature: Encodes the peptide sequence at SEQ ID NO. 28817
ctcgctcgctcgctcagatccggaagctttggggaaggagctgtgcgtcgtgcacgggatcggtatcgcgcagtggcagctggccgggtgactacgacgggagcgggatgggcctcctcgacaagctatgggacgacaccgtcgcggggccccgcccggacaccggcctcggccgcctccgcaagcagcccgtgcgccccgccgccgtgaagatcaatggtgagcgaggtggccgccgccgccggagtaaaagagaaaatacgcgtaaaatacaaccccttgtagccgttgttcccttcgatctgactgatcgtttggttcccgttggtcgtacagatccggccggggacgcggcggccttcgtcccgccgtcgccggcgtcaggcagcgaggagacgccggtcaaggtgacgcgcagcatcatgatcaagcgccccgcggggtacccgtcgtcgccgaggagcgcggccagcacgccgccggcctcgccgcttgggaccaccccgcccatctcgccgttcgccggcgccggtgagtgccccgagactcctggaccccctcctccctcccttcgcgttaacatctcctaggaataggggca

SEQ ID NO: 28817 - protein, 160 aa, Panicum virgatum
  misc_feature: Ceres CLONE 1887185
  misc_feature (7)..(122): Pfam Name: Auxin_repressed Pfam Description: Dormancy/auxin associated protein
MGLLDKLWDDTVAGPRPDTGLGRLRKQPVRPAAVKINGERGGRRRRSKRENTRKIQPLVAVVPFDLTDRLVPVGRTDPAGDAAAFVPPSPASGSEETPVKVTRSIMIKRPAGYPSSPRSAASTPPASPLGTTPPISPFAGAGECPETPGPPPPSLRVNIS

SEQ ID NO: 28818 - DNA, 659 bp, Panicum virgatum
  misc_feature: Ceres CLONE 1887186
  misc_feature: Encodes the peptide sequence at SEQ ID NO. 28819
actttggcacgcacacaccgacgcacatccactcggcacagacagttgctcctttcctcgccgccgcactttggagccccacctcgtccttccttgatctcacgcgcgcgtgcgcccatggggaggataaagagtgggcgacgcacgacggcggcggcgccgccgctgctactgctactgctcctcgtcggcgcgtcgctgcaagggcggtgcattgcgcagggcggcggagcagggctcacgcgggggagcttccccaaggggttcgtcttcggcaccgccgccgccgcctaccagtacgagggagccgtggaggtggatggcagaggacagactatctgggacaagttcgcgcacacgttcggcaagatttccgactttagcaacgccgatgttgctgttgatcagtaccaccgttttcaggaggatgtgcagctcatggcagacatgggaatggatgcttaccggttttcgattgcctggtcgaggattttgccaaatggtaccggccaagtcaatcaggctggcatcgatcactacaacaaagtgattgatacactagtatcaaaaggaattcagccatatgtaaccctctaccactgggacctccctcaggccctggaagacaggtacaatggatggctggacaggcagatagt

SEQ ID NO: 28819 - protein, 180 aa, Panicum virgatum
  misc_feature: Ceres CLONE 1887186
  misc_feature (42)..(180): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50586
  misc_feature: Useful for making plants with altered carbohydrate content
  misc_feature: Functional homolog of the protein sequence given in SEQ ID NO 50294
  misc_feature: Useful for making plants with altered cell wall content and/or composition
  misc_feature: Functional homolog of the protein sequence given in SEQ ID NO 50615
  misc_feature: Useful for making plants with modulated biomass
MGRIKSGRRTTAAAPPLLLLLLLVGASLQGRCIAQGGGAGLTRGSFPKGFVFGTAAAAYQYEGAVEVDGRGQTIWDKFAHTFGKISDFSNADVAVDQYHRFQEDVQLMADMGMDAYRFSIAWSRILPNGTGQVNQAGIDHYNKVIDTLVSKGIQPYVTLYHWDLPQALEDRYNGWLDRQI

SEQ ID NO: 28820 - DNA, 2593 bp, Panicum virgatum
  misc_feature: Ceres CLONE 1887198
  misc_feature: Encodes the peptide sequence at SEQ ID NO. 28821
gccttctccgcctggtcgtccccgtcccccgtccccacccccgccgcgccgagcgagcccaaccggaagctcgggctctcggccgcccccaccctgccgcggctatggcggtgcgcgcgacggtctcccgcttcccggccacgctggaggcgctggagtcgtgtgccgtccagtggggcgtcgccgtgacgcccttcgccgccgccgacgagcgcggccagcccccgaccaccggctccggcggcgaccgcgtcccgcgctgcgagcactgctgggcctacttcagcagccactgcgatctggagcggtggggctggtcctgcgcgctctgcggcacgctcaacggattcgacgacgacaccgcgcgccggttccagcaccccgacgcgtgccccgagctcaactcctctttcgtcgacctcgagatcccagtggatgaggcggagggtggaggagacggcgtgcaggcgcggcctgtttatgtggccgcagtggatctcgcatgttctgaagagttcctggaactcatcaagagtgcgcttctggctgccctagaagctcttattccgggctccctatttgggcttatgactttcagccacaagattgggctgtatgatgtccaaggtccgattccagtcgtgaaaaatgcttttattccaccggacatagaggaagatggtcttcctgttgcccttgaagatgccatgcccctacttgcttttttagccccagttgacacatgcaaggatcgaatcactgctgccctggagacactgcgacctacatcttcatgggagcgaggtgctgcgtcggggcaggaggaggatactgttttgcttggtggacaggaggaggatactgttttgcttggtggacgaggctttggaacagccatgtctgctttaattgactatctaagttcagaatatggttctacttttgctttggctcgggtgtttgcttttctgtctggtgcacctgattatggagctggtctgctagacaccaggagatttggggagcagtatgctagtaagggggtagatgctgaccttgcattgctccctgaacagatacctttctacagagacctagcagctgttgctgttcaagcaggagtatgcatagacatatttgctgtaactgatgagtacactgatttggcttcactgaagtttttgagtattgaaagtggtggatcattatttctctatgcaaatactgatgattcaacacttccccaagacatataccgcctgctaagccgaccatatgcatttggctgcgttctaagactgagaacatcttcagatttcgaaccaggcaattcttatgggcatttcttccctgaccctcaatatgaaaatgtgcaacacatcatctgctgtgattcatttgccacttatgcatatgactttgactttgttcataacgacggtttctccaggcacaccgaccctgctgttatacagatcgcctttcagtacagtgtgattgaacctgttgaggaaacatcaggcaatgaatcacaattatctgcaagctacaagttttgtttaaagaggcggttgagattaagaacattgcagtaccgccctgctaggaatatcagtgaaatttatgacagtgtagatccagaggttgtgctgcatatccttgttcataaggttattttagagtccttggataaaggggttagagaaggaagacaacaagtgcatgcttggctagccctcctcgcagcccggtataatgaggcccttagctctgatgctcgagctccaccatcgagcatcgatgttgacttctcacagtgcccacagttgcaaatgttaccacaactcgtgtttgcattactgagaagtcctcttcttcgcttgcacgaagaaggcgtacacccagattacaggatatatttacaatgccttttcagtgcactggagccatcttctctagctaaagctatatatccagttttgatatcatattcctcacctgacaagcaagcattcccacggcacactttgagccgtgctgctctaataatgagcgagagcccaatattcctcctggatgcttttaccaaccttattgtttactattcaccaactgctgatccttcaatcgcttttcctccaccccgagattgtctgttgagaacaacgattaatagattgaagcaggacaggtgtattacaccaaagcttacattcatccatggagggaaagatgattcaacattgtttgagagctaccttatcgaagagcaagatgttgatggttcaggctttacaactggttcagggtttgtagccttccgcgagagtgtcaggaatgttgcagcagagatcatccaggaagaaattggaagctagttttagctacccttctggttccactgcagattggatcgacagggatgcttctaaccttaatgttatagtaactaactgtatgttacataaccaaaagagttgctttaggcacgattagtcagggaaaacttatcggtaccagtgttttttgttcactaaaatttatcatcggcagatctttgttgatgcaaaaagaagcacaagagttatactac

SEQ ID NO: 28821 - protein, 757 aa, Panicum virgatum
  misc_feature: Ceres CLONE 1887198
  misc_feature (121)..(387): Pfam Name: Sec23_trunk Pfam Description: Sec23/Sec24 trunk domain
  misc_feature (512)..(622): Pfam Name: Sec23_helical Pfam Description: Sec23/Sec24 helical domain
  misc_feature (49)..(86): Pfam Name: zf-Sec23_Sec24 Pfam Description: Sec23/Sec24 zinc finger
MAVRATVSRFPATLEALESCAVQWGVAVTPFAAADERGQPPTTGSGGDRVPRCEHCWAYFSSHCDLERWGWSCALCGTLNGFDDDTARRFQHPDACPELNSSFVDLEIPVDEAEGGGDGVQARPVYVAAVDLACSEEFLELIKSALLAALEALIPGSLFGLMTFSHKIGLYDVQGPIPVVKNAFIPPDIEEDGLPVALEDAMPLLAFLAPVDTCKDRITAALETLRPTSSWERGAASGQEEDTVLLGGQEEDTVLLGGRGFGTAMSALIDYLSSEYGSTFALARVFAFLSGAPDYGAGLLDTRRFGEQYASKGVDADLALLPEQIPFYRDLAAVAVQAGVCIDIFAVTDEYTDLASLKFLSIESGGSLFLYANTDDSTLPQDIYRLLSRPYAFGCVLRLRTSSDFEPGNSYGHFFPDPQYENVQHIICCDSFATYAYDFDFVHNDGFSRHTDPAVIQIAFQYSVIEPVEETSGNESQLSASYKFCLKRRLRLRTLQYRPARNISEIYDSVDPEVVLHILVHKVILESLDKGVREGRQQVHAWLALLAARYNEALSSDARAPPSSIDVDFSQCPQLQMLPQLVFALLRSPLLRLHEEGVHPDYRIYLQCLFSALEPSSLAKAIYPVLISYSSPDKQAFPRHTLSRAALIMSESPIFLLDAFTNLIVYYSPTADPSIAFPPPRDCLLRTTINRLKQDRCITPKLTFIHGGKDDSTLFESYLIEEQDVDGSGFTTGSGFVAFRESVRNVAAEIIQEEIGS

SEQ ID NO: 28822 - DNA, 614 bp, Panicum virgatum
  misc_feature: Ceres CLONE 1887199-R
  misc_feature: Encodes the peptide sequence at SEQ ID NO. 28823
aatttcatttcaacaggagaggccggggtttggcctgagagaatgcaagatcctaacggcgacgatttctctgccccaaagttgcacaagaagaaggttgtataccggccgcttccatcaggcatgctgaagggtgaacctgaactgctgcgtagagaggttccgcattcatcaggcatggtccataagctgcccaaaagaagcttgaagagtgagcgcccagccacacctccatctgacagagggactcctgattccctgccggactctggtcctaccgatgaatatcgtgcgctgcggaggaaatacatgatgctggaggaagagaactttgccctggaccaagaactgaacatggaagatgaggaaatcaaggcacttgaggaggaaaagcttgcccttcttgatgagctcgttgtcttggaaggccttgttgagccatcgcagctgcagtctcaccgtaggccatgagtgtagtattttggtttctgactttctgtgattgctgtcgtttagtgcaaatcagtaaccggtacctgttaatacgttctggatgtaaacattgtggttgaaatagcataaacctgttatgaattgaaaaccccttagattag

SEQ ID NO: 28823 - protein, 142 aa, Panicum virgatum
  misc_feature: Ceres CLONE 1887199-R
  misc_feature: Functional homolog of the protein sequence given in SEQ ID NO 51029
  misc_feature: Useful for making plants with modulated nitrogen use efficiency
MQDPNGDDFSAPKLHKKKVVYRPLPSGMLKGEPELLRREVPHSSGMVHKLPKRSLKSERPATPPSDRGTPDSLPDSGPTDEYRALRRKYMMLEEENFALDQELNMEDEEIKALEEEKLALLDELVVLEGLVEPSQLQSHRRP

SEQ ID NO: 28824 - DNA, 1337 bp, Panicum virgatum
  misc_feature: Ceres CLONE 1887199
gaagacatttgtgaagctgcgatgggggctagggtttcctagtgccgcttccctccatcgccgccttcgctcagcgctccgctccacccggacggtagatcgagtcttctccaagtcaaatcacatttggatctctaggcgtgcgcgaggagacaaggagcgagcagatcagcaccgcacctgctcctgggcagcggcgagcagattggcaccctcctccccatcggcgacctccctctccgtcgggcatcagcgaataggggccgttcccgtccgcagcttcactccccaccggggattcgacaccgtctgcgcctccttcccgttctggtgtgagcgtcactgaaacagcaagatcggtgccccgacgtcccatcgacgacctccctcaaccgcacggtctcagcttcgtttccacataatgtttttttctgcatccttttttctgcatgtgaacgattcttccatgtccaataatgtttgagagatagtaatagagttgtagcagtagcaggtacttgctctccaatgtatggtacagatattagtagaggtgcaaattgttcatatgtgctagttaggttttttttaaatctagttcagatgttcagatagtagtagaggttcagatgtgccagcttataacgctagtatatagttcatttgtgatggctagtagtcatctctcttttttcagcttggtgaattctgtgctgatcattgttttttttggacaaatgcataacttgtgtgttatatctgaaaacttgtgtgttatctctgaaaccttgtgtgttattctgaatcatttcaggtacctgaatatatacttgtacattttttaagctaagtacaaggttccgtaggatcaacaaacttatcttgttatgtaatttaagatacatagaagcttgccataatttaagatgacaatttaatacttttaggctgtgcagaatttatgtatggtctcctcctacgtatacttacagcatttcttttgcgctttgcagacatgatgcaaagcggacctttaggctttgatactgtaggtgtacttctctgtgacagtgaactagtgattattttcaatacttgatataaagagtcatagagccataatgtgatacttggtgcctttttctccttggcatgtttatagaacgcctagtttgtgcatctgacaatatcttataactgctgatgatagaaacaggatgcaggattatctgccacatatcaagtaattgtgcagttgtgtttgctgattgattatgttgggtctgcagcactggggctaggcattcgcagaatcagtctatccggacctattttat

SEQ ID NO: 28825 - DNA, 718 bp, Panicum virgatum
  misc_feature: Ceres CLONE 1887203
  misc_feature: Encodes the peptide sequence at SEQ ID NO. 28826
ctcttcccccgaaataaaattcgggggcccaaaaaattcgcaattttgggggcgctcgtggccgccgctccgcccgaattcgtgcgcctcccggagccgatcccgcgcgggccatggaaatgaagattcaatgaggagctgtgcatacttaactcttgtccagttgttgctcttggggttcgttgctcccactcaaattagtctgtttgacaatcgaatccaaaggtgcagatgagtgaggagtgcaatatggatgaggccctgaaagccaaaggtgttgctgagaacaagttccgtgaccatgacatcaggggtgctcggaagtacgcaatcaaggctcagactctctgcccgtcgctcgaaggcatatctcagatggtgtccacactagaagttcatcttgcagctgagtccaagattgatggagagtgtgactggtaccggatattgtctctaggtgcctttgcagatgaagaggaagtgaagaagcagtataggaagctagctctgttgctgcaccccgacaagaacaagtcaattggtgctgaggaggccttcaaactgatctctgaggcatggggtgtgttgtctgataatggcaggaagatgctttacgatgagaagcggagaaatcattctgttgtcagcgcaaccattgccatctgtacttatgataagaaggcaaacaaaagaactcgaaagaatgccgctgctgcac

SEQ ID NO: 28826 - protein, 162 aa, Panicum virgatum
  misc_feature: Ceres CLONE 1887203
  misc_feature (68)..(129): Pfam Name: DnaJ Pfam Description: DnaJ domain
  misc_feature: SWISSPROT Homolog: EC 2.7.11.1 Non-specific serine/threonine protein kinase
MSEECNMDEALKAKGVAENKFRDHDIRGARKYAIKAQTLCPSLEGISQMVSTLEVHLAAESKIDGECDWYRILSLGAFADEEEVKKQYRKLALLLHPDKNKSIGAEEAFKLISEAWGVLSDNGRKMLYDEKRRNHSVVSATIAICTYDKKANKRTRKNAAAA

SEQ ID NO: 28827 - DNA, 2775 bp, Panicum virgatum
  misc_feature: Ceres CLONE 1887209
  misc_feature: Encodes the peptide sequence at SEQ ID NO. 28828
ctctcgcgccccgcccccaaatcaacaatcaccgcggccccaaatccatcgaaaaccccaggatttaaccctggaaatcagcccaaaattagaggaaatatatatatctgcttgcagccatccaatccgcctctctcgcgcgaaccctaggaatctaggataatgggggaggcggcggcggcggcggaggagctgctacatcggaggatagagttccacgccgccaccaagccccgtccgccgacgaaggcggctgtggccgtgccgggagggtttcggatggagaagagtctcttcgcgggcgctaataaccgcgtgggggcggcgcggggcgggccggagggcaggatgttcgagaatggggagagcagcgggggcgggcgcgagctaagcgccgcgagattctacctgcggagaatcggtgctggcttgcacaatctcggcaatacatgctacctcaactcagttctgcaatgcttgacgtataccgagccattcgttgcctacctgcagagcagcaagcacagatcctcatgtcggactgctggattctgtgcattatgtgctctccaagaccatgttaggtttgctctacggtcaactgggaaaattctgacaccagtgcagtttgtcaagaacttaagatgcatttctcgtagttttcgtaactctaggcaggaagatgctcatgaactaatggttagcttgcttgagtcaatgcacaaatgttgtttaccatctggtataccaagtgagtctccaagcgcttatgagaaaagtctagttcacagaatatttggtggccgcttaagaagtcaggtgagatgcacaaggtgctcacactgttcaaacaaatttgatcctttcctggatctcagtcttgaaataggcaatgctgccacattgatgaaagcactttataattttactgaggaggagctattagatggtggggaaaagcactacagctgccagaagtgcaagcagaaagttgcggcaaagaaaaggtttcttattgataaggctccttctgtgttgacaattcatctgaaacgctttagtcctttcaaccctcttcaaaagatcaacaaaaaggtggattttcaaacaactttaaacttgaagccatttgtcagcaattcagaaggtacagatttgaaatatagcctctatggtgttttggttcatgctggttggaatacacagtcaggtcactattattgcttcgttcggacatccagtggtctgtggcacaatcttgatgataaccaggttcgccaagtccgtgaggcagatgtactaaggcagaaagcatacatgttattttatgtgcgtgacgaagtaaggagctctgtaattcataaaggtagtggtgccaccagtttctcagaaaaggaaatgatatccaaaaagattgcatgtatgaatggtgcaattcgaagtggtttaatggaaaaaactttgtattttcccccaatttccaaagaagatatgaagttgcagaagcatggcctggataatggtcagcctagtgatattactgccacttcacaaggccagtgttcaaatgagcatagcaccactgaagttatcaatgcttcaacatccaaaaacattgaaccagaagagaaagccccacatgcactcccagaaggtgttgataccttgtccaccagagcagagcaaatagcactgggtgttcagagggcgataatgtcccgaggacaacctgatgtttgtattcttgagatgaagtcacagaagctgaacccagataatggtcagtccaacaatattagcgccagttcgcaggaacagtgttcaaatgaacatggaaacactgaatttactaaagattcaacatcccaaaacaatgagcaagtacagaaagcctcatgctcacatgttgcgggtactgctacattctccaccaaaacagagcaaactgcactaattaatcaaagagatacaatgtctacagcacagcctgatgtttgtattgtctgtgatgcgaactctgatcagaaggtatatgagaagccattacaggaattgcaactagaacctgatggtgcactaactgattcaggcaaagacttccctgcttctgcacagcctgatgcttgtagtctctgtgatgcaagctctgatcagaaggcatatgagaagccattgcaggatttgcaactagaacctgatggtgcactcactgattcaggcatagacatccctgcttctgtatttcaatcatgcaatggtgctgatgggttattgagggcaaacgaacaggctaatgaacctcgaacatatgcattttggaaaccagctcctaatactgatgcaacaattattgcagtcgtcctgactgaggatactgctgtttctagtgatgcaataacgggcaatgaagattcaaccaatggtaatgaagctaaagggacagagcctgttaagcaatatgatggactaattgtggtgaaggagctttctgcagaaacaattgatgataaagtaaaagcagaggagcagactactgtgcagaacaatacactgggggatgcgcagtctatggttaaggaagtctctcttatggaaactggccatatggcagacgcagagtaccagtataactcgctgaacactggaggtgccaactgtgagaaaaaaatctcttctgaaacctctgcgcatgtggctagctccgaagattatgtgatgtgctctgaaaactttgtgcaagtggtagataagggtccatgccatggcagtcagcat

SEQ ID NO: 28828 - protein, 870 aa, Panicum virgatum
  misc_feature: Ceres CLONE 1887209
  misc_feature (85)..(389): Pfam Name: UCH Pfam Description: Ubiquitin carboxyl-terminal hydrolase
  misc_feature: SWISSPROT Homolog: EC 3.1.2.15 Ubiquitin thiolesterase
MGEAAAAAEELLHRRIEFHAATKPRPPTKAAVAVPGGFRMEKSLFAGANNRVGAARGGPEGRMFENGESSGGGRELSAARFYLRRIGAGLHNLGNTCYLNSVLQCLTYTEPFVAYLQSSKHRSSCRTAGFCALCALQDHVRFALRSTGKILTPVQFVKNLRCISRSFRNSRQEDAHELMVSLLESMHKCCLPSGIPSESPSAYEKSLVHRIFGGRLRSQVRCTRCSHCSNKFDPFLDLSLEIGNAATLMKALYNFTEEELLDGGEKHYSCQKCKQKVAAKKRFLIDKAPSVLTIHLKRFSPFNPLQKINKKVDFQTTLNLKPFVSNSEGTDLKYSLYGVLVHAGWNTQSGHYYCFVRTSSGLWHNLDDNQVRQVREADVLRQKAYMLFYVRDEVRSSVIHKGSGATSFSEKEMISKKIACMNGAIRSGLMEKTLYFPPISKEDMKLQKHGLDNGQPSDITATSQGQCSNEHSTTEVINASTSKNIEPEEKAPHALPEGVDTLSTRAEQIALGVQRAIMSRGQPDVCILEMKSQKLNPDNGQSNNISASSQEQCSNEHGNTEFTKDSTSQNNEQVQKASCSHVAGTATFSTKTEQTALINQRDTMSTAQPDVCIVCDANSDQKVYEKPLQELQLEPDGALTDSGKDFPASAQPDACSLCDASSDQKAYEKPLQDLQLEPDGALTDSGIDIPASVFQSCNGADGLLRANEQANEPRTYAFWKPAPNTDATIIAVVLTEDTAVSSDAITGNEDSTNGNEAKGTEPVKQYDGLIVVKELSAETIDDKVKAEEQTTVQNNTLGDAQSMVKEVSLMETGHMADAEYQYNSLNTGGANCEKKISSETSAHVASSEDYVMCSENFVQVVDKGPCHGSQ

SEQ ID NO: 28829 - DNA, 760 bp, Panicum virgatum
  misc_feature: Ceres CLONE 1887209-R
  misc_feature: Encodes the peptide sequence at SEQ ID NO. 28830
tgaaagtattgccaatgatcagcagacatcaacatcggaaattgttctaactagtggcatatcatgtaaatcccatagacgaaagtgctcttgtaacactgcaggttctgaagatgctatccacatgtataacaagaaacaaaatcttggaaactcctgtgctgccgaacttaccatggacaagaagggcagcaaggatgcaactcttgctgttgctgagctaggaagctcattcccgagctctgtgtcaaatcctgattcaggaaaatgtggggatacagataagaaaggctcctggcatttcgatctcctcacaaggggtttgagagttccacgatgggatgatgacgacatgccaaataccaaggcagaagaactgcaatgttcgagtgccaccagcattggctatgttttagatgaatgggacgaggagtatgaccgcgggaggacgaagaaggtgaggaaatccaagcaagacttcagtggaccgaaccctttccaagagatggaaaacatcagatcacggcagcggaggagattgcgaactgaccaggccaggtctgggcacgagcctctaaggatatgacacgttgtagaagcatttcgctgttgtgtccatcagttttgaaacggattttcttctttgtatgtttttcaagatttctgatgtgttatatagagtttggaccgatcaatttgccttgtatttatttccaatcgatcagtggaaaaatgaaatgacaactctttgttctgttcc

SEQ ID NO: 28830 - protein, 194 aa, Panicum virgatum
  misc_feature: Ceres CLONE 1887209-R
  misc_feature: SWISSPROT Homolog: EC 3.1.2.15 Ubiquitin thiolesterase
ESIANDQQTSTSEIVLTSGISCKSHRRKCSCNTAGSEDAIHMYNKKQNLGNSCAAELTMDKKGSKDATLAVAELGSSFPSSVSNPDSGKCGDTDKKGSWHFDLLTRGLRVPRWDDDDMPNTKAEELQCSSATSIGYVLDEWDEEYDRGRTKKVRKSKQDFSGPNPFQEMENIRSRQRRRLRTDQARSGHEPLRI

SEQ ID NO: 28831 - DNA, 1090 bp, Panicum virgatum
  misc_feature: Ceres CLONE 1887212
  misc_feature: Encodes the peptide sequence at SEQ ID NO. 28832
gcctcgcctcctatttccactcgctcgcctcacgcttcccacactggtacggcaatctagtctctagtcgccgcctcgccacgatcttccgcgcgcgcgcgcgagagagggagagagttgggagaggatgagttctgggcgcgggtccgcggcgccggagcgggacatcgacgacctgccgcggaacgacgccaactacacggcgctcacgccgctctggttcctggagcgcgccgcgctggcgcagccgggcagggcctccgtcgtgcacggctccgtgcgctacacctgggccgagacctaccgccggtgccgccgcctcgcgtccgccctcgcgcgccgatccgtcggtcctggaagcacggttgctgtaatagccccaaacatcccagcagtttatgaagctcattttggtgttccgatgtccggagctgttgtgaactgcgtcaatatcaggttaaatgccgagacaatcgcattccttcttgaccattctgtggcagaagttgtgatggtggaccaagaattcttcactctagctgaagaatccctgaagatactctccgagaagaagaaatctgctttccggcctccgatcctggtcgttatcggtgacccaacctgtgatccaaagtctctgcactatgctctaggaaagggagctatggagtatgaagagttcctgaaaactggtgacccagagttcaactggaagccaccaagggatgagtggcagagcatcgccctaggctacacttccgggactacttccagcccgaaaggcgtcgtgctgcatcaccgcggcgcctatctcatggcgctcagtgttgctatggtgtggggaatgcctgaaggtgctgtctacctgtggactctgcccatgttccactgcaatggttggtgctatacttgggcgttggcagcgttctgtggaacaagcatatgccttcgccaggtgagcacaaaagcgatataccatggcatcgcgaagcaaggagtgacgcacttatgcgctgcgccggtggtcctcaacaacctcatcaacgcccccgcgagcgagaccctcctgccgctcccgcgcgtcgtgaac

SEQ ID NO: 28832 - protein, 320 aa, Panicum virgatum
  misc_feature: Ceres CLONE 1887212
  misc_feature (54)..(320): Pfam Name: AMP-binding Pfam Description: AMP-binding enzyme
  misc_feature: SWISSPROT Homolog: EC 6.2.1.26 o-succinylbenzoate--CoA ligase
MSSGRGSAAPERDIDDLPRNDANYTALTPLWFLERAALAQPGRASVVHGSVRYTWAETYRRCRRLASALARRSVGPGSTVAVIAPNIPAVYEAHFGVPMSGAVVNCVNIRLNAETIAFLLDHSVAEVVMVDQEFFTLAEESLKILSEKKKSAFRPPILVVIGDPTCDPKSLHYALGKGAMEYEEFLKTGDPEFNWKPPRDEWQSIALGYTSGTTSSPKGVVLHHRGAYLMALSVAMVWGMPEGAVYLWTLPMFHCNGWCYTWALAAFCGTSICLRQVSTKAIYHGIAKQGVTHLCAAPVVLNNLINAPASETLLPLPRVV

SEQ ID NO: 28833 - DNA, 584 bp, Panicum virgatum
  misc_feature: Ceres CLONE 1887212-R
  misc_feature: Encodes the peptide sequence at SEQ ID NO. 28834
tgagggaccggatgaaggacgtgatcatctccggcggggagaacatcagcagcctggaggtggagaaggtggtgtgcgcgcacccggcggtgctggaggcgtcggtggtcgccagggccgacgagcggtggggggagtcgccgtgcgcgttcgtgacgctcaaggacggggccgccgccgacggcggctcggaggacaccgcgagcgacatcatgcgcttctgccgggagaggatgccggggtactgggtgcccaagtcggtcatcttcgggccgctgcccaagacggccacggggaagatcaagaagcacgagctgagggccagggccagggagctggggcctgtcaagaacagcaggatgtgaaccctgcctggtgcagagacatttgtacaggggcaaaagaagaaacggacggtgtcatcaatccagaaatttcacagataaagtgaagtagccgtcaaaatcttggaatttccaaataagcataagaagtttgggtgttctttattcagttgtatatatccttcagagattcagataagacctgtattttacagtctggagcgaaagtggttgctgcgc

SEQ ID NO: 28834 - protein, 120 aa, Panicum virgatum
  misc_feature: Ceres CLONE 1887212-R
  misc_feature: SWISSPROT Homolog: EC 6.2.1.26 o-succinylbenzoate--CoA ligase
RDRMKDVIISGGENISSLEVEKVVCAHPAVLEASVVARADERWGESPCAFVTLKDGAAADGGSEDTASDIMRFCRERMPGYWVPKSVIFGPLPKTATGKIKKHELRARARELGPVKNSRM

SEQ ID NO: 28835 - DNA, 682 bp, Panicum virgatum
  misc_feature: Ceres CLONE 1887230
  misc_feature: Encodes the peptide sequence at SEQ ID NO. 28836
cgcacgcctttcacacttgatgggttgctgccgctcctcgctccggccgggggcgggggcggggaagccgccccggcaccgcccgccgccgccaccgacgacgaaccgcccgtccacgaacgcgcaccggaccgcgccctcggcccgcgcgagcggcggcggcggcggcagggatgtcccggcgttcgcggagttctccctggcggacctccgcgcggccacgggcgggttcgcggccgagaacatcgtctccgagagcggcgagaaggcgcccaacctcgtctacaggggccagctcgagggcagcggcggcgcgccgccgcgcgcgattgccgtgaagaagttcgccaagctcgcgtggcccgaccccaagcagttcgcggaggaggccaagggggtggggggcctgcgccaccggaggatggcgaacctgatcggctactgctgcgacggcgacgagcgcctgctcgtcgccgagttcatgcccaacgacaccctcgccaagcacctgtttcactgggaaaaccagactatagaatgggctatgcgtctgagagttgcatactacatctcccaagcattggaatattgtagtatcaagggaaggcctttatatcatgacttaaatgcatacagggtcctctttgatgagaatggtgaccctcgtctgtcatgctttggt

SEQ ID NO: 28836 - protein, 220 aa, Panicum virgatum
  misc_feature: Ceres CLONE 1887230
  misc_feature: SWISSPROT Homolog: EC 2.7.11.1 Non-specific serine/threonine protein kinase
MGCCRSSLRPGAGAGKPPRHRPPPPPTTNRPSTNAHRTAPSARASGGGGGRDVPAFAEFSLADLRAATGGFAAENIVSESGEKAPNLVYRGQLEGSGGAPPRAIAVKKFAKLAWPDPKQFAEEAKGVGGLRHRRMANLIGYCCDGDERLLVAEFMPNDTLAKHLFHWENQTIEWAMRLRVAYYISQALEYCSIKGRPLYHDLNAYRVLFDENGDPRLSCF

SEQ ID NO: 28837 - DNA, 1574 bp, Panicum virgatum
  misc_feature: Ceres CLONE 1887244
  misc_feature: Encodes the peptide sequence at SEQ ID NO. 28838
cctcctcctcgcccccgcccactctttctctcttcttttgcgcgcgcggcctgtcattccccgggggatcagccttggcgttgcctcatatgggggcgagctgagagcaaagcgagggccggcaccggacaaggagagcctttcgatctccctctctctcctctctctcactctactctcgtcacgcactccccttcgcctctggagatagaggcagagggaggtggtgagagatcgagagggggcggccggggggtggagagggcgagatcaaccgtcgccgtcgcctcgtcggcgacggccatgacatggtgcaacagcctcaacgacgtgcgcgccgtggagaacaacctggccaccgccgcggccgtcgccgctgccaagaagcagcagcaggcgtcctcccacgtcaacctcatcaggacctgcccctcctgcggccaccgcgcgcagtatgagcagttgcaggcggcggcgacgatccaggacctgccggggctgccggccggcgtgaagttcgatccgacggaccaggagctgctggagcacctggaggggaaggcgaggccggacgcccgcaagctccacccgctcatcgacgagttcatccccaccatcgagggcgagaacggcatctgctacacccacccggagaggcttccgggtgtcggcaaggacggcctcatccgacacttcttccaccgcccgtcaaaagcatacacgaccggcacgcggaagcggcggaaggtgcacaccgacgagcagggcggcgagacgcggtggcacaagacgggcaagacccggccggtgttcaccaacggcaagctcaagggctacaagaaaatcctggtgctctacaccaactacgggaagcagcgcaagccggagaagaccaactgggtgatgcaccagtaccacctgggctccgacgaggaggagaaggacggcgagctcgtcgtgtccaaggtgttctaccagacgcagccgaggcagtgcggcagcgggtcggcgacggccaaggacgtcgtccccctcgcggctagcgcggccaccacgatggatcaccaccaccaccaccaccatgacggcggcagtggcggtagcaacagcatgctgaaggaggcagctggcattgtagatttctacagcccggcggcgctaatcggctacaaccaggcggctcctaacaacagggcggctttttctgctcacctgatgcctaactttgaggtgcacacggcaggggcggctggctttggtccctgatgaccaagatgtgcaagtgtgcaacaattcgactgatataggttattagaggggagagaaattaaaggcaggaagataaggcaccctcatgagttacaagaagggatccaagacttaactgaaccgtaacgctggacaataagaggggtgttcagtgggtagctggacgtacagatgctgatatcagaggagtagggatcgatactatacattgttcattaattgttacaagtatacgtaacttgacgttatcattttttgttcaatgatatgttgtttcataataagaataatgctggagtgagttc

SEQ ID NO: 28838 - protein, 320 aa, Panicum virgatum
  misc_feature: Ceres CLONE 1887244
  misc_feature (66)..(207): Pfam Name: NAM Pfam Description: No apical meristem (NAM) protein
  misc_feature: Functional homolog of the protein sequence given in SEQ ID NO 50710
  misc_feature: Useful for making plants with altered carbohydrate content
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
MTWCNSLNDVRAVENNLATAAAVAAAKKQQQASSHVNLIRTCPSCGHRAQYEQLQAAATIQDLPGLPAGVKFDPTDQELLEHLEGKARPDARKLHPLIDEFIPTIEGENGICYTHPERLPGVGKDGLIRHFFHRPSKAYTTGTRKRRKVHTDEQGGETRWHKTGKTRPVFTNGKLKGYKKILVLYTNYGKQRKPEKTNWVMHQYHLGSDEEEKDGELVVSKVFYQTQPRQCGSGSATAKDVVPLAASAATTMDHHHHHHHDGGSGGSNSMLKEAAGIVDFYSPAALIGYNQAAPNNRAAFSAHLMPNFEVHTAGAAGFGP

SEQ ID NO: 28839 - DNA, 1492 bp, Panicum virgatum
  misc_feature: Ceres CLONE 1887247
  misc_feature: Encodes the peptide sequence at SEQ ID NO. 28840
aaaaaacgcgcgcaagataacaagcaacacagcggactagtagtacagtacgtaccagcaggcaggcagggtcccaatcccgccggtcgctccactgctccagcctgcccccatcctcctcctccctccctctcgtccccaagccgctcgctcgctcgatcgatcccctttctgccgagctagctagccgcgcgcggaggggggacatggcgagcgctggaggcggcgcggcgggggaaggggagtggctcaaggtcgccgagctcagggccgccgtccaggcgcaggacccccgcgccaaggaggtggacaacctgacgctgcggaggttcctgcgcgcgcgcgaccacaacgtggacaaggccgccgccatggtcctcaagtacctcaagtggcggagggaggtggcgcccgacggcttcgtgccggaggagcgggtgcggagggagctcgcgcaggacaaggcctgcatgggcggcgtcgacaggagcggccgccccatcctcgtcggcttcatggccaggcacttctccgccgaccgcgacctggcggagttccagtgtactacgcgttgcccactgctgcagagttcaatcaagaaaacgcaaaaccatgatgagtattgacagttgaatcatgcatgcttgcattcttctcttctcttctcttctcctgtgcaggttttgttgcctacttcttcgacaagatctgtgccaggtatgtactaactgcttgtgctcagttgattttctgcaaaaacgcagtttatctttgtccagcaacagcaatggagttctccagtgctagcttcttgttgttggctgttgctatgcgtccttgcacaagattgagggaccgaaaaggcgactagagggggtgaatgggagccgattaaaaattcttgcaaatagaaactttggctttgtcccaacgtgcacgcccaaccctagagtcctaggcacagcgtggagtagctatagagaagccacaccaacacaagaaagccctaagaacaaacggaaaccaacgcggaagcaaacatcgaaaatcagcgcaagaatcaacgcacggtatacacaccggttgaaccgacgtgcactaggggcaccttgtcggttcaaccgatgtgcagagcctgcagcagacaaaagctaacaccggttgaaccgatgcagaggctttaagaagtgtcggttcaaccgacgttgaacaccggatgatccgataaattcaaatttaaacgccggtgcagttttccagagagagctcaagctggactaaagagcaccggttgatccgacgaattcaactccaaagcgccggtgcaattgtccagaggagcagcaaaacgaatccaacggtgcaccggttaaaccgacgtcaacgaagttcaatactccggttgaacgggcacaacagcagtagaaaaacaacacaccagttgaaccgatgcctgtgaacagctaaagcaccggtgcaactgacgaacagc

SEQ ID NO: 28840 - protein, 139 aa, Panicum virgatum
  misc_feature: Ceres CLONE 1887247
  misc_feature (7)..(72): Pfam Name: CRAL_TRIO_N Pfam Description: CRAL/TRIO, N-terminus
MASAGGGAAGEGEWLKVAELRAAVQAQDPRAKEVDNLTLRRFLRARDHNVDKAAAMVLKYLKWRREVAPDGFVPEERVRRELAQDKACMGGVDRSGRPILVGFMARHFSADRDLAEFQCTTRCPLLQSSIKKTQNHDEY

SEQ ID NO: 28841 - DNA, 629 bp, Panicum virgatum
  misc_feature: Ceres CLONE 1887247-R
ggtatgcaaactgcgacgtccgggcttacatcgctgcgatagagattatgcagaactactacccggagcggctcggcaaggcgctgatgatcaatgtgccctacatcttcatgaaggtgtggaagacgatgatctacccgttcatcgacaccaacaccagggacaagttcgttttcgtggacgacaagagcctgcacgagacgctgcgccgggagatcgacgagacccagctccccgagttccttggcggcaagatgcctctgatccccctcaaggactatgcccagcagcatgaatcagtttaaccattaccatcacacgtcggtaatctccattagcggttaattaattaggtgcacaaagtaaggatgatcctttggctacaaaagggaggaagatgcaatctagctgctactagtcctgcaacaatggtgtaactgtaaaatgcagctctgtccgatcgcatgcttcagccgctccaatataattagtggtggccgaggtcggtgatcagtcagcagctgacattgtctgcgccacatgctgggctatgtgaaataaaactgtgaatgggatggcacctgcatacggcaacataataataaaggattgagaccattagtccttgc

SEQ ID NO: 28842 - DNA, 697 bp, Panicum virgatum
  misc_feature: Ceres CLONE 1887253
  misc_feature: Encodes the peptide sequence at SEQ ID NO. 28843
tccctccccctcctccctccggcctccccttcctcctcgtcctctccctctcctcccaaaccaagaaggcagtgagaaccgaagcgcgcgccgagagggaggggagcctcgccgcctctcgcggcagatctcgcgccagccccgggttctgacgcgagatccgcgctcgccgcccgccggccggtgccgccgctgcccgctcgctcgcccgcccgatctcgaagaatccaccttgaagatgatgatgggtttgctagcgtttgagagtcaccaggggctctggaatagtggatactattcccagttgtttggaattgggggagttatgatcactgttgccattcttatgctatccacgggctactttggtggaatcggtgctccatttgctccgtatttctggccatatctaggacaagttccgaagaagagggaacgcaaaaggcctgtgagagtgtacatggatggatgctttgacctcatgcactatggtcatgcaaatgcgttgcgacaggccaaactgttgggagatcagctggtagttggggttgtcagtgatgaggagatcgtcgcaaataagggcccgcctgtcctttctatggaagagaggttgactcttgttagtggcctgaagtgggtcgatgaggtcattcccaatgcaccctatgagatcacagaagagttcatgaataccctc

SEQ ID NO: 28843 - protein, 152 aa, Panicum virgatum
  misc_feature: Ceres CLONE 1887253
  misc_feature (74)..(152): Pfam Name: CTP_transf_2 Pfam Description: Cytidylyltransferase
  misc_feature: SWISSPROT Homolog: EC 2.7.7.14 Ethanolamine-phosphate cytidylyltransferase
MMMGLLAFESHQGLWNSGYYSQLFGIGGVMITVAILMLSTGYFGGIGAPFAPYFWPYLGQVPKKRERKRPVRVYMDGCFDLMHYGHANALRQAKLLGDQLVVGVVSDEEIVANKGPPVLSMEERLTLVSGLKWVDEVIPNAPYEITEEFMNT

SEQ ID NO: 28844 - DNA, 696 bp, Panicum virgatum
  misc_feature: Ceres CLONE 1887261
  misc_feature: Encodes the peptide sequence at SEQ ID NO. 28845
gacgtcaccattcgccgccctccgccgcgggtactcctcgccaagatccgttagaagttcctccctcctcgttgccgccgccgccgccgcctcatcctccggcgagggagagtgctccggcgtcgtccggcgatcgagtgggcgggaggagatgttcctggtggactggctctacggggtgctggcgtcgctggggctgtggcagaaggaggccaagatcctcttcctcggcctcgacaacgccggcaagaccacgctcctgcacatgctcaaggacgagagattggttcagcatcagcctacacaatatccaacttctgaagagctgagtatcggaaagatcaagttcaaggcatttgatttgggaggacatcagatcgctcgccgtgtgtggaaggattactatgccaaggtggatgcagtggtgtaccttgtggatgcctacgacaaggagcggtttgctgaatcaaagaaggagctcgatgccctcctctcggacgactctctggccaccgtacccttcctgatcctggggaacaagatcgacatcccttatgctgcgtcggaggaggagctccggtaccacatggggctgagtaacttcaccactggcaagggcaatgttaacctgggcgagtccaatgtccgtaccctggaggtgttcatgtgcagcatcgtcccgcagatggggtacgg

SEQ ID NO: 28845 - protein, 181 aa, Panicum virgatum
  misc_feature: Ceres CLONE 1887261
  misc_feature (6)..(181): Pfam Name: Arf Pfam Description: ADP-ribosylation factor family
  misc_feature: The sequence is a functional homolog of SEQ ID NO 11 in US patent 7259294
MFLVDWLYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGNVNLGESNVRTLEVFMCSIVPQMGY

SEQ ID NO: 28846 - DNA, 682 bp, Panicum virgatum
  misc_feature: Ceres CLONE 1887272
  misc_feature: Encodes the peptide sequence at SEQ ID NO. 28847
atcagcccaccaaccagtccgggtccagcaaaccactccgactgactcaccacaaagcctccgacgcctccccgcgccccaatccggaagaggaggcgcggccgccggcgccggcgccgatcggaccccatgctccgcgcggcgctctcccgctcagcctccgggctccgccggtccccggcgatggccgcgtccgtccctctctccaccgccgccgccccgtggctctccaacggccccgcctcgtccccgccaagggtgcgcctcctcatcggcggcaagttcgtcgagtcgcgcgccgacgagcacgtcgacgtcaccaaccccgcgacgcaggaggtggtgtcgcggatcccgctcacgaccgccgacgagttcagggccgccgtggacgccgcccggacggccttccccgggtggcggggcacgcccgtcaccacgcgccagcgcgtcatgttcaagttccaggagctcatccgggcaaacatggacaagcttgcagagaacattacgacggagcaggggaagacactaaaagatgcttggggtgatgtttttcggggtctagaggtggtggagcatgcttgtggaatggggactttgcaaatgggtgaatatgtatcaaatgtttctaatgggattgatactttcagcattagggagccacttggcgtgtgtgctg

SEQ ID NO: 28847 - protein, 184 aa, Panicum virgatum
  misc_feature: Ceres CLONE 1887272
  misc_feature: SWISSPROT Homolog: EC 1.2.1.27 Methylmalonate-semialdehyde dehydrogenase (acylating)
MLRAALSRSASGLRRSPAMAASVPLSTAAAPWLSNGPASSPPRVRLLIGGKFVESRADEHVDVTNPATQEVVSRIPLTTADEFRAAVDAARTAFPGWRGTPVTTRQRVMFKFQELIRANMDKLAENITTEQGKTLKDAWGDVFRGLEVVEHACGMGTLQMGEYVSNVSNGIDTFSIREPLGVCA

SEQ ID NO: 28848 - DNA, 2525 bp, Panicum virgatum
  misc_feature: Ceres CLONE 1887277
  misc_feature: Encodes the peptide sequence at SEQ ID NO. 28849
cacggccactgcacattgcacaaacctcggtgagcgcgaggggagagagagaggccgagagggagtcggagcccaattccccaatccccgccgcccaccgggaccggcaattcggtgtccttcccttcctccctcggtccctccctccctgcgcgcgcgcagcccggcggcgagtgtgactcctccgtccccgggttcgctcgttccagatttccgtcgggacgagccgtccacctcgcggtggtcttggatcgggccaccggcgccgcgggaaaagccgcctctttttccgcggttgggcgccgggctttttgatccggcgtcgcgccacctgtgctgcggtggttctggttcttatccggaaccggaagggcatctggggagggtggggcgggcctccagcggcacgtgacgagcggttggcgatggcgacgatgggggtgagaaagcgcagcggcgagggccgggcgccgaggcgtgcataaaggaggaggcggggatcccgtggcgtcgagagggagggggaggagatctgggctcctgagctggtgagcgggggagagaggacagaggagcagagggcgtcgaggaatggggaccgcggtggatgcggcggcgttcgggtcggtggacggggtggtggcggaggtcatgcggctgcaccgctcgctgccggcgcgcccgtcgctggaggaggtggaggccgcggaggcgctggcgcacgccgcggaccgggaggagcgggcgcgcctcgacgccgtgtcgcgcctgcgcaggcctcccgccgtgcccgacgagctcttcgccgtcgcgctcgagatgcaccgcgcgctcgccgccttccagtgccgggagcagaagcgcgacgccacgcggctgctcgagctcgacgcgctccacgcgctcttcgacgacctcatccagcgcgcgtcgcagtgcgtgccctccagctccagctccggctccacccgcgcggcgccgcgcgtcactgccgcccccgccgctgcatccacctctgccgcctcgtcgtcgtcatcggtacctgcggacagcaacgccgaccgctactcgttgacgagcactaatgggttcagtgcggcgaggaaggtgacgggcgcggggcgcgtctccatggatgacagctacgtcaagaaggccaaggccgcagtatgggacgatggtgttgtggcagcgagctcgcatacgccccgaggagctgttgcagcaaactccgtggcggctcgagtggatggcggttacggagacggggatgagaaattgtcccacattaagctagctagcatgattgaagttgctgcaaagaaaggctctcgcgaactcaacctccaaggcaaactcacgaaccagattgagtggctgcctgattccattggaaagcttactgggcttgttacccttgatatttcggagaatcggatcttggctttgccggatgcaattgggaggctttcttctttggccaaattggaccttcattccaatcgaattgctcagctccctgagtcgattggggatctctgcaatttgatgtatctcgacctgaggggtaatcagttagcatcattgccctctagtcttggcaggctggtaaagcttgaggagcttgatgtgagcgcaaaccatcttacctcactccccgaatcaataggaagccttgcacgtctgaagaagttaatcatcgagacaaacaaccttgatgagctgccatacactattggccattgtgtttcactggtagaactgcgggcgggctataatcatctcaaggccctcccagaggctgtcggaaagctagagtctctggaggtcctgtctgtgaggtacaacagtatcaggggacttccaacaacaatggcatctctcacaaagctgaaggaggttgatgcaagtttcaatgagctcgagtctattcctgagaacttctgctttgttacttctcttgttaaactgaatgtcgggaacaattttgctgacctgcgatccctgcctcgttccattggcaaccttgagatgctggaagagttggatataagcaataatcagattagggtgcttccaggttcttttggaaacttgcagcgtctccgtgttctccacgcagaagaaaaccctttacaagtgccaccaagagatgtagctttaaagggagctcaggctgctgttcaatacatgagtgaacatgttgccaagagagccacaaggtcacaaccgacaaagacaaagaagacttgggctcagttctgctttttctccaggcctaacaaaagaaagcatgaccgtattgacactgcttcatgatttatttggagattgaagacaaactgttatttcatctcttacatgtgcagaagtacaaatgggcgcatcctcttcgattgctaccattgtgaggatgggtcaacaagatgtgatgcccagagcttttccttcgacaattctgcaactttcttctgtggaaccaaaatggtcaggttttatcaaacctgctcactctcctttccaac

SEQ ID NO: 28849 - protein, 575 aa, Panicum virgatum
  misc_feature: Ceres CLONE 1887277
  misc_feature: SWISSPROT Homolog: EC 2.7.11.1 Non-specific serine/threonine protein kinase
MGTAVDAAAFGSVDGVVAEVMRLHRSLPARPSLEEVEAAEALAHAADREERARLDAVSRLRRPPAVPDELFAVALEMHRALAAFQCREQKRDATRLLELDALHALFDDLIQRASQCVPSSSSSGSTRAAPRVTAAPAAASTSAASSSSSVPADSNADRYSLTSTNGFSAARKVTGAGRVSMDDSYVKKAKAAVWDDGVVAASSHTPRGAVAANSVAARVDGGYGDGDEKLSHIKLASMIEVAAKKGSRELNLQGKLTNQIEWLPDSIGKLTGLVTLDISENRILALPDAIGRLSSLAKLDLHSNRIAQLPESIGDLCNLMYLDLRGNQLASLPSSLGRLVKLEELDVSANHLTSLPESIGSLARLKKLIIETNNLDELPYTIGHCVSLVELRAGYNHLKALPEAVGKLESLEVLSVRYNSIRGLPTTMASLTKLKEVDASFNELESIPENFCFVTSLVKLNVGNNFADLRSLPRSIGNLEMLEELDISNNQIRVLPGSFGNLQRLRVLHAEENPLQVPPRDVALKGAQAAVQYMSEHVAKRATRSQPTKTKKTWAQFCFFSRPNKRKHDRIDTAS

SEQ ID NO: 28850 - DNA, 678 bp, Panicum virgatum
  misc_feature: Ceres CLONE 1887285
  misc_feature: Encodes the peptide sequence at SEQ ID NO. 28851
agtcgagggcccgccgccatcgccctcctcctcgtgcctcaaactaacctctctctttctggtcgccagccagcgttgtccatactagcaaggcaaagcgctaggcagagcaatttcctagctagctagctagcgtcgtaccggggagagagagagagagagagagagagagagagagagagagagagatggcaggcggcggggtatggcggccgttgctcgccggcgcctggctgctgtggcttctcccgtgggcttcggccgtccgccggagcgacttcccggcgtccttcctcttcggcaccgccacttcctcgtaccagatcgaaggtgcttacctcgagggcaacaaaagtttaagcaattgggatgtgctcactcatctaccagggagaatcaaagatggaagcaccggggacatcgcggatgatcattaccatcgtttcgaggacgacgtcgagctgatgtactctctcggcacaaacgcttacaggttctctatatcatgggccagaatccttccaagagggagattcggcgaagtgaacccagaaggcatcaagttctacaacgaactcatcgactcactcctgctcaaaggaatagagccgttcgtcacgctgagccactacgacatgccgcaggagctggaggacaggtacggggcgtggctgagcg

SEQ ID NO: 28851 - protein, 163 aa, Panicum virgatum
  misc_feature: Ceres CLONE 1887285
  misc_feature (27)..(163): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50474
  misc_feature: Useful for making plants with altered carbohydrate content
  misc_feature: Functional homolog of the protein sequence given in SEQ ID NO 50475
  misc_feature: Useful for making plants with altered cell wall content and/or composition
  misc_feature: Functional homolog of the protein sequence given in SEQ ID NO 50615
  misc_feature: Useful for making plants with modulated biomass
MAGGGVWRPLLAGAWLLWLLPWASAVRRSDFPASFLFGTATSSYQIEGAYLEGNKSLSNWDVLTHLPGRIKDGSTGDIADDHYHRFEDDVELMYSLGTNAYRFSISWARILPRGRFGEVNPEGIKFYNELIDSLLLKGIEPFVTLSHYDMPQELEDRYGAWLS

SEQ ID NO: 28852 - DNA, 1080 bp, Panicum virgatum
  misc_feature: Ceres CLONE 1887286
  misc_feature: Encodes the peptide sequence at SEQ ID NO. 28853
ttctttccttggcccgcccccggcacgccctccacccgccgccgcctcctctcccccgcgccttggcggaatctccccgtcttcccctgcaagcccaagcccatggcggggccttcgccccgtggccgccgctccatgaccggcctcgcgccccccctcctcctgctcgcgtgcgtcgcggcttgctccgtcccggccgtgcgcgcccaggccgtgatgtacaccgggcccgacgccggcagcggcaggaagatcaccaacttctccttccccgggttcgagcgtgacctgctcaagctctccaacctgacgttcgcgggcaacaccagcgtcagccagaactcgctgcagctcaccccggacagcctcaacgacccgcagaagttcctcgtcaaccaggccggccacatcttctactccacgccgttcgtgctctgggcgcccaacgcgtccaacgccaccgcggacggccggcacgtcgcctccttctccacggtcttcaaggccaacctctaccgcggcgccaacacgagcgtcaagggagaagggctcgcgttcgtcgtcgcgtccggcaaggacggcggcccgccccccggcagctacggcggctacctcggcctcaccaacgcgtccaccgatggcctccccgccaacgagttcgccgccgtggagctcgactcggtgaagcagtcctacgactcggacgacaaccacgtcggcctcgacgtcaacggcgtccgctcctccgtcgccgtcccgctcgcccccttcggcatcgagctcgcgcccagagacaccaacgccaccaacgacggcagcaactatgtctggatcgactacaacggcacggcgcggtacgtttgggtgtacatgtccccgaacgccgtcaagccggccacccccgtgctcaacgcgtcgctggacctctccttgatcctccggggaaggaagggctacttcggcttctcggcgtccaccggcgaggactaccagctcaactgcatcaacatgtggaaaatgacggtggaggttctccaggacgacagcgtccccaacaagaaaatgtcgggttggaagctc

SEQ ID NO: 28853 - protein, 325 aa, Panicum virgatum
  misc_feature: Ceres CLONE 1887286
  misc_feature (50)..(307): Pfam Name: Lectin_legB Pfam Description: Legume lectin domain
MAGPSPRGRRSMTGLAPPLLLLACVAACSVPAVRAQAVMYTGPDAGSGRKITNFSFPGFERDLLKLSNLTFAGNTSVSQNSLQLTPDSLNDPQKFLVNQAGHIFYSTPFVLWAPNASNATADGRHVASFSTVFKANLYRGANTSVKGEGLAFVVASGKDGGPPPGSYGGYLGLTNASTDGLPANEFAAVELDSVKQSYDSDDNHVGLDVNGVRSSVAVPLAPFGIELAPRDTNATNDGSNYVWIDYNGTARYVWVYMSPNAVKPATPVLNASLDLSLILRGRKGYFGFSASTGEDYQLNCINMWKMTVEVLQDDSVPNKKMSGWK

SEQ ID NO: 28854 - DNA, 611 bp, Panicum virgatum
  misc_feature: Ceres CLONE 1887286-R
ggagcacatgagatttgttcagacatgtatccttagttcctcaggtaatggcaaaataacttgagaatgaggcacgctcatgctatcccaatggaacatttaaattaaagaattttcaattaagccacatgggtaggtggtttttctttggagttaactgaaagttgtttttaaaatttagatatttttttaaaagagatatgtagtatgtcggtcctgcatgaatgaacaaactaaaagaagagaagaaatagatatagcttcctgtttgtttgaatgatagccatcaacataaacaacctaaaatttattcatttccggatttatatggttactaaatcaagaacaagaattgtcagaggatcaggctttttttcatttccctaaaacctagcatgcagctagttagaggaagtggtaggcttccccccaaccaatcaaagttgctacatgtacatttactatttgaaacatcaggtgggacaaagtgttccaacaattaattatatattgagcaaatgtgattccatgctcatggtggttcagaagcttttttccaccccccccccccttttttccatttatgatgcctgcataatcatgattggttc

SEQ ID NO: 28855 - DNA, 632 bp, Panicum virgatum
  misc_feature: Ceres CLONE 1887319
  misc_feature: Encodes the peptide sequence at SEQ ID NO. 28856
ctcctcttctgctgctgctcttcttctctgctctgttccaccccccggcgcgatgctgagaagcgccatggcatccgcttccagcccaatctgctctctcctcttcgtcctcgtcctgctactgcctccttgtaccgccgctctctcgaagccgcccgcgcggtaccagtaccacacgcttcacgctaccccgctctccgccaagcccgccgccggcgctggggtcgacgccggatccatcttcggcgccaacttggccgctttcttcgacgacaccggcaacgcctctaccgtgcgattgctgctcgcccaccgcgaggcgttcgcggcgcccgacgccaccgcgccccagctgctcgcgcaccgcctggcgcgcgacgccgcgcgtgccgaggcgatttccgccgcggcggccggggccgcggcgaacaggacgcgcgcgccgcaccgtcgaggcggcggcggcttcgcggcgcccgtggtgtccggcctgtcgcagggcagcggcgagtacttcgcgcaggtcggcgtgggcacgccgcccgcgccggcgctcctggtgctcgacaccggcagcgacgtcgtctggctgcagtgcgcgccctgccgccactgctacgcgcagtcgggca

SEQ ID NO: 28856 - protein, 188 aa, Panicum virgatum
  misc_feature: Ceres CLONE 1887319
  misc_feature: SWISSPROT Homolog: EC 3.4.23.12 Nepenthesin
MASASSPICSLLFVLVLLLPPCTAALSKPPARYQYHTLHATPLSAKPAAGAGVDAGSIFGANLAAFFDDTGNASTVRLLLAHREAFAAPDATAPQLLAHRLARDAARAEAISAAAAGAAANRTRAPHRRGGGGFAAPVVSGLSQGSGEYFAQVGVGTPPAPALLVLDTGSDVVWLQCAPCRHCYAQSG

SEQ ID NO: 28857 - DNA, 1969 bp, Panicum virgatum
  misc_feature: Ceres CLONE 1887346
  misc_feature: Encodes the peptide sequence at SEQ ID NO. 28858
ctcgctcaccatcagagctaaattaacctcgcacccccgaaatgatccgctcgccgcgccccacattgcccgcaaatccaaccctttcgggcccaatcactccccaaatccacctttttcgtcactccatcctgtcctaaatcccctcctcagtcctccccacccccaaagtcctacctttcccactgcaccccctgcagagattcttggccactttgattgcccgcctattcgtttcctgcgaaaatccgctctagctcaccaaattccctgcaaaacccgtctttttggcgatttttttttctttgaaattttcgttcttgagcgtccaattctgctcgggctccggggagatccaccgtttctgcttgcgccaggagggagctgggcagcgcggcgcccatgtcggactccgagctgtcccagggcacgctggtgttcgggctccacctctgggaggtcgtcggcatcggtgtcggcgccgccttcgtgctcctcctcgtcctcctctccctgctgtgcctgctcgcgtcccgccgccgccgccgccgccgcgccgtcccggccacccccgtcctccacctccccgtcgtcgtgcccaatgcccagcccaagcacgccgccaagccccccaaggacatccaggaggtgccctaccgcggcgccgcggcccccgccgccccgctcaaggcgccgctcgcgcaggtgctccaggcgccgccgccggactccatccagatcgagaccgggaaggagcaccgcatcacgttcccggagcagccgccgccgcagcaccaccagcggagcggggggccgtcgtcgcgtggcgccagcggcgagagccgcggcgggggcggggagccgggggtcccggaggtgtcccacctggggtggggccactggtacacgctcaaggagctggaggacgccacgtgcatgttcgccgacgagaaggtgatcggcgagggcggctacggcatcgtctaccacggcgtgcttgaaggcggcgtgcaggtcgccgtcaagaatctcctcaacaacagggggcaggcagagagggaattcaaggttgaggtggaagcgattgggcgggtgcggcacaagaacctggtgcggctgttaggatactgtgctgaagggaaccagaggatgcttgtgtatgagtatgtcaataatggaaacttggagcaatggcttcatggtgatgttggtcctgtgagccctctcacatgggatatcagaatgaagattattttgggaacagcaaaaggcttaatgtatttgcatgagggacttgaaccaaaggtggttcaccgtgatgtcaagtcaagcaatattctccttgacaagcactggaatgctaagctttctgattttgggctagcgaagcttttgggttcagagaggagttacgtcacaaccagggtcatggggacatttgggtatgtcgcaccagaatatgcgggcactggcatgctgaatgaaactagtgatgtctatagctttggaatccttatcatggaaataatatctggacgggttcctgttgattacaacaggccaccaggggaggttaaccttgttgaatggctgaagacaatggtcagcaaccgaaattctgaaggggttttggatccgaagatgactgagaagcctacttctagggcattgaagaaggctttgctagtggctctacggtgcgtagatcctgaagctcgcaagaggccaaagatcgggcatgtcattcacatgcttgaagttgatgattttccctacagagatgaacgtcgcggtggcaaggctccaactcaagggagatcggtcgaaacacctacaagtgaaccgggtgatagcagtgggaacaacacgccaaaagacgcaccgaaaggaggagagcctttcaaatggagaactcaagagacctagcaatcaggaaaagcagcgattgttccgagtcttcatgcccatc

SEQ ID NO: 28858 - protein, 507 aa, Panicum virgatum
  misc_feature: Ceres CLONE 1887346
  misc_feature (180)..(429): Pfam Name: Pkinase Pfam Description: Protein kinase domain
  misc_feature: SWISSPROT Homolog: EC 2.7.11.1 Non-specific serine/threonine protein kinase
MSDSELSQGTLVFGLHLWEVVGIGVGAAFVLLLVLLSLLCLLASRRRRRRRAVPATPVLHLPVVVPNAQPKHAAKPPKDIQEVPYRGAAAPAAPLKAPLAQVLQAPPPDSIQIETGKEHRITFPEQPPPQHHQRSGGPSSRGASGESRGGGGEPGVPEVSHLGWGHWYTLKELEDATCMFADEKVIGEGGYGIVYHGVLEGGVQVAVKNLLNNRGQAEREFKVEVEAIGRVRHKNLVRLLGYCAEGNQRMLVYEYVNNGNLEQWLHGDVGPVSPLTWDIRMKIILGTAKGLMYLHEGLEPKVVHRDVKSSNILLDKHWNAKLSDFGLAKLLGSERSYVTTRVMGTFGYVAPEYAGTGMLNETSDVYSFGILIMEIISGRVPVDYNRPPGEVNLVEWLKTMVSNRNSEGVLDPKMTEKPTSRALKKALLVALRCVDPEARKRPKIGHVIHMLEVDDFPYRDERRGGKAPTQGRSVETPTSEPGDSSGNNTPKDAPKGGEPFKWRTQET

SEQ ID NO: 28859 - DNA, 210 bp, Panicum virgatum
  misc_feature: Ceres CLONE 1887346-R
aaatggtgatggttgtgatagtatttgtatattgtgggattaatatgttaggtatagtgattttttggttgttttgttttgggtggtatttatgggggagttgatttgtatggtaaaggggtgtttatttttgaggtgggaaaagattattgagaattgttatagttgaaaagggttgtattaggattggggaatggaattaaaataatg

SEQ ID NO: 28860 - DNA, 699 bp, Panicum virgatum
  misc_feature: Ceres CLONE 1887369
  misc_feature: Encodes the peptide sequence at SEQ ID NO. 28861
atagttgacctgaccccgggcatcatctctgatccggttcccctctgcaccaaagcctgtactatatactccactccacccacgattgatgctcccttccatggcagcccggtaaggcggtaagcgtcgttgtacaccggagggagacgattgacttggcgcccgcaaatccatccgcaacaggaggccccccccagaaacaaagtgatggaacttatccaagaagctgatagatctaaatggatggtgcacagtaaccatagcataaaatgcttcacaaaaggcgacatagacaaaatgaccaacagctatcgaacttgtcttggaagaggtgccttcggagaagtatacaaaggggttcttgaggacggaagcatggttgcagtgaaaaggtttatccacaatgtgaaagaaaacttcgctaaagagctgatcgtccatcgtgaaatcaaccacaagaacgtagtgaggctcattggttgctgtgaggaggaaaatgcccttatgctggtcactgaatatgtcgctaatggaaatctaagtgatgctcttcaccatgacaatcttcccatccctttggatataagacttagggtcgccgtcgagtgtgcggaggcgttggcgtacattcattctcacatgtatactcgggttatccatggcgacatcaagcctggtaacatacttttagatagcaac

SEQ ID NO: 28861 - protein, 163 aa, Panicum virgatum
  misc_feature: Ceres CLONE 1887369
  misc_feature (34)..(160): Pfam Name: Pkinase_Tyr Pfam Description: Protein tyrosine kinase
  misc_feature: SWISSPROT Homolog: EC 2.7.11.1 Non-specific serine/threonine protein kinase
MELIQEADRSKWMVHSNHSIKCFTKGDIDKMTNSYRTCLGRGAFGEVYKGVLEDGSMVAVKRFIHNVKENFAKELIVHREINHKNVVRLIGCCEEENALMLVTEYVANGNLSDALHHDNLPIPLDIRLRVAVECAEALAYIHSHMYTRVIHGDIKPGNILLDS

SEQ ID NO: 28862 - DNA, 2158 bp, Panicum virgatum
  misc_feature: Ceres CLONE 1887381
  misc_feature: Encodes the peptide sequence at SEQ ID NO. 28863
atgaattgcaagcctacgccggtgacgacctggcctagcttattggctcctgcatgctagctgcgcctgcgtcgtctccatgccatgcatgccgctgcgccgctggtagtgcgcgcgctagctagtagtgcaagtgtagagtagagagctccagcaagatccgcccagctttgcgtcgtcgtctccggccgtgaccgtgaagggatcgcgaccgccgtccccgtccgtgcgggatctcctgccgcgcggatcctacacggctacacccaccgcctttgccgttggcaggctaccacctacagcccggtgagcatcgccttttttttcgtgcacacacagctagctaggctagtagctgccgatcgtacgtgcatgggaacggaggagatgctgccgtagtggtcgtcggcgggcctgctgcagatcaaggcgttgcgccgctcacgggagtgtggacgcaggtggtggtcgcaggagctcaaaagcacccccaccagaagccggccagctgccggcgagctccctctcgtcttcatcccgagcgaccgcccgacctccaggtccggcgatgggcaaggcggcgcggtggttccgcagcttcctgggcaagaaggaccaggccaaagaccagaggcgccagcgggagaaccaccagccgctgcccccgcaggccagcgccaagcgctggagcttcggcaagtcctcccgggacacggcggaggccgctgccgccgccgctgccgcctcccaggcgcccgttgcggccggcaacgcggcgatcgcgcgcgcggctgaggccgcgtggctcaggtccgcggcctacgccgagacggaccgggagcgcgagcagagcaagcacgccatcgccgtggccgcggccaccgcggcggcggcggacgcggcggtcgccgcggcccaggcggccgtcgccgtcgtgcggctcaccagcaagggacgcgccgcgcccgtcctcgccaccgccggcgggcgcgccgccgccgccgtcaggatccagacggcgttccggggattcctggcgaagaaggcgttgcgcgcgctcaaggcgctggtgaagctgcaggcgctggtgcgcggctacctcgtgcgccggcaggcggccgccacgctccagagcatgcaggccctcgtccgcgcgcaggccgccgtgcgcgcgcgccgcgccggcgtccccgtcctcccgcagctccaccacccgcccgtccggccgcgctactcgctgcaagagcggtacgcggacgacacgcggagcgagcacggcgcggcggcgtacggcagccggcggctgtcggcgagcatcgagtcctcgtcgtacgggtacgacaggagccccaagatcgtggaggtggacccgggccggcccaagtcgcggtcgtcctcgcgccgggcgagctccccgctgctcgacgccggcagcagcggcggcgaggagtggggcgccaactccgcgtgctcgccgctgccgtgctacctgtccgccgggccgccgcgcatcaccgtgccgacctcgcgccagttcccggactacgactggtgcgcgctggagaaggcccggccggcgacggcacagagcacgccgcggtacctgcacgtgcacgcgccgggcaccccgaccaagtccgtggcgggctactccccgtcgctccacggctgcccgaactacatgtcaagcacgcaggcgtcggaggccaaggtgcggtcgcagagcgcgccgaagcagcggccggagctcgcctgcggcaatggcggcggcgcgcggaagcgggtgccgctgagcgaggtggtggtggtggagtcgtcccgcgcgagcctgagcggcgtcgtgggaatgcagcgcgggtgcggcgccagggcgcaggacgcgttcagcttcaagacggccgtcgtcggccgcatcgaccgcacgctggaggtggccggcgtcgagaacgaccggctggcgttcctgcagaggaggtggtgatgaggccagcaggctctgcattggggatgccagtgaaacgagggctttgggggggggggggggggagtaattagcaataagaatgcgttttcctgtgtgttcttgcgagctctcgtccttttcattcttcttgttcttgtgtgtttgcaatgtgatcaatcatgcagcttttgtgtg

SEQ ID NO: 28863 - protein, 470 aa, Panicum virgatum
  misc_feature: Ceres CLONE 1887381
  misc_feature (142)..(162): Pfam Name: IQ Pfam Description: IQ calmodulin-binding motif
MGKAARWFRSFLGKKDQAKDQRRQRENHQPLPPQASAKRWSFGKSSRDTAEAAAAAAAASQAPVAAGNAAIARAAEAAWLRSAAYAETDREREQSKHAIAVAAATAAAADAAVAAAQAAVAVVRLTSKGRAAPVLATAGGRAAAAVRIQTAFRGFLAKKALRALKALVKLQALVRGYLVRRQAAATLQSMQALVRAQAAVRARRAGVPVLPQLHHPPVRPRYSLQERYADDTRSEHGAAAYGSRRLSASIESSSYGYDRSPKIVEVDPGRPKSRSSSRRASSPLLDAGSSGGEEWGANSACSPLPCYLSAGPPRITVPTSRQFPDYDWCALEKARPATAQSTPRYLHVHAPGTPTKSVAGYSPSLHGCPNYMSSTQASEAKVRSQSAPKQRPELACGNGGGARKRVPLSEVVVVESSRASLSGVVGMQRGCGARAQDAFSFKTAVVGRIDRTLEVAGVENDRLAFLQRRW

SEQ ID NO: 28864 - DNA, 1958 bp, Panicum virgatum
  misc_feature: Ceres CLONE 1887387
  misc_feature: Encodes the peptide sequence at SEQ ID NO. 28865
attttcgcttcccatccccttttcctcgttgttgctccgcctcttcggtctccgttccccacccaccgccttctcccttgtgccctcggcgccgcgcgacatgagcctcgctgaggcgccgtcgccgtccccgtcgtcctcgagcggaagcgacgactttgccgccctcctcgacgccgagctcgagctcgcctccggcgccgactccgccttccccgacgacccctcctccgcctcgcccgccaccgacgacgagggcgaggaggaggattcagaggaggaggtggaagttgaagtcccagaacagaacggtgctaaaaggcgtagagtggaggaacaacgccaagatcaaggaatgtcaattaggcctggcaaaattgcaactggtccatctaaaaacgttcaagttgagttatgtccacatcctggatattttggtggcctttgctatagatgtggcaaaccacaggatgaggaagatgtttcaggagttgcttttggttacatccacaagggcttgaggctaggtacttcagaaatcgacagattacgtggctctaatttgaagaatctgttgcgtgaaagaaaattagtgcttattttagacatggatcatacactgatcaactcgaccaaactccaacatatttcttctactgaaaatgagttgggtattcggacagctgctctaaaagatgatccggacagaagcatcttcacgctagattcgatgcagatgctgacaaagttgagaccatttgtccataattttttgaaagaagcaagcaatatgtttgacatgtatatatacaccatgggtgacaaagcttatgcaattgaaatagcaaagcttcttgaccctactaatgtctattttccatcaaaagtgatttcgaactcggattgcactcagcaacatcagaaaggtcttgatgtgattcttggggctgaaagtgttgcagtgatccttgatgacactgaatatgtctggcagaagcataaagaaaatctaattctgatggagagatatcattactttgcttcaagctgccgcgaatttggttttggtgttagatctttgtcagagtctatgcaagatgaaagggagagtgatggtgctttggctacagttttagatgtcttgaagcgcatacatgcgattttctttgacacagctgctgaaactgatcttttttcacaggatgtaagacaggtgatcaagatggtacggaaagaagtactgaaaggctgcaaactagtcttcagccgggtgttcccgaacaacgctcgcccacaggagcagatgatgtggaagatggccgagcgtctgggtgccgtttgctctacagacgtggattccacagtgacccacatcgtggctgtggatctgggaacagagaaggcccactgggctgcaggcaacaaaaagtttttggtccatccgcgctggattgaagctgccaatttccgatggcaccgacaacctgaggaagattttcctgtcgttcctccgaaggtaaagagcagagatgaagtgaatgctgtgactggccagaatgaaacgagcaaagataaagaagaaaatgctgtagctggcgtgaaggaaacgatcaacgataggaaagaagaaaatgacgcagacggccagaaggataaggacgacgccaaagaaaacgctgtggcaactactgctacaggccctgctgactcgtaatggtctgtagggctcgaaagttggctgacatacagtgtaggcgtgcaggtttgtggggacggaccgcggagattgcttttttgttacccgctcgtgcaggtccaagatgttagatttaattctggtacgcgtgaaattttgatgctgacctgagatgctgattgggcttccggccatatgacttgtggtactataacactataggagtttttcaaattgatgtcattattatggcataattctg

SEQ ID NO: 28865 - protein, 537 aa, Panicum virgatum
  misc_feature: Ceres CLONE 1887387
  misc_feature (155)..(350): Pfam Name: NIF Pfam Description: NLI interacting factor-like phosphatase
  misc_feature (376)..(455): Pfam Name: BRCT Pfam Description: BRCA1 C Terminus (BRCT) domain
  misc_feature: SWISSPROT Homolog: EC 3.1.3.16 Phosphoprotein phosphatase
MSLAEAPSPSPSSSSGSDDFAALLDAELELASGADSAFPDDPSSASPATDDEGEEEDSEEEVEVEVPEQNGAKRRRVEEQRQDQGMSIRPGKIATGPSKNVQVELCPHPGYFGGLCYRCGKPQDEEDVSGVAFGYIHKGLRLGTSEIDRLRGSNLKNLLRERKLVLILDMDHTLINSTKLQHISSTENELGIRTAALKDDPDRSIFTLDSMQMLTKLRPFVHNFLKEASNMFDMYIYTMGDKAYAIEIAKLLDPTNVYFPSKVISNSDCTQQHQKGLDVILGAESVAVILDDTEYVWQKHKENLILMERYHYFASSCREFGFGVRSLSESMQDERESDGALATVLDVLKRIHAIFFDTAAETDLFSQDVRQVIKMVRKEVLKGCKLVFSRVFPNNARPQEQMMWKMAERLGAVCSTDVDSTVTHIVAVDLGTEKAHWAAGNKKFLVHPRWIEAANFRWHRQPEEDFPVVPPKVKSRDEVNAVTGQNETSKDKEENAVAGVKETINDRKEENDADGQKDKDDAKENAVATTATGPADS

SEQ ID NO: 28866 - DNA, 691 bp, Panicum virgatum
  misc_feature: Ceres CLONE 1887388
  misc_feature: Encodes the peptide sequence at SEQ ID NO. 28867
aggtcctcagctcgatccccctccgcaacacgacaccgccgcaccacaccaatccgatcgaatccgccgcagcggcgacggccatggaggcggcggcggagctggcgctgcgcctccgggcggccgccaacgcccgcctcgcgcgctacgagccgctggcgctcgctgccgcgccgctcctcgcgctcctcgtcgcccgcctcgcccacgccgccgccagcgccgtcgccgaccggggcctcgtcgccatcgccatcgccgccgtcaagttgctgccgggagtctccagctacatcgcggcggagaagaagaaggttgttgacaagatgcaatctggtgggacatcgtccaagaacaaccggcgaactgagttgccgacaattggccttggtgaggaagtgataaaggatcttgaaacattgaaagccaaagatgtagactggcagggaaagtgctctggcacagtatatatcgctggaagtgagtctgagggccatttcgaattgataaacaaagcttactctatgttttcacacaccaatccgctgcatcaagatgtattcaagagtgtggcacacatggaagctgaagtagttgcaatgacagctgctttgcttggcagcaaagaaaaatcatccggtggacaaatttgcggcaacatgacatctggtggaactgaaagcatattatt

SEQ ID NO: 28867 - protein, 202 aa, Panicum virgatum
  misc_feature: Ceres CLONE 1887388
  misc_feature: SWISSPROT Homolog: EC 4.1.2.27 Sphinganine-1-phosphate aldolase
MEAAAELALRLRAAANARLARYEPLALAAAPLLALLVARLAHAAASAVADRGLVAIAIAAVKLLPGVSSYIAAEKKKVVDKMQSGGTSSKNNRRTELPTIGLGEEVIKDLETLKAKDVDWQGKCSGTVYIAGSESEGHFELINKAYSMFSHTNPLHQDVFKSVAHMEAEVVAMTAALLGSKEKSSGGQICGNMTSGGTESIL

SEQ ID NO: 28868 - DNA, 503 bp, Panicum virgatum
  misc_feature: Ceres CLONE 1887424
  misc_feature: Encodes the peptide sequence at SEQ ID NO. 28869
aagccgaagcagccgctgcgtccccaggaccagcccaccacccggaccccacctgctgacagacgccgccgcaccagcgcccaaatctcccaaaaccctaagccgaggggccaaaaaagagggcaagggggagagagaggaggcgcgcggaagggcggccccaacgcccccgtcggcggccgcaaatctggcgggcaagtccggcgtccgcgtcgtcgtgatcggcgaccccggcaccggcaagtccagcctcgttgtcgcgctcgccaccgagcaattccccgagaacgtgccccgggtcatgccccccacccgcctccccgccgactacttccccgaccgcgtccccatcaccatcatcgacacatcgtccagcccggagcagaagccgaaattgatcacgcagagccaggcagccgatgaggcggtggtgctcacgtacgcctgcgaccggcccgccacgctggaacggctcagttcgttctggctccccgagctccggc

SEQ ID NO: 28869 - protein, 167 aa, Panicum virgatum
  misc_feature: Ceres CLONE 1887424
  misc_feature (70)..(167): Pfam Name: Miro Pfam Description: Miro-like protein
SRSSRCVPRTSPPPGPHLLTDAAAPAPKSPKTLSRGAKKEGKGEREEARGRAAPTPPSAAANLAGKSGVRVVVIGDPGTGKSSLVVALATEQFPENVPRVMPPTRLPADYFPDRVPITIIDTSSSPEQKPKLITQSQAADEAVVLTYACDRPATLERLSSFWLPELR

SEQ ID NO: 28870 - DNA, 1896 bp, Panicum virgatum
  misc_feature: Ceres CLONE 1887449
  misc_feature: Encodes the peptide sequence at SEQ ID NO. 28871
aacccgcgcccctcttgggctcttggctgcgtgcgtgtcgccgtcctcggcacttacccccttccctggcggcctgcctgcctgcctctacagcagcggcccgccggcacggcgacgcggcgagcgctcgctcaaggccgcgggggctacctgggtcgtctgctcctccagccccatcggagatccgcgctgccgttccctgatttatggtgaggctcatagaactactgtttttcaaacccagattcagcgcctgttgatggatgagagatgaaaaacttcatcaagtaatcaatttgaagaagttcagatgggctccattctaagtgtgagtagtgctaagtctatggatcgacatgagtcatctgggacagatcctaataagaggttgaaggtatctacttatgagtatgggacgaacccgaggatccttccaacacttcccgatgagctctcattccaaattctggcaagattaccacggattcattacctcaacttgaagatggtttgcagagcttggaaggcagcaatcaccagccatgaactttcccagctgaggagagagcttcgtgtaaatgaagaatggttgtatgtactgaccaaagtcgaggcaaataagctcgattggtatggccttgatccattgtttcagaaatggcagaggttgccaccgatgccttctttcatcaatgaggaggaatccactaggactggatcttctgggttccggatgtggaatgttgtgggctcaagcattaggattgctgatttcgtgaggggctggttctggcgcaggaatggtttggaccagatgcccttttgtggttgctcagtgggtgttgctgatggttacttgtatgttgttgggggcttttccaaagctgttgccctgaactgtgtatggagatatgacccttttctcaacttgtgggaggaagtaagcccaatgatggctgggcgggctttctgcaaggcaacattcttgaatggcaagttgtatgtagttgggggagtcagtaagggtcggaatggcttgcttcctctgcgttcagctgaggtgtttgatccaaaaactggactgtggagtgagctaccagaaatgccttttgcgaaagcacaggtactccccacagctttcttggctgatgtgctgaagcctatcgccacaggaatggcaccatacaagggtaaactgtacgttcctcagagcttgtactcatggccattcttttttgacattggaggtgagatctatgacccggaactgaattcttggtcagcgatgccagatggtctcggcgatggatggccagcaaggcaggcaggcacaaagctcggtgtcgtgatcgatgacaaactttataccttggagccttctacctctttggatagtggccacataaaaagatacaactctgaagaagacacatgggtaactatcgccccacaggttccggttaacgatttcactgatgcagaggctccatatttacttgctggcctccatggaaggctgcacgttataacaaaggcggcgaacaatactctccaggttatgcatgctgtggtgcagaataacacaggcagcggggcatcagaagaaaacgtgttatggaacacagtggcttccaggaactttgggacggctgagcttgtgagctgccaggttcttgatgtttaaaacgaggtcgcctttcacacctgtagagcatacgtttggcctaggtttcatgctatgagctatcgttttagccaacaaagataatagttttttttccttgtgtgtatgtgtggtgtgcggagattggagaaggcctttaatttgacatgtataagttgactcaactgctggaaagatgtgtatataggcatacaatcgacatggttacgtac

SEQ ID NO: 28871 - protein, 457 aa, Panicum virgatum
  misc_feature: Ceres CLONE 1887449
  misc_feature (170)..(215): Pfam Name: Kelch_1 Pfam Description: Kelch motif
  misc_feature (217)..(266): Pfam Name: Kelch_1 Pfam Description: Kelch motif
  misc_feature (39)..(86): Pfam Name: F-box Pfam Description: F-box domain
MGSILSVSSAKSMDRHESSGTDPNKRLKVSTYEYGTNPRILPTLPDELSFQILARLPRIHYLNLKMVCRAWKAAITSHELSQLRRELRVNEEWLYVLTKVEANKLDWYGLDPLFQKWQRLPPMPSFINEEESTRTGSSGFRMWNVVGSSIRIADFVRGWFWRRNGLDQMPFCGCSVGVADGYLYVVGGFSKAVALNCVWRYDPFLNLWEEVSPMMAGRAFCKATFLNGKLYVVGGVSKGRNGLLPLRSAEVFDPKTGLWSELPEMPFAKAQVLPTAFLADVLKPIATGMAPYKGKLYVPQSLYSWPFFFDIGGEIYDPELNSWSAMPDGLGDGWPARQAGTKLGVVIDDKLYTLEPSTSLDSGHIKRYNSEEDTWVTIAPQVPVNDFTDAEAPYLLAGLHGRLHVITKAANNTLQVMHAVVQNNTGSGASEENVLWNTVASRNFGTAELVSCQVLDV

SEQ ID NO: 28872 - DNA, 2179 bp, Panicum virgatum
  misc_feature: Ceres CLONE 1887458
  misc_feature: Encodes the peptide sequence at SEQ ID NO. 28873
accgcccccttcttctccagttctccctcccactgctcccccccccccttctctctccagatctcacccgccatggacctcctcgacgcgggccaccgccgcgcccccgccgccgacatggacggcgccgcggccgccgcgctcccgctagcgggcgcggcctaccagccctacgtctccgagctcctctccttctccatcgagcgcctcgacaaggagccggagctgctgcgggtggacgcggagcgggtgcggcggcagatgcaggaggtggcggtggagaactacgccgccttcatcgcggcgtccgaggcgctctccttcgtccgcgcgcagctcgaggggttcgacagccacctcgaggccctgatagaggagataccaaatttaacatctggctgcactgagtttgtcgagtcagcacagcaaattttggaagagaggaagcttaatcaaacattactagccaaccatagtaccttgcttgacttgcttgaaatcccacaactgatggacacgtgcatacggaatgggaactatgatgaggcacttgatctagaagcttttgtaaacaaaatttcaaagttgcaccctgatttacatgttatccaaggattagctgctgaagtcaagaagacaatacagtcactaatttcacagcttctccagaaacttcgatcaaatattcagttacctgagtgccttcgtattgtagcacatttgcgtcgaattggagttttcagtgaatcagaattgcgcttacagttcttgagatgcagggaagcttggctttctgggattcttgaagatctggaccagaggaatgtttatgattacctgaaaggcatggtgacttgccacagggtacatttgtttgatgttgttaatcaataccgagcaatattcaacaatgataaatccggaaatgaggagaactatgatggtgggctgctgttcagctgggcaatgcaacaagttagtaatcacctcacaactcttcaagttatgttaccaaacataactgaaggtgggtctctgtccaacattcttgatcaatgcatgtattgtgcaatgggtctggggttagttgggttggatttccgtggcctacttccacctatctttgaaaatgcggttctaaatttattatcaaagaatatgagcacagcggtagaaaatttccaggttgttttggattcacaccgttgggttccgatgccatctgttggcttcgtagcaaatggagttgtggatgagacttctgatgatgtgactccaccttctgttttaatggagcatccacctcttgcagtgtttgttaatggtgtttcagcagcaatgaatgagctgagaccatgtgcgccattgagcttgaaacatgtccttgctaaggaggtggtgaagggattacaggcagtctctgactccctagttagatacaacgccatgcgaatgctgcgtgggaatgagtccgctctgttcctttcactctgccaggcatttatcgaggttgtacacccttattgtgctgcatgttttggccgatgctacccgaacggagcaacgctgatcacagagtgccagagcacattcaacgctgtcagccagctactgaccgtgcccgcaagatcacacagttccagcattgagagaagacagtcaggaggcatagaccggaagcagtcgggaggcattgacaggaagcagtcggggaacattgaacgagggcagtcgggaggcatagaccgaaggcagtccattgagagcactgggtcagccatcaccgataatgggctcccagctgatggaccgggccctgaggtcaacagtgatgctgcaaccccagcctcagcggttcaggatgatgcgcgaaccagtccgccatcaagcaagtagcttggatctctgttcttggaatctgttgaagcccttcatcaaggccttgttatcttcaaccagaggataccgctgcaaagttacatttgttgagtttcgctcagtattttctgctctcggttctacagtgtatacaagcttctcatcagcagatatttgtatcttgatttgtacaatacactcaaatccttagccgttcattgttacttgttagcccatacctagatcctgtagagtgttacaacctggacaataatctggtaatacgaactgtgttggttgc

SEQ ID NO: 28873 - protein, 607 aa, Panicum virgatum
  misc_feature: Ceres CLONE 1887458
  misc_feature (23)..(368): Pfam Name: Dor1 Pfam Description: Dor1-like family
MDLLDAGHRRAPAADMDGAAAAALPLAGAAYQPYVSELLSFSIERLDKEPELLRVDAERVRRQMQEVAVENYAAFIAASEALSFVRAQLEGFDSHLEALIEEIPNLTSGCTEFVESAQQILEERKLNQTLLANHSTLLDLLEIPQLMDTCIRNGNYDEALDLEAFVNKISKLHPDLHVIQGLAAEVKKTIQSLISQLLQKLRSNIQLPECLRIVAHLRRIGVFSESELRLQFLRCREAWLSGILEDLDQRNVYDYLKGMVTCHRVHLFDVVNQYRAIFNNDKSGNEENYDGGLLFSWAMQQVSNHLTTLQVMLPNITEGGSLSNILDQCMYCAMGLGLVGLDFRGLLPPIFENAVLNLLSKNMSTAVENFQVVLDSHRWVPMPSVGFVANGVVDETSDDVTPPSVLMEHPPLAVFVNGVSAAMNELRPCAPLSLKHVLAKEVVKGLQAVSDSLVRYNAMRMLRGNESALFLSLCQAFIEVVHPYCAACFGRCYPNGATLITECQSTFNAVSQLLTVPARSHSSSIERRQSGGIDRKQSGGIDRKQSGNIERGQSGGIDRRQSIESTGSAITDNGLPADGPGPEVNSDAATPASAVQDDARTSPPSSK

SEQ ID NO: 28874 - DNA, 660 bp, Panicum virgatum
  misc_feature: Ceres CLONE 1887807
  misc_feature: Encodes the peptide sequence at SEQ ID NO. 28875
gacgagggaggggaagagacgaagagtgaagagacacgaatccggatagagcgccgccgccgcccccagccccgccccgccccgtctggcgacgaggaccccgttccggcgccgccacagcgccggaccgagagaaaggcaggtagggaggaactgaggaaacatgacgacgatccggcggttctgctgcgaggacctcctccgcttcgcctccgtcaacctcgaccacctcaccgagacgttcaacatgtcgttctacatgacgtacctggcgcgctggcccgactacttccacgccgccgtaagccctggcggccgcgtcatgggttacagtatgtcgcttcttcccattcttcgtggttgtttgggcgtctggttggtttgtcctgccaaatttgtctggctagttgtgtgttcctagttcttctgcatcattgcttgtcaaattaaggttagctggacctgtagagtgcaatccgtggatgctagttgaatttttagacatgagttgtttaaagggaccggattatcttcatctgctatgtttccacgcaattaatcatatgtggatatgcgaatagtctggttgagttgacaaagttgttctacaagtaggcattgtttctgcaaatgcaaatgcacgtgatgatagtgagatta

SEQ ID NO: 28875 - protein, 85 aa, Panicum virgatum
  misc_feature: Ceres CLONE 1887807
  misc_feature: SWISSPROT Homolog: EC 2.3.1.88 Peptide alpha-N-acetyltransferase
MTTIRRFCCEDLLRFASVNLDHLTETFNMSFYMTYLARWPDYFHAAVSPGGRVMGYSMSLLPILRGCLGVWLVCPAKFVWLVVCS

SEQ ID NO: 28876 - DNA, 655 bp, Panicum virgatum
  misc_feature: Ceres CLONE 1887809
  misc_feature: Encodes the peptide sequence at SEQ ID NO. 28877
aggggtggtggtgagagctagcttagctgtcatggccgcggcggcgcctccgttcccggcctcagcggcggcggcgctgctcctgctgccgctgctgctctgcctgagcggcggatgcaatgcgcagacgccggtgttcgcgtgcgacgcgtcgaacgcgacgctggcggcgtacgggttctgcaaccggtcggcgacggccgcggcgcgcgcggcggacctggtgtcgcggctgacgctggcggagaaggtggggttcctggtggacaagcaggcggcgctgccccggctgggcatcccggcgtacgagtggtggtcggaggcgctgcacggcgtgtcctacgtggggcccggcacgcggttctcgccgctggtgcccggcgccaccagcttcccgcagcccatcctcacggcggcgtccttcaacgccacgctcttccgcgccatcggcgaggtggtgtcgaacgaggcgcgggcgatgcacaacgtggggctggcggggctcacgttctggagccccaacatcaacatcttccgggacccgcggtggggccgcgggcaggagacccccggcgaggacccgctgctcaccagcaagtacgccgtcggctacgtcaccgggctgcaggacgccggctccggcgccggcgacagc

SEQ ID NO: 28877 - protein, 207 aa, Panicum virgatum
  misc_feature: Ceres CLONE 1887809
  misc_feature (81)..(206): Pfam Name: Glyco_hydro_3 Pfam Description: Glycosyl hydrolase family 3 N terminal domain
  misc_feature: SWISSPROT Homolog: EC 3.2.1.21 Beta-glucosidase
MAAAAPPFPASAAAALLLLPLLLCLSGGCNAQTPVFACDASNATLAAYGFCNRSATAAARAADLVSRLTLAEKVGFLVDKQAALPRLGIPAYEWWSEALHGVSYVGPGTRFSPLVPGATSFPQPILTAASFNATLFRAIGEVVSNEARAMHNVGLAGLTFWSPNINIFRDPRWGRGQETPGEDPLLTSKYAVGYVTGLQDAGSGAGD

SEQ ID NO: 28878 - DNA, 712 bp, Panicum virgatum
  misc_feature: Ceres CLONE 1887817
  misc_feature: Encodes the peptide sequence at SEQ ID NO. 28879
  misc_feature (648)..(648): n is a, c, t, g, unknown, or other
atatctagaagagttcatcgcaaaacaaagcttgtgtttaggtttcttgataaatccttagataattctatacaccaaacatatgcttcacttttgagcaacctaacgtttattaagtctattgcatctggcataatggtccctaagagctacatttggccagtcacaaaggataactatctacaggcacccacatcaattgtagcaaaagcccacagtgcagggctggaaatatatgcctctgattttgcaaatgatagaattatcccctataactacagttatgatccattggcagaatacctaaactttatcggcgatgggggcttctctgttgatggtgtattgtcagaaaacccaattactgcatcagaggctattggttgctttgctaatctgaattcaagtaagactgatcatggggaacccttaattatctcgcataatggtgctagtggagattatccggactgtacggacctggcctaccatagtgcaattaatgatggcgcagatgtcattgattgtcctgttcaagtgacaagtgatggaactcttatgtgcatgggttccattaacctgcttcataccacgaatgtgcagagaacaactttcaactctcgtgcttctgttgtttcagaaattcangctacaccaggagtcttcacattcaaccttacttgggatgacatcaatagtagtatacaacccc

SEQ ID NO: 28879 - protein, 237 aa, Panicum virgatum
  misc_feature: Ceres CLONE 1887817
  misc_feature: SWISSPROT Homolog: EC 3.1.4.46 Glycerophosphodiester phosphodiesterase
  misc_feature: Functional homolog of the protein sequence given in SEQ ID NO 51292
  misc_feature: Useful for making plants with altered cell wall content and/or composition
  misc_feature (216)..(216): Xaa is any aa, unknown, or other
ISRRVHRKTKLVFRFLDKSLDNSIHQTYASLLSNLTFIKSIASGIMVPKSYIWPVTKDNYLQAPTSIVAKAHSAGLEIYASDFANDRIIPYNYSYDPLAEYLNFIGDGGFSVDGVLSENPITASEAIGCFANLNSSKTDHGEPLIISHNGASGDYPDCTDLAYHSAINDGADVIDCPVQVTSDGTLMCMGSINLLHTTNVQRTTFNSRASVVSEIXATPGVFTFNLTWDDINSSIQP

SEQ ID NO: 28880 - DNA, 732 bp, Panicum virgatum
  misc_feature: Ceres CLONE 1887818
  misc_feature: Encodes the peptide sequence at SEQ ID NO. 28881
acctacctccttcacccgtgcccccccaccctggccggccctgcttcgacgggcggcttcgcagatcgaaggtgagagagatctctgctcctgcccctctaccgatccgaaccgctccccgctcctcgcggccggagaccgggtcgtcgcggcatttcccggaaccaggagggaatgatggatctcgcggacagccggcagcggctcatcgccggcgcggcgctgctgctggccaccgtcgccttcgtcaagctcctgctgggctctcgcgcccgcggcaagcgcctcccgcccaccatcccgggggcgccggtcgtcggcgggctcatcaagttcatgcgcgggcccatccccatgatccgggagcagtacgcctgcctcggcagcgtcttcaccgtccccatcctcagccgcaggatcaccttcctcatcgggcccgaggtgtcggcgcacttcttcaagggcaacgaggccgagatgagccagcaggaggtgtacaagttcaacgtgcccacgtttgggccaggggtcgtcttcgacgtcgactactcagtcaggcaggagcagttccggttcttcaccgaggccctgcgggccaacaagctccgcagctatgtcgaccagatggttgctgaggctgaggagtacttctcagagtggggagaaagtggtaccgtggatttgaagtatgagttggagcacctcatcatactgacagctagtcgatgcttg

SEQ ID NO: 28881 - protein, 184 aa, Panicum virgatum
  misc_feature: Ceres CLONE 1887818
  misc_feature: SWISSPROT Homolog: EC 1.14.13.70 Sterol 14-demethylase
MDLADSRQRLIAGAALLLATVAFVKLLLGSRARGKRLPPTIPGAPVVGGLIKFMRGPIPMIREQYACLGSVFTVPILSRRITFLIGPEVSAHFFKGNEAEMSQQEVYKFNVPTFGPGVVFDVDYSVRQEQFRFFTEALRANKLRSYVDQMVAEAEEYFSEWGESGTVDLKYELEHLIILTASRC

SEQ ID NO: 28882 - DNA, 1375 bp, Panicum virgatum
  misc_feature: Ceres CLONE 1887820
  misc_feature: Encodes the peptide sequence at SEQ ID NO. 28883
gcaaccgtcgccgacgccgacgccctccacctccggccccggcgtggagcgcaggaggaccgtccgcacttcgcactcgtgagtcgtgactggtgtcgtgcggtggtgagaaaccctaacttgctcggcggatttttcccagagtttcggtttttccccgcgagactattcgctgctgtgtttgtttctctcgatcgatgcctaggatttatttgttgcgaggtggagtaccagtccggaaatcatccatccacggttccggttgggttcgattaacttcttcggcgggcgctaggtcatctcagttgatgccatggggctttgggtgcggatgaactttaatttccaggaaaaaaaaaaggttcatctgaacccctatgcccctgttaatttcaggttactatgaagtcactgcttggttgtcgcattgattgaattggactaagaatcatattgcgtaatggatgtacatttggaaccatgtggcctaggggtacaacaaaggtttgatgattgtggtcatgggtttatgcccccaatctccttagaataggaaaaaatggaggtgcattcagtcagcaacctactaagctgtggacatttcacgacatataaatatgtcatacatgtcttttttttacgagtggtgacaattatgttgatattgcgcattttcctatcttctttatttgtccttgatatagttattgttttgctacacatggaaaaccactcagagtctaagctattcagatatttctagggttgttggctcatggtctagcaatcgatccctcaagaactttgcgatgcccagctacttcaaaggtgtcaactgcacccttgggacttgtcacttcgttgagtttcaacaggcgatgcaaggaaaagaacaaagtcttcatcaatgtggatagatacaccaaatacagtactcctttctgttatgcacagagaaatgccagaatcataccactggcaactgcatcatttggggacatggctgattctactcgtgagtatttgctaaccatgtctatgacaagaagatcttacataatcagttcatacactgagatggtcatgggcggacccagggcccggcgaccctgggcaccagcccaggctccggcgtgatgaccgcaagagccatttttcctagaatccatgtgaaggatccatatcagcgtcttggaatcagtagggaagcatctgaagaagagattcgagctgccaggaactatctgataagcaagtatgcaggccataagccaagtgttgatgcaattgagtctgcccatgacaggattattatgcagagtttctttgacaggaaaaagccaaaaatggacctcaagaaaaatttagagagctt

SEQ ID NO: 28883 - protein, 79 aa, Panicum virgatum
  misc_feature: Ceres CLONE 1887820
  misc_feature: Functional homolog of the protein sequence given in SEQ ID NO 50749
  misc_feature: Useful for making plants with altered protein content
MTARAIFPRIHVKDPYQRLGISREASEEEIRAARNYLISKYAGHKPSVDAIESAHDRIIMQSFFDRKKPKMDLKKNLES

SEQ ID NO: 28884 - DNA, 675 bp, Panicum virgatum
  misc_feature: Ceres CLONE 1887820-R
ttagagagcttagtcagtcacgtgcagtcaaggctattcaaggcagatttcaaacaccacgtagcaaagtcatttggcagacagcaattacttttatcttacttggagtgcttacccttgcctttcctactgaagaagggccaactctccaggtggccatatcttgtgcagcaaatatctatttcatttatcagagggtcagaagtggatggcgagcattcttttatgggtttggatctttctttgcttcgtggttccttggcaccttcttgatggtatctgtaattccaccaatactgccaggtccaagaaacttggaagtgagcactgcatgtgttacatatgccctccttttcatatcatcaaccttcctgaagtaagaagccttggtattttccatagcctatgatcctgcggcagccatcaacatggtatcctacatctgataactcaacaatcatctgctcctttctttgtttcttcccagagttgcaaatgctagttccttggtgagttgatagtagttgttgtcaggttgtaatttgagatgtagaactgttttgccttggcccttcttaagcagtgagcctaacacctcctgtaggcattttggtcgaaatgttaaacactgattggttttggatttagatcatatgagatagtcgctaaatttcc

SEQ ID NO: 28885 - DNA, 1753 bp, Panicum virgatum
  misc_feature: Ceres CLONE 1887830
  misc_feature: Encodes the peptide sequence at SEQ ID NO. 28886
agcaggtcgcggccggcctcgaaccatctcgtttcgtttcccttcctccttccctcgctccccagccacaccacatctcgagcgggctccttggcggccggccgcccacgccgtccgtgcccgtgcggcgatccggcgcgccgctcttagaggctaggccgctcccgtcgctcgccggggcggcgcgagcccgggcgccgtcctaggttcgtggcgcctgcgcaaccgagccttggttcgtgggcccgggtttcccgcgcttgattcgcagccggggaagcatcagaagggaaacgggattagctatctctgcagaggccgccgggcttccccggccgtctcgcgcaggtgggtacgcttgaataagttggaaatccttcaagttcccggctccttatggcttcctcagatatctctgttgatattcggcccgactttaactcattcgatcatttcccaagcatgcgatacattgcaacagatagaccctggctgaagttatatggaataagagttcagcctatgccgccattcagaagtttgagctgcaaacctgatccggcactcattcatcattgcctacctgatgaactacttcttgagattttcacaagaatgaacccatatacgttagggagggctgcgtgtgtctgccgcaagtggaaatatactgcacgtaatcctgctttgtggcgtgttgcatgcttgaaaacttggcagaggagtggaactgaagtaaactacatgatggttcggtcgttgtatgattcttcttggaggagaatgtggttgcagagaccaagaatccgaattgatggtctctatgttagcaggaacacatatattcatactggagttacagagtggcaattcaagaaaactgtcaacgtggtttgctactaccgttacttgagatttttccctagcgggaagtttctctacaagatttcccctgataaaattaaagatgccgtcaagtgcatgcatttccgggcatcaaaggctgattgtgtttttaaaggcgactatatactgtcagaggatggccagatagaaatggcactcctatatccggggcatcggtacacccttgttaggatgcgccttaggctcagaggcactacaattggtgcaaataacaggttggatgtactaaagattctaactactggagtgaatgcaactgaattgaaaaactggacaggcagcatacttgaacttgttgagggctgggaggaggatgagacgcacgacccagatgtgcctgccgtttcccacagcaggggtttgtcgccctttgtgtttgtcccgtttgaagaggctgatacttcggtgctaaacctcccagtggagaagatggattactatgtccctgggtgagctactcatggcgacaattatgatggagaatggagattattgatggccctattgccggttcagatgactggagatgataagcgatttcatttcctcacggattcttgctggagcaatatgtaaatacacagtgttgttttatttccccttctgggttgcttgcatgaaattgtatgaataattatacgtgttcgttgatgcttgttgaaaatggggtaggcaagaaataagttcttcctaaagttatgtaggtttgtactataaaacgagtggaaccaccctcctaaagttatgtgggtttgtactatagagacaagcaggctatcgttgtaaactcttgaatctgaatatgtattttttgattgtacagttg

SEQ ID NO: 28886 - protein, 327 aa, Panicum virgatum
  misc_feature: Ceres CLONE 1887830
  misc_feature (57)..(104): Pfam Name: F-box Pfam Description: F-box domain
MASSDISVDIRPDFNSFDHFPSMRYIATDRPWLKLYGIRVQPMPPFRSLSCKPDPALIHHCLPDELLLEIFTRMNPYTLGRAACVCRKWKYTARNPALWRVACLKTWQRSGTEVNYMMVRSLYDSSWRRMWLQRPRIRIDGLYVSRNTYIHTGVTEWQFKKTVNVVCYYRYLRFFPSGKFLYKISPDKIKDAVKCMHFRASKADCVFKGDYILSEDGQIEMALLYPGHRYTLVRMRLRLRGTTIGANNRLDVLKILTTGVNATELKNWTGSILELVEGWEEDETHDPDVPAVSHSRGLSPFVFVPFEEADTSVLNLPVEKMDYYVPG

SEQ ID NO: 28887 - DNA, 705 bp, Panicum virgatum
  misc_feature: Ceres CLONE 1887833
  misc_feature: Encodes the peptide sequence at SEQ ID NO. 28888
atactcaagcagctcaaaacctctatccagctaccaagaaatggctctacttgcttcagccctgatgagtcgtactacccatccaggccttattagaagccacataggacccaatggtgacaatttgtcatggcgcctaccttcaaaagagaagagtaagagaaggtgtgacccgagccttagatcacaagcagaaaggatgagcagcgagcttggacaagaacatctcatgccatcagaaaggatgggaagcgagcttggacaagaacatctcatgccacgcgaaatccctaggagggactggttccaccccggattcgtctttggcgccgccactgcagcataccaaattgaaggtgcttggaatgagcatggcaaggggccaagcacttgggaccacttctgccacaatcatcctggaggaaatcgaagccaagtcagcctataggcaccggttgaaccgacggtccaaaaaaaagggcatcggtgcattgggcgtactatgtaccagagacgatgtcaaagtgcccaggaaaagtttcttcagcaccgattcaaccgacggtgcatcggagtataccatcggtgcaatgacgtcagctgtcaggagaagatccttccagcaccggttgaaccgatgaagcatcggtgcatagcatcggttcaaccggtggtcactgtgtcaacagtcagaagctcaacggc

SEQ ID NO: 28888 - protein, 135 aa, Panicum virgatum
  misc_feature: Ceres CLONE 1887833
  misc_feature: SWISSPROT Homolog: EC 3.2.1.21 Beta-glucosidase
MALLASALMSRTTHPGLIRSHIGPNGDNLSWRLPSKEKSKRRCDPSLRSQAERMSSELGQEHLMPSERMGSELGQEHLMPREIPRRDWFHPGFVFGAATAAYQIEGAWNEHGKGPSTWDHFCHNHPGGNRSQVSL

SEQ ID NO: 28889 - DNA, 2250 bp, Panicum virgatum
  misc_feature: Ceres CLONE 1887883
  misc_feature: Encodes the peptide sequence at SEQ ID NO. 28890
tgctcatgctagtttccgtcgtttcccatcccgtctgctcgctgaaaaaaagaaagaaatttttgacagattgctcgctggaggatagcacatagcaggcatggaaatcaaacaggtttagcgccgggtctgctccgccgctgagggcgcctataaaaatgccctccacggggcacggaggcaacgcccgatcgatcaccgcggctgcactcctgctgcctctccacctccgattcgcctcttcccaccaccgactgccccgtcctcttcacgtcgccgatggagttatccatcctcgccgccgcctcggtggccagggcctctgttccggcaactttcttctcgccgctctcctcgtcctctcggccctccgtcctccgcgccgacgtcgccaggcccagccccgccgcgcgcgccgtccgctgccgcgccgccgaggttccctgcttgcttctttctgctttctcctgttgcctcggattcggatggggtgctccgctgcagcctctgctctggttctttttcttgggagggagatgcatactgcattcttgtttcatttgatggatgggacggcgacaggggtcggtcctgcacaggctggacgacgagatgttaaactcgtcggaggtgatcctgtgggagagcggcaagtccatcaactgtatcgccgccgcgcagggcatccgcatccgccgccgctgccgccccaggtacccctccgagggcgtcggcgccgacagggccgtcccgcgcaacgtcctggagcagatcatctgggacaaggaggtcgaggtgtcgcagaggaaggccaaggcgccgctgcagcgggtgatggagtccgccgagcgcgcgccgccgccaagggacttcgtcggggcgctggacgccgcgcgccgccgcaacggcctccccgcgctcatcgccgaggtcaagaaggcgtcgcccatcaagggcctgctcagggagcacttcaatccggtcgagatcgcacacgcctacaagaaaaacggcgcagcctgcttgagcatcctgaccgacgagaagcactttctagtttggcatttgcttcctgttcttcaagtgctgatgaaattcgctgtggaacttctctgaaacttccgatcttgtgcatgttgaaagtgatcgggtgctctagcctaagagggggagggggtgaattagacactctaaaaacttagacctatggctccaactagtttgcacaaaacttaaactaaaacatgctatctagatgtgcaactaggttattctagtgtgaaacccctatcccaaaagagtttagcaacatatagcctttcctatcaagaaactattcttatgaaagtaaaggcacacaaattgctagtatgaaatgcggaagcttaaagagcgggataggagatagcaaactcttgacgcgggtgtttatcccgtggttcggttagcaacaaaggcacacctacatccacgttgttgtagcactcactaagagtattgctactcggccaccaagtctcttccgtgaacacaatcacggttatcttggccccgggttccactaaggagcttctccacaaaggatgggggtctccacgtccccccgcacaaagtgtcgtcgccgctccacaccaagtcggagggtcgatgacgttgccggtgagcttcacgctccaaggtgccggtgcaccaagatcttgttttggttcactagagaaccacagcacaaaggctcaaggccttgcaatcacactcactaagagctaatctagcactcacactttacaaagctagtgctataagctaaggatatgatctatgagctcttgtatggcttggagatgttcttggatatgtataaggtgtcttgggactccagcaaacttcaaatggccggggtgaggcgtatatattggtcaccaagtcttgtagccgttgctccaacggtcagctgaaaatctgcgtatcaccggaagaaccgatgcctctggcaggggtagcgtcggttctttcggtcactcataaaccgaagtagccgttgaagacctgacagctgacgcagtgaccaccggttgaactgatgctttgtaccgatgcatcaccagttcatccggtgcttaagaatcttctactgggcgctgtcgtcattgcaccgacgcaatactccgatgcaccgtcggttgaaccggtgctgaagaatcttctcctgggcgcttgacatcgtctctggaacataggacactcaatgca

SEQ ID NO: 28890 - protein, 182 aa, Panicum virgatum
  misc_feature: Ceres CLONE 1887883
  misc_feature (65)..(182): Pfam Name: IGPS Pfam Description: Indole-3-glycerol phosphate synthase
  misc_feature: SWISSPROT Homolog: EC 4.1.1.48 Indole-3-glycerol-phosphate synthase
MGRRQGSVLHRLDDEMLNSSEVILWESGKSINCIAAAQGIRIRRRCRPRYPSEGVGADRAVPRNVLEQIIWDKEVEVSQRKAKAPLQRVMESAERAPPPRDFVGALDAARRRNGLPALIAEVKKASPIKGLLREHFNPVEIAHAYKKNGAACLSILTDEKHFLVWHLLPVLQVLMKFAVELL

SEQ ID NO: 28891 - DNA, 297 bp, Panicum virgatum
  misc_feature: Ceres CLONE 1887883-R
ctttggagagtcaaaacaatatcaagtttgaccaagattatagagagaaatataaagatttatgatatcaaattgatgtactatgaaaatataattaataaaaaatctaatggtacttagtttatataataaatgtcattattctattatataaattatgtcaaacataaaaaactgactctccaagattgttggaatgtcttataatttagaacggagggagtatcacgaatatggattattttgttccgtgcatgtattggagtgtctacctatctatccagattgtttataacg

SEQ ID NO: 28892 - DNA, 681 bp, Panicum virgatum
  misc_feature: Ceres CLONE 1887888
  misc_feature: Encodes the peptide sequence at SEQ ID NO. 28893
acaacagccggtgtcctcacctctcctctcccagccgccgtgtcctctcttctcctcgtcctctccctcttgctcgcgcgcgtaggaggagcgcgcaggacgggggtgcgcccatggggaggacgccgtgctgcgacagggcggccgtgaagcggggcccctggtcgccggaggaggacgaggcgctgcgcagctacgtcctgcggcacggcagcggcggcaactggatctccatgcccaagaaagccgggctcaagcggtgcggcaagagctgcaggctgcgctggctcaactatctccgcccggacatccgccacggcggcttcaccgacgaggaggacgccgtcatcatctccctctacagccagcttggtagcaagtggtcgctgatcgcctcgcagctggaggggaggacggacaacgacatcaagaactactggaacaccaagctcaagaggcgcctcctcgccgccgcagccaccgccggcatcgtctccacccgctccccgccatccgttccgcggctaccggcggcgccggcctcggcacctccggccgcggccaccgtcaccacgcacgcgtcatcgctgttcccgttgctcgccatcccgaccgtgaagaccgagatgtacacctgcgacgacttcctggcgccggccgcgttccgggacgacccgttcg

SEQ ID NO: 28893 - protein, 189 aa, Panicum virgatum
  misc_feature: Ceres CLONE 1887888
  misc_feature (14)..(62): Pfam Name: Myb_DNA-binding Pfam Description: Myb-like DNA-binding domain
  misc_feature (68)..(113): Pfam Name: Myb_DNA-binding Pfam Description: Myb-like DNA-binding domain
  misc_feature: Functional homolog of the protein sequence given in SEQ ID NO 51293
  misc_feature: Useful for making plants with modulated nitrogen use efficiency
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: Functional homolog of the protein sequence given in SEQ ID NO 51294
  misc_feature: Useful for making plants with modulated biomass
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 796 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1681 in the 10/374,780 US patent application
  misc_feature: The sequence is a functional homolog of SEQ ID NO 1010 in the 11/435,388 US patent application
  misc_feature: The sequence is a functional homolog of SEQ ID NO 1002 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 794 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 126 in the 10/412,699 US patent application
  misc_feature: Functional homolog of the protein sequence given in SEQ ID NO 50733
  misc_feature: Useful for making plants with altered cell wall content and/or composition
MGRTPCCDRAAVKRGPWSPEEDEALRSYVLRHGSGGNWISMPKKAGLKRCGKSCRLRWLNYLRPDIRHGGFTDEEDAVIISLYSQLGSKWSLIASQLEGRTDNDIKNYWNTKLKRRLLAAAATAGIVSTRSPPSVPRLPAAPASAPPAAATVTTHASSLFPLLAIPTVKTEMYTCDDFLAPAAFRDDPF

SEQ ID NO: 28894 - DNA, 733 bp, Panicum virgatum
  misc_feature: Ceres CLONE 1887911
  misc_feature: Encodes the peptide sequence at SEQ ID NO. 28895
gcgcccggctgcccagcgcgcccctgaggcgttcacccgccgccgtctccttcccctcccgcccacggccggccgcgctggtggcgcgcgccgggcccgcgcggcgcctcgacgtggccgccgccgccgctgcggggcaccagaagctcatggggtcgctgaccagcaacgagaagctcaggtttggtgtggttgtggcacggttcaacgaggttgtgacaaacttgttactgcagggggccctggagacattcaagcgatactctgtcaaagctgaaaatataacagttgttagtgttcctggaagctttgaagttcccatcacggcacaaaagcttgggaagtctggaaaatttgatgccattctgtgcattggagctgtgattagaggggacacgactcactatgatgctgttacaaactcagctgcatctggtgtactgaatgctggattatctgctggcatcccttgcgtatttggtgtactaacctgtgaagacatggaccacgcgctaaaccgtgctggtggcaaggcagggaacaagggcgctgaagctgctcttactgctatcgagatggcctctctgtttcggcatcacttaggttgacacctggcggacttggagtctcaacatttcgtctcatccaccgctaccacagtttgaatttttgcccagtagagctatggctgcacgctagcagttaagctacagctcagaaatggctagtcctg

SEQ ID NO: 28895 - protein, 201 aa, Panicum virgatum
  misc_feature: Ceres CLONE 1887911
  misc_feature (56)..(199): Pfam Name: DMRL_synthase Pfam Description: 6,7-dimethyl-8-ribityllumazine synthase
  misc_feature: SWISSPROT Homolog: EC 2.5.1.9 Riboflavin synthase
ARLPSAPLRRSPAAVSFPSRPRPAALVARAGPARRLDVAAAAAAGHQKLMGSLTSNEKLRFGVVVARFNEVVTNLLLQGALETFKRYSVKAENITVVSVPGSFEVPITAQKLGKSGKFDAILCIGAVIRGDTTHYDAVTNSAASGVLNAGLSAGIPCVFGVLTCEDMDHALNRAGGKAGNKGAEAALTAIEMASLFRHHLG

SEQ ID NO: 28896 - DNA, 1650 bp, Panicum virgatum
  misc_feature: Ceres CLONE 1887919
  misc_feature: Encodes the peptide sequence at SEQ ID NO. 28897
accgccaccgaaagggcagacagccagcagttgaactccgcggcgctctgcttcccctcaaggagaaagctccgcgctctgctcgaaaggctctgcctacctacctacctctcacgcgcgagttcgaatccgggagccatgggcggcggcggcgcgggggcgaacggcggagggtcggcggcgggggcgcgggtgccggtgccggtgccgccggcgcggccgtttctggacacgttccgggcgaacctcaaggagaccttcttcccagacgacccgttccggtccgtggtgcgggagcgcggggcggcgcggcggacgctggcggcgctgcgctacttcttcccgttcctcgagtgggcgccggcctacacgctgggcgccttcagggccgacctcgtcgccggcatcaccatcgccagcctcgccatcccgcagggcatcagctacgccaagctcgccaacctgccgcccatcctcggcctttactcgagcttcgtgccgccgctggtgtacgcgctgatggggagctccagggacctggccgtggggaccgtggcggtggcgtcgctgctcatcggctccatgctcggcagcgaggtgtccccgacggagaacccggctctgtacctgcacctcgccttgactgccaccttcttcgccggcgtcttccaggcctcgctcggcctcctcaggttgggcttcatcgtggacttcctgtcgcacgcgacgatcgtggggttcatgggcggcgcggccacggtggtgtgcctccagcagctcaagggcatcctgggcctcgagcacttcaccacctccaccgacgtcgtctccgtcatggactccgtcttctcccagactcaccagtggcggtgggagagcgtcctgctcggcagcggcttcctcttcttcctcctcgtcacccgcttcatcagcaagaggcggcccaaactattctggatatccgcggcggcgccactgacttcggtcatccttgggagtgtcctggtgtacctcactcatgctgaaaaccatggcatccaagtgattggttacctgaagaagggtctgaacccaccatcagtgacaagcctgcagttctcgccaccttacatgatgctcgcgctgaagaccggcatcatcaccggcgtcattgccctcgctgaaggcattgcaatacggaggagcttcgccatgttcaagaactacaacattgatggcaacaaggagatgatcgccatcggaacgatgaacatcgtcggatcattcacatcctgctacctcaccaccggtccggtctcgcagtccgccgtgaactacaacgccgggtgcaagacggccatgtcaaacgtggtcatgtcactggcggtgatgctgacgctgctgttcctgaccccgctgttccactacaccccgctggtggtgctgtcggcaatcatcatctcggcgatgctggggctgatcgactaccagggcgccttccacctgtggcaggtcgacaaggtggacttctgcgtctgcatgggcgcctacctcggcgtcgtcttcggcagcgccgagatcggcctgggcgtcgcggtctccatattcatcctccgggtgatgctctgcatcccgcgcccgaggacgacgatgctcggcaactttccccga

SEQ ID NO: 28897 - protein, 503 aa, Panicum virgatum
  misc_feature: Ceres CLONE 1887919
  misc_feature (181)..(491): Pfam Name: Sulfate_transp Pfam Description: Sulfate transporter family
MGGGGAGANGGGSAAGARVPVPVPPARPFLDTFRANLKETFFPDDPFRSVVRERGAARRTLAALRYFFPFLEWAPAYTLGAFRADLVAGITIASLAIPQGISYAKLANLPPILGLYSSFVPPLVYALMGSSRDLAVGTVAVASLLIGSMLGSEVSPTENPALYLHLALTATFFAGVFQASLGLLRLGFIVDFLSHATIVGFMGGAATVVCLQQLKGILGLEHFTTSTDVVSVMDSVFSQTHQWRWESVLLGSGFLFFLLVTRFISKRRPKLFWISAAAPLTSVILGSVLVYLTHAENHGIQVIGYLKKGLNPPSVTSLQFSPPYMMLALKTGIITGVIALAEGIAIRRSFAMFKNYNIDGNKEMIAIGTMNIVGSFTSCYLTTGPVSQSAVNYNAGCKTAMSNVVMSLAVMLTLLFLTPLFHYTPLVVLSAIIISAMLGLIDYQGAFHLWQVDKVDFCVCMGAYLGVVFGSAEIGLGVAVSIFILRVMLCIPRPRTTMLGNFP

SEQ ID NO: 28898 - DNA, 389 bp, Panicum virgatum
  misc_feature: Ceres CLONE 1887919-R
aagatcaggaaaagcatttcagcgttcccctccctgaggacgccagcattgtgggcttctttggaactgctgagaaccatcttgatgcgatcggcgtttacgtgagccatttcatctcaaactagtccgagcggccacctgcttgaaaaggcacctcaaattaaataagtcaggacttgcgtcctcagcgagttcagctttccagtactttgtttcagcagaaataaagatgatcatgcatgatatgagcgtggtctgtacttgtttgccacagcaggggcggtcctgcggatcccttgttgacgacggtgtaatgcgagtgtttttgtttcatgtcgagagtgctttaattttgttgtaacctgtgatgtggaataaaatttctgtgc

SEQ ID NO: 28899 - DNA, 1888 bp, Panicum virgatum
  misc_feature: Ceres CLONE 1887966
  misc_feature: Encodes the peptide sequence at SEQ ID NO. 28900
agcgctcccaaccactcccaccactgttcctcccctctctcgagctgggagacgatatcctaaactccaaagcagcagcggaggggaaagcaacaagccaagcgatcgatcatccggaagacgccgggagcgagaggcacaaagatacacggcgcctgccatgtcgcctctccgtgacctggactggtcggtcatcacctgagagagagtagagtccgaccgacgaggggaaggtagctgccagtttgggcaagagtggtgagtgagtcaagggggcaagaagagagcggtttgttttcttccgatggcggccgcctcgtccgcgcccttcttcgggctcggcgacacgcagatgcagccgccccagggcccctctctgcagcagaactccgcggcggccgcgcccggcgccgccgccgcgccgccgaagaagaagaggaaccagcccggcaatccaaaccccgacgcggaggtgatcgcgctgtcgccgcggacgctgctggcgacgaaccggttcgtgtgcgaggtgtgcaacaaggggttccagcgggagcagaacctgcagctccaccggcgcgggcacaacctgccgtggaagctgaagcagaagaaccccaaggaggcccggcggcgggtgtacctgtgcccggagccgacgtgcgtgcaccacgacccgtcccgggcgctgggcgacctcaccgggatcaagaagcactactgccgcaagcacggcgagaagaagtggaagtgcgacaagtgcaacaagcgctacgccgtgcagtccgactggaaggcgcactcgaagacctgcggcacccgcgagtaccgctgcgactgcggcacgctcttctccaggagggacagcttcatcacccaccgtgctttctgcgacgcgctggctcgtgagagcgcgcagatgccgccattgggcgccggcctctacgtcggctccggcagcatgagcctcgggctctccggcgccgccgcccagatgcatggcttcgcggaccatgccggccagtcctcttcagcagcagcagcagcagcagccgctcaattcgaccacatcatgccaccgtcctcgggcccctctttgttccgttctcaggtgtcggcctcctcgtcgtctttcttcctcggcggcggcggcaacgccgatcacagcagcgtgatggcgtccatgggaagccacctcagctgcagcagcttcccctcttcgctgtacaactcatctccatcggccggcctggcgcagaactcggcgacggcgctcctgatgaaggcagcccagatgggctcgacgtcgagcgcgcagaacggccccagcgcgctgctccgcgccgccggcttcagcgccgccagcggccagggcactagcagggccgcaggagaagggacgtcgcacgaggcgcacttccatgacctcatcatgaactctctagcgggaggcagcggcggcgggggcggcttctccggcggcggcgcagggttcggcgccgtggacgacggcaagctgagcacgagggacttcctcggcgtcggcaggggcgcgatggcgccgcccgggctccatatcggcgcactggacccggcccagatgaagtgatcgatcgatgtgacgataggatcagggagtgaacaacaacaagaagaacaaaacaaggagaagatgcaagagaaccaagaagtctcaataaacagacgggcgcgtgcacgtgaaaccgagctttcgcgtgcatggaccatggagaaggtgagctaatgagggatcggagataccaagtaaacttaatctaacttcatcatgcaacttgattttgctattccggtacaatttcgtggagtttaactttcaagtgcttagttaatataattaaacttttggctg

SEQ ID NO: 28900 - protein, 433 aa, Panicum virgatum
  misc_feature: Ceres CLONE 1887966
  misc_feature (71)..(93): Pfam Name: zf-C2H2 Pfam Description: Zinc finger, C2H2 type
  misc_feature: Functional homolog of the protein sequence given in SEQ ID NO 51295
  misc_feature: Useful for making plants with altered lignin content
  misc_feature: Useful for making plants with altered terpenoid content
  misc_feature: The sequence is a functional homolog of SEQ ID NO 1524 in the 10/666,642 US patent application
  misc_feature: The sequence is a functional homolog of SEQ ID NO 1087 in the 10/666,642 US patent application
MAAASSAPFFGLGDTQMQPPQGPSLQQNSAAAAPGAAAAPPKKKRNQPGNPNPDAEVIALSPRTLLATNRFVCEVCNKGFQREQNLQLHRRGHNLPWKLKQKNPKEARRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYVGSGSMSLGLSGAAAQMHGFADHAGQSSSAAAAAAAAQFDHIMPPSSGPSLFRSQVSASSSSFFLGGGGNADHSSVMASMGSHLSCSSFPSSLYNSSPSAGLAQNSATALLMKAAQMGSTSSAQNGPSALLRAAGFSAASGQGTSRAAGEGTSHEAHFHDLIMNSLAGGSGGGGGFSGGGAGFGAVDDGKLSTRDFLGVGRGAMAPPGLHIGALDPAQMK

SEQ ID NO: 28901 - DNA, 657 bp, Panicum virgatum
  misc_feature: Ceres CLONE 1887970
  misc_feature: Encodes the peptide sequence at SEQ ID NO. 28902
aaccctcccctcgccccccaataaaaaaaaaccctccatctcccacctccgcctccgcctcggcaggcactgccaatctcctctcccctctccctctccctcctcgatcccaaggcgagagaccagggaacccgagacgaccgcgcgcacgagccgctgcagtgagtgacctcgcaacccgcgcgcgtgagaggggagatcgagcagaaggtgccgggacccgaccgagccgaggactcgagaccatgaagtacgtgctggtgaccggcggcgtcgtgagcgggctgggaaagggcgtgacggccagcagcatcggcgtcctgctcaaggcctgcggcctccgcgtcacctccatcaagatcgatccatacctcaacaccgatgcaggaaccatgtctccgttcgagcatggcgaagtgtttgttttggacgacggtggtgaggtggacttggaccttggaaattatgaacggtttctggacatcaagttgactcgtgacaacaacataaccacgggaaagatctaccagtctgttattgacaaagaacgtagaggagattacctgggaaaaactgttcaggttgtgccacacatcacagatgaaatacaagtgtggattgaacgtgtcgcaatgaatccagttgatggcacagaag

SEQ ID NO: 28902 - protein, 137 aa, Panicum virgatum
  misc_feature: Ceres CLONE 1887970
  misc_feature (1)..(137): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQSVIDKERRGDYLGKTVQVVPHITDEIQVWIERVAMNPVDGTE

SEQ ID NO: 28903 - DNA, 955 bp, Panicum virgatum
  misc_feature: Ceres CLONE 1887982
  misc_feature: Encodes the peptide sequence at SEQ ID NO. 28904
gtccgcagctaagtctgagcggctgcagctcgctcttctctctgtccagcaccagcacgagccgcgacaacgacagcgctgccgcggcgcccgtgccgccaccgccgccgtctctccacccgctgcccccaggccgccctcttctgtcgctcagcgtcggcggcggtggggaggaggaacaggaggatgaggaggagtacctgctgggcggcctggatctgcagctgactggggccggcggcagcaacagcagcggctgctgcgacggcgacgacgagcgcaagaacatccggatgatgaagaacagggagtccgcgctccgctccagggcaaggaagagggcgtatgtgcaggagctggagaaggaggttcgtcgcctggtgaatgagaacctcaagctcaagaggcagtgcaaacaagtacacgacgggctaggccaatctcatctttctttctttctttctttctttctaggcttgtctgtattctctgcacaacacaatcaacctaaccttgtctgtattttgaatacttcatataatgcagctccaagtggagatggctgcactgatccagccaagcagcagcaggagtaacccccacatcagaagagctgcctcctccactcagctctagctccttacttgttatgtttccttgcaaaattttagtatcttcgtcttcattagctacaactccttggactgtggtacaaggggcgtaaaaataatcatcctcttgccaatgcctcgattatgtcagttgcatctactacagcttctgctgatccagcacctgctctttcccaagacctaccgaggaagaaggccaagaagcaggatccatcatggatgaggacaagctagctagactgcttcttctctgatgatctgatccatgaatgtgcagtgcttgggagttgaatggaattagctgacacgagatccgttgacgg

SEQ ID NO: 28904 - protein, 197 aa, Panicum virgatum
  misc_feature: Ceres CLONE 1887982
  misc_feature (89)..(141): Pfam Name: bZIP_1 Pfam Description: bZIP transcription factor
  misc_feature: The sequence is a functional homolog of SEQ ID NO 933 in the 10/374,780 US patent application
PQLSLSGCSSLFSLSSTSTSRDNDSAAAAPVPPPPPSLHPLPPGRPLLSLSVGGGGEEEQEDEEEYLLGGLDLQLTGAGGSNSSGCCDGDDERKNIRMMKNRESALRSRARKRAYVQELEKEVRRLVNENLKLKRQCKQVHDGLGQSHLSFFLSFFLGLSVFSAQHNQPNLVCILNTSYNAAPSGDGCTDPAKQQQE

SEQ ID NO: 28905 - DNA, 714 bp, Panicum virgatum
  misc_feature: Ceres CLONE 1887986
  misc_feature: Encodes the peptide sequence at SEQ ID NO. 28906
ctcaaaaaacaggccccctttgagccaaaccccggagaaaccctaggaaagctctcaggggcggcgcagcatccgcgacgaacgatggctggctaccgcagccggagtccgagccggagctatagccctcggaggcgatacagccggagccctcctaggcgcaagcgctacgacgacccccgcgaccgctaccgcgggggtgggggcggcggaggcggagcccggcgtgggtacggtcggccgtcggcgcagtccggtctcctcatccgcaacatctccatcacagccaggccagaagatattcgtgttccctttgagcaattcggccctgtaaaggatgtctatcttccaagaaacttccacaccagggaacttcgtggtttcggatttgtgaaattccgctaccccgaggatgctgcggtggccaagcaagagatgaatcatcaagttattggtggccgagagatttcaatagtttatgctgaagagaatagaaagacaccccaagaaatgcgcatgagaacaagaataagtggtaggtatatggacagaaggtacacaaggcgatcagtatctagatctccaagatctcattcccactcttattcacccacaccatctcctgttaggcgtgacttcaggggcagggacagccgtgacaattactcccctggggggtcatactctccgcgtcctcagaataacaggcactac

SEQ ID NO: 28906 - protein, 209 aa, Panicum virgatum
  misc_feature: Ceres CLONE 1887986
  misc_feature (59)..(130): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYRSRSPSRSYSPRRRYSRSPPRRKRYDDPRDRYRGGGGGGGGARRGYGRPSAQSGLLIRNISITARPEDIRVPFEQFGPVKDVYLPRNFHTRELRGFGFVKFRYPEDAAVAKQEMNHQVIGGREISIVYAEENRKTPQEMRMRTRISGRYMDRRYTRRSVSRSPRSHSHSYSPTPSPVRRDFRGRDSRDNYSPGGSYSPRPQNNRH

SEQ ID NO: 28907 - DNA, 2498 bp, Panicum virgatum
  misc_feature: Ceres CLONE 1887993
  misc_feature: Encodes the peptide sequence at SEQ ID NO. 28908
gcgcctccaaatccaaacccaaaatcccaccaaatcccccccgaatttcccccaaaccgcgtccaaaccccccgccccgtcctccccccgaattcgtttcgaaatcagaccgacgcgaccggggctctggccgccccccgccctgccttcgcctcccatggcgtttcacgtcgcgtgccccatcacttgcaggagggtgtgcgactgcgagctagggttcggcgcggcggcggcggcgaggaagggggccggcgcggcggcggcggcggcggcgtgggcgggcgcggcggcggcgctcgagggcttcctcgcggatccgtggctgctgcggccacccggggccggcgcgggggatggggcgacggtgcaggtggaggtgccgccgctggacccgggccccgaggacggggagggcgaggcgcgccgggcggcggcgcagcgcggcgccgacgcggccgaggacctcgccaggcggctcgagagcggcgcctacggatcgccggaggcggaaggagatgaagatgagtgggaccgggaggatcaaggaaatgcttctgtcaaggttatgtgccgtttatgctgttttggagaaaatgagggcagcacaaaagctgccaaaatgcttccatgcaagctctgcaacaaaagatatcataggaactgtttgaaaagctggggggagcatagagatcttttccactggagctcatgggtctgtccgtcttgccgcagttgtgaggtatgccggcggcctggtgaccctaataagttgatgttctgtaaaaggtgtgatggtgcgtatcactgttactgtcagcaaccatcacacaagaatgttacccatggaccatatttatgtccaaaacatacaaggtgtcacagctgtggatctggtgtgcctggtagtggccatagcacaaggtggtttttggggtacacatgttgtgatgcttgcgggcgattgtttgtgaaaggaaactactgcccgatttgcttgaaggtttatagagactctgaagtgatacctatggtttgctgtgatgtttgtgaaaaatgggtgcatattgagtgtgatggcatcagtgaggaaaaataccaacagttccaagctgaccaaaaccttcagtacacatgtgcagcatgccgtggcgagtgctcccagatcagggacactgaggatgcaattcgggagctttggaagaggagggacgttattgatcaagaacttatggttagcttgcgagctgctgctgcattaccttctcttgaagatgtctctccatcgtatccaaactcggatgaagagaaacctgctccgtatgtattgaaaaatgatggtaggaatactttaaagttttcattgaaaagcaacagtagtaaggctccagatacacctgagcaagagaagattgttttgaagagctccgggtcgaataagaagccttccaaaaagaaaggtggtcagggtaataaaacagacgatggccatgatgaaatatttttggagagaaggcatgatgctaaatcttcaaatagccgtttgggagatcaaagtatagatggtaatcatgataggagtccttttaagaatgatggtaatgcttatatttcatcttcaactcgaagttcagaaaagaatttgaaatctccatccatgaaagctgtggcaaacaatgctgatatgatacctaaagtcaagattaaaggcagtaaggttccaggtttacatttcaaagacgcagctgataaaagtactcccaaggatactgggaaaggtaccaagttggttatccatcttggttcacggcacaaaaccaggagtggctctcccaagtctgaactatccgattctcaaaaagaccaagatatgggttcgatacatggagggaaaatagatgtcacaagccagctgaagagctcaaggagcgagataaaagagaaaagtgtaatgaagctagttagagagaccggaacacagcaaagaaatagccttttgggagatcttggtacctcaaaaaagcatgcaactggaaaaagaagtaattctttaatctctggaatggaaaatgcaaataaaactggtacaaggaacagatcatttggactcaaacaatctcattccagtcatgtgaacaagaaccagggagctgctgctttattttcatctgactcttctgacaacttgaagccatcattgctgaaacttaagtttaagcgtccccatttcgagcagctgaacacccaggcttctcaaccagaggagccagccacctgggcttcacagcaagaggaacagttaaatgttgctaaaggccagagatcaaagaggaagagaccttcaatggagaaggtggatgattcagatggtaagattccggccaagaggcatcagcagagcacaaatgatgaagtgatggacgctaactggatactgcgcaagttgggcaaggatgcaattggaaagaggattgaggtccatcaagcttctgatgccaatg

SEQ ID NO: 28908 - protein, 780 aa, Panicum virgatum
  misc_feature: Ceres CLONE 1887993
  misc_feature (275)..(332): Pfam Name: PHD Pfam Description: PHD-finger
  misc_feature (194)..(240): Pfam Name: PHD Pfam Description: PHD-finger
  misc_feature (140)..(193): Pfam Name: PHD Pfam Description: PHD-finger
  misc_feature: SWISSPROT Homolog: EC 2.1.1.43 Histone-lysine N-methyltransferase
MAFHVACPITCRRVCDCELGFGAAAAARKGAGAAAAAAAWAGAAAALEGFLADPWLLRPPGAGAGDGATVQVEVPPLDPGPEDGEGEARRAAAQRGADAAEDLARRLESGAYGSPEAEGDEDEWDREDQGNASVKVMCRLCCFGENEGSTKAAKMLPCKLCNKRYHRNCLKSWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPICLKVYRDSEVIPMVCCDVCEKWVHIECDGISEEKYQQFQADQNLQYTCAACRGECSQIRDTEDAIRELWKRRDVIDQELMVSLRAAAALPSLEDVSPSYPNSDEEKPAPYVLKNDGRNTLKFSLKSNSSKAPDTPEQEKIVLKSSGSNKKPSKKKGGQGNKTDDGHDEIFLERRHDAKSSNSRLGDQSIDGNHDRSPFKNDGNAYISSSTRSSEKNLKSPSMKAVANNADMIPKVKIKGSKVPGLHFKDAADKSTPKDTGKGTKLVIHLGSRHKTRSGSPKSELSDSQKDQDMGSIHGGKIDVTSQLKSSRSEIKEKSVMKLVRETGTQQRNSLLGDLGTSKKHATGKRSNSLISGMENANKTGTRNRSFGLKQSHSSHVNKNQGAAALFSSDSSDNLKPSLLKLKFKRPHFEQLNTQASQPEEPATWASQQEEQLNVAKGQRSKRKRPSMEKVDDSDGKIPAKRHQQSTNDEVMDANWILRKLGKDAIGKRIEVHQASDAN

SEQ ID NO: 28909 - DNA, 498 bp, Panicum virgatum
  misc_feature: Ceres CLONE 1887993-R
tcaattagataatggcagatctgagaatgtggaactggggaagcaggccatccgcttgatagctgggtcaaagggcaagaagcgatgaagcctcccatattgatgctgagggcatgtccccactcaaaactcattgccatgaatgttgcaggcagagtcttggcacccactgaagcgcagcagtgcgaccgccgccgttcatagcgggttctcttcatctcatattctcatcacctttgctgactggacgggacatgggagcgcaacatgcgatgttgtggccatgtttcgctagcctagcttgtaacaaactctctagtttttcgtgttggtgctgtttgaagcccattggcttccattagattctagcagcgtagggaaaccggagagattttggatcaccatggtgcccgggaagcgccgtgccaaaatttgtcgtgcacatgtagctgtcagattatttttttttccgaataatattttgtcattgttattttc

SEQ ID NO: 28910 - DNA, 732 bp, Panicum virgatum
  misc_feature: Ceres CLONE 1888013
  misc_feature: Encodes the peptide sequence at SEQ ID NO. 28911
ataggaacgctcgtctcacctgtcagccgaaagccaatggggtcagcatcctgcgccgccgccgtgcgcgcgctgggcgtagccgtggcggccgcgctcctggcgtgccggtgcgcggcgcagccgtcgggctccggctgcatgccggagctggtcggcctgtcgccgtgcatggactacctgtcgggcaacgccacgacgcccgacgtgccgtcgtgctgctcggcgctctcgggcatgctgaggtcgagcccgggctgcctctgcacggtgctcggcggcacggccacgtcgctcggcgtcgccgtcgacggcgcccgcgtggcgcagctgcccggggcgtgcaaggtccaggcgcctcctgccacccagtgcaacggtgagtgcgcgcgtccagcttcacgcattagaggcaatggcaaagagattgacacgagtcgcgcgttgtttgtgcagccgtgggagctccagtggcgtctccggcggcgccgtcagacgccaacgcgacccctgcaggagggtctggatcgaagtctacaccagcatccacccttccatactctgacggaaatactgggaggcctggaaggatcttcgtattcgccgcagcagcactggcgttgctccatcgtttgtgagatgaatcagatgacgcgaaagcttcttgtgttcgtctccgagcgaccgaatcgtttccacgagcagcttgtacagtttgggggtgctgttgct

SEQ ID NO: 28911 - protein, 231 aa, Panicum virgatum
  misc_feature: Ceres CLONE 1888013
  misc_feature (35)..(113): Pfam Name: Tryp_alpha_amyl Pfam Description: Protease inhibitor/seed storage/LTP family
MGSASCAAAVRALGVAVAAALLACRCAAQPSGSGCMPELVGLSPCMDYLSGNATTPDVPSCCSALSGMLRSSPGCLCTVLGGTATSLGVAVDGARVAQLPGACKVQAPPATQCNGECARPASRIRGNGKEIDTSRALFVQPWELQWRLRRRRQTPTRPLQEGLDRSLHQHPPFHTLTEILGGLEGSSYSPQQHWRCSIVCEMNQMTRKLLVFVSERPNRFHEQLVQFGGAV

SEQ ID NO: 28912 - DNA, 744 bp, Panicum virgatum
  misc_feature: Ceres CLONE 1888035
  misc_feature: Encodes the peptide sequence at SEQ ID NO. 28913
cgagcttgtttcatttgtgaaggataaggagtcatgggactaaaacaatgaagagaagattgaggctgctggcaagaagaaagaagaagggaatgcactgttcaagttgggcaaatatgctagagcttcgaagcgttatgagaaggctgcagagttcattgagtatgacagttcattcagtgaagatgagaagaagcaatccaagcaactgaagatcagctgcaacttgaacaatgctgcttgcaaactgaagctgaaggactacaagcaagctgagaagctttgcaccaaggtgctggaactagacagccaaaatgtcaaggccctgtacaggagggtccaagcctacatgcaacttgctgacctagaactagcagaggccgatatcaagaaggcgttggaaattgatcctgacaacagggatgtaaagttggaatacagggccctgaaggagaagatcaaggagtacaacaagaaggatgccaaattctacagcaacatgttcgctaagatgacaaagtaactggctggaagacagtaaaccttttggatcgggggatgtactgaagcagaggatcaacaaagcctgccgttcctgctgcccaaggacttccctagtttgacatttcgctttctggcctactgtttaatctactaaagcgcatggacgattgcatctgttagaacttagaacagagatgaggaacatttacttcgaggaccactattggctgattggctccg

SEQ ID NO: 28913 - protein, 57 aa, Panicum virgatum
  misc_feature: Ceres CLONE 1888035
  misc_feature: SWISSPROT Homolog: EC 5.2.1.8 Peptidylprolyl isomerase
MQLADLELAEADIKKALEIDPDNRDVKLEYRALKEKIKEYNKKDAKFYSNMFAKMTK

SEQ ID NO: 28914 - DNA, 682 bp, Panicum virgatum
  misc_feature: Ceres CLONE 1888036
  misc_feature: Encodes the peptide sequence at SEQ ID NO. 28915
aggctaagtgtccatccacaacatacatcttgcacacaacatactagcaatctcgtctctgtagcatttgaagaactccaacgaaaatgctgttgcagaactcggtggtgaagatcggcccctttggcagcacctccgaggctgagggcaatcgcgacatcaccgtagcgccgctgcgcctggagagcatcaccatccgccatgggaatgtgctcgacgccctctccttcacctacaaggactgccacgggctgcagcacaccacaggccaatggggcggcgacggcggcaactccaccacaattacccttggccctgacgagttcgtgacgggagttcacgggctctacggcttctacggttacgggagcgacggcgtcaccggcttcaccatcgtcaccaacctccggacctacggaccgttcggagtcagtgactccatcaaggaacccaagtccttcgacatccccgtcatgaacaacggcagcatcgtcggcttcttcgcccaccgcaacaaggcctacgtcacggccatcggtgtctacgtcaagcccttctgatgattgtcatgtgcttggcaaaatcgatcatgaacctgctgtttaatttgggcgttcagctgttgtgtgtatgcttgataaaataaactgggatctgatgtcatctcactatcccagcccgt

SEQ ID NO: 28915 - protein, 157 aa, Panicum virgatum
  misc_feature: Ceres CLONE 1888036
  misc_feature (21)..(156): Pfam Name: Jacalin Pfam Description: Jacalin-like lectin domain
MLLQNSVVKIGPFGSTSEAEGNRDITVAPLRLESITIRHGNVLDALSFTYKDCHGLQHTTGQWGGDGGNSTTITLGPDEFVTGVHGLYGFYGYGSDGVTGFTIVTNLRTYGPFGVSDSIKEPKSFDIPVMNNGSIVGFFAHRNKAYVTAIGVYVKPF

SEQ ID NO: 28916 - DNA, 942 bp, Panicum virgatum
  misc_feature: Ceres CLONE 1888057
  misc_feature: Encodes the peptide sequence at SEQ ID NO. 28917
atcaccgcgagctaaaacccttgctctccccgcccagccatcgctgcttccgcttctgctcctgcttctcccgccccgcctacgcggccaccacgcctcttcctcctcctcttccttgtcggagcatcggatcagctgcttaatttccatggggatggagatggagatggacaaggagaaggagatggagaccgatcccgatctcaatcccaatcccagtccttccccctcgcccgacaactcggccaaggcctgcgccgactgccacaccaccaagactccgctctggcgcggagggcccgagggacccaagtccctctgcaacgcctgcggcatccgctaccgcaagaggaggagacaggccctcggcctcgacgccgccgacgcgcagcaagatcaccaccagcgcaagaacaaggccgccgatccgcacgaggatcagcagcagccgaaaaggaaggccgccgccgccgccagcagcaccaccaccaccaagaaagacaaggacaagaagagaaaggatcggcaagtcaccgtggagctccgcgtggtgcctttcggcaaggaggtgatgctcaagcagcgccgccagatgcgccgcaacaagtgcatgagcgaggaggagagggcggccgtcctcctcatggcgctgtcgtcgggcgtcatctacgcctcatgattccatccaacctgctgctgcctatcccccaagtgcccctttttctccgatcgagatcagatcatctgtagcactactagttagtgggagccgaagctgaacaacaagactccttgcatcctcccaataatcctgcctttagctcattcatctgtaatgctcgctctatgtaactgtaatctccagccagtcctgacccgacccagcagacaccagacagcaagtgtaacaaaggtcatcgtctcttcttgttgcaacgctcc

SEQ ID NO: 28917 - protein, 170 aa, Panicum virgatum
  misc_feature: Ceres CLONE 1888057
  misc_feature (30)..(65): Pfam Name: GATA Pfam Description: GATA zinc finger
  misc_feature: Functional homolog of the protein sequence given in SEQ ID NO 51296
  misc_feature: Useful for making plants with altered terpenoid content
  misc_feature: The sequence is a functional homolog of SEQ ID NO 1054 in the 10/666,642 US patent application
MDKEKEMETDPDLNPNPSPSPSPDNSAKACADCHTTKTPLWRGGPEGPKSLCNACGIRYRKRRRQALGLDAADAQQDHHQRKNKAADPHEDQQQPKRKAAAAASSTTTTKKDKDKKRKDRQVTVELRVVPFGKEVMLKQRRQMRRNKCMSEEERAAVLLMALSSGVIYAS

SEQ ID NO: 28918 - DNA, 472 bp, Panicum virgatum
  misc_feature: Ceres CLONE 1888102
  misc_feature: Encodes the peptide sequence at SEQ ID NO. 28919
acatcgctccctctccctctcccccacagcaggctagctagggttttctggggtttgcgagggggttgatccggtccggcgggaggggggagatggcggcggagcgggctcaggggacggtgaagtggttcaacgggaccaaggggttcggcttcatcagccccgacgacggcggccacgacctcttcttccaccactcctccgtcaaggccgacggcttccccaacctcaaggacggtgacgccgtcgagttcaccgtcggcgccgacaacgacggccgcgccaaggccatcgacgtctccgcgcccggcggcggcgcgcttgccggcagggagcgcccggacagctgctacagcagacgccgtggcggcggctactgcggcggaggcgacctcggctactgcggaagaagtgactccagatactagcagacgctgcaacctgcatctccggctgaggcggcaacctcctc

SEQ ID NO: 28919 - protein, 111 aa, Panicum virgatum
  misc_feature: Ceres CLONE 1888102
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
MAAERAQGTVKWFNGTKGFGFISPDDGGHDLFFHHSSVKADGFPNLKDGDAVEFTVGADNDGRAKAIDVSAPGGGALAGRERPDSCYSRRRGGGYCGGGDLGYCGRSDSRY

SEQ ID NO: 28920 - DNA, 2418 bp, Panicum virgatum
  misc_feature: Ceres CLONE 1888126
  misc_feature: Encodes the peptide sequence at SEQ ID NO. 28921
ctcgccgtcgctgcttccgcctcccgtccggccgtcccccctttcccctccacctcggttgcccgccggccatctctctgctggctcccgcgtcgcccatgtgcccacccgcatcgtaattttgtgtgccggcgcgcaattgaagccataaacacagttgattcttaattttcaaatcaaatggagagatcttacgcgtcaaggagctccggcgaactagccacagcgtccggaggcggaaggccggtgaaagtgataccgctgcggcacccaccgggttttgggtcgctctcctcctcctcgcagccctggtggtgggcggcggtgggaagggctcggggcatgaggccagtggaatgggcagaggcggccctgccgtgcgtggcgtggatgcagaagtacaggtggaaggaggacctccaggctgacctcgccgcgggcatcaccgttggcgtcatgcttgtgccccaggcaatgtcatatgcaaagctggctggccttcacccaatttatgggctctacacaggctttgtcccgttatttttatatgcaatatttggctcatcacgacaactagcagttggtccagtggcacttgtttctctgcttgtatccaatgttcttgggggtatagttaattcatctagtgaactgtacacagaattagccatattgcttgcattcatggttgggatattggagtgcttgatgggattgctaaggcttggttggcttattcgtttcattagccattctgtaatatctgggttcactacagcttcagccattgttattggtttatcccagatcaagtatttcttaggttacaatgtcacaagaagcagcaaaattataccacttattgagagcataattgcaggagctgatcagttctcctggcctccatttgtcatgggatcaacttttcttgtggttcttctaactatgaaaaatcttggaaaatctaataagagattgcgtttcctaagagcttcaggccctcttacagcagttgtgcttggaacaatttttgttaaaattttccatccaccagccataccagtggttggtgaaataccacaaggtcttcccaagttctccattcctcgaggatttgagcatgtattgtcgcttacgccaacagcagtacttatcactggtgttgctattttggaatctgttggtattgctaaagctttggcggcaaagaatgggtatgagttggactccaacaaagagttatttggtttgggtatagcaaatatttgtggttcattcttctctgcatatcctgccacaggctctttttctaggtcagctgtgaatcatgaaagtggggcgaaaaccgggttatctggaatcataatgggcaaaatcattggtggtgctctcttgtttatgacaccgttatttagtgacatacctcagtgtgcattggctgcaattgtgatttctgctgttactggactggtagattatgaagaggccatcttcttgtggggtattgataagaaggatttctttttatgggcaatcacatttatcacaacattagtttttggcattgaaattggtgtccttgttggggttggattctcattggcctttgtgatccatgagtcggcaaatccgcatatagctgtgttggctcgtttacctggcaccactatatacaggaatatattacagtaccctgaggcctatacgtataatgggatagtagtagttcgaattgatgcacccatctactttgccaacattagctacatcaaagacaggttgcgtgagtatgaactcaacctttcaaattcaaacaggggacttgacgttggaagggtctattttgtgatcctcgagatgtcccctattacatatattgactcgagtgctgttcaagctcttaaagacttgcaccaagaatacaaagcacgccatattcagattgccatagctaacccgaaccgacaggtgcacctacttctatcaagatcaggtatccttgacttgataggagctgcgtggtgcttcgtgcgagtgcatgatgctgtgcaagtatgcctacagcatgtgcagaatgcatcttctagtgcattgaagctggcttcacaggcatcaggggactcggcagattccatttcaacttctaaggaagagcagcagcgtataaagcaggatggcttcttcaagaacttatgcaaggcaaagaacgggaacgctgactccggtactgaagtgcaaccactgctccgacaaaatcttgtgtaatagtaatactacgtggtgggactcactcccctcactgacctatgtgtgtgtgtgtgtgtgtgtgtgtgtgtgtgtgtgtgtacgtatttatttgtcgttgttaacttgttactgtgacatgaagagaagaaagggaaacgcgccgttgttatt

SEQ ID NO: 28921 - protein, 694 aa, Panicum virgatum
  misc_feature: Ceres CLONE 1888126
  misc_feature (177)..(481): Pfam Name: Sulfate_transp Pfam Description: Sulfate transporter family
  misc_feature (504)..(622): Pfam Name: STAS Pfam Description: STAS domain
MERSYASRSSGELATASGGGRPVKVIPLRHPPGFGSLSSSSQPWWWAAVGRARGMRPVEWAEAALPCVAWMQKYRWKEDLQADLAAGITVGVMLVPQAMSYAKLAGLHPIYGLYTGFVPLFLYAIFGSSRQLAVGPVALVSLLVSNVLGGIVNSSSELYTELAILLAFMVGILECLMGLLRLGWLIRFISHSVISGFTTASAIVIGLSQIKYFLGYNVTRSSKIIPLIESIIAGADQFSWPPFVMGSTFLVVLLTMKNLGKSNKRLRFLRASGPLTAVVLGTIFVKIFHPPAIPVVGEIPQGLPKFSIPRGFEHVLSLTPTAVLITGVAILESVGIAKALAAKNGYELDSNKELFGLGIANICGSFFSAYPATGSFSRSAVNHESGAKTGLSGIIMGKIIGGALLFMTPLFSDIPQCALAAIVISAVTGLVDYEEAIFLWGIDKKDFFLWAITFITTLVFGIEIGVLVGVGFSLAFVIHESANPHIAVLARLPGTTIYRNILQYPEAYTYNGIVVVRIDAPIYFANISYIKDRLREYELNLSNSNRGLDVGRVYFVILEMSPITYIDSSAVQALKDLHQEYKARHIQIAIANPNRQVHLLLSRSGILDLIGAAWCFVRVHDAVQVCLQHVQNASSSALKLASQASGDSADSISTSKEEQQRIKQDGFFKNLCKAKNGNADSGTEVQPLLRQNLV

SEQ ID NO: 28922 - DNA, 694 bp, Panicum virgatum
  misc_feature: Ceres CLONE 1888141
  misc_feature: Encodes the peptide sequence at SEQ ID NO. 28923
gttccaagttcgttcgactccagcaggaaagcaggtcgcgtccagcgcatcgccgcgcacaagggcggagagaagaggcaactattcgggagccgttgggcgttggctgttccccctccattgccggccgcccatcaccttcccctcccgcccgcgccctcgtccccgcgtcctcgccaccacctaatcggctgacccgcccgccttcccctccgctcccccgcgcgcccggccaccctccgccaccccgatggccggcaccccgccgtcgtcgcgggacccgtcgccgcagccccggcggccggcctcatccgcggggcgccccaagcgcgggggcctcctgctcgaccgctacgagctgggccggctcctcggccacggcaccttcgccaaggtctaccacgcccgccacgccgacaccggcgaggccgtcgccatcaaggtgctcgacaaggagaaggccctccgcaacggcctcgtcccgcacatcaagcgcgagatcgccattctccgccgcgtgcgccaccccaacatcgtccggctctacgaggtcatggccaccaagtccaagatctacttcgtcatggagtacgtccgcggcggggagctcttcgcgcgcgtcgccaagggccgcctcaaggaggacatcgcgcgcaggtacttccagcagctcatctccgccgtcggcttctgc

SEQ ID NO: 28923 - protein, 147 aa, Panicum virgatum
  misc_feature: Ceres CLONE 1888141
  misc_feature (35)..(147): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
  misc_feature: Functional homolog of the protein sequence given in SEQ ID NO 50696
  misc_feature: Useful for making plants with modulated salt sensitivity
MAGTPPSSRDPSPQPRRPASSAGRPKRGGLLLDRYELGRLLGHGTFAKVYHARHADTGEAVAIKVLDKEKALRNGLVPHIKREIAILRRVRHPNIVRLYEVMATKSKIYFVMEYVRGGELFARVAKGRLKEDIARRYFQQLISAVGF

SEQ ID NO: 28924 - DNA, 644 bp, Panicum virgatum
  misc_feature: Ceres CLONE 1888145
  misc_feature: Encodes the peptide sequence at SEQ ID NO. 28925
agcagtagcactccaccgcagtcacgcccttttttttccctccgctcccttcctccttctccgtcggcacggcgccagctccaaggcgggaccggaggagggcatggcgcggcgcgcggcagcggcggcaaggcttctaccccgcctgggcccgctcgcctccaagccgccggtgcgaggcatacctcatactcaatatgaattcccaagccgcactgtgagttcctgtaaaaaattccattggattcccagtctacagcgtccacctcatggacctaaaactaatgtggaaacatatgaagggaaacacagtgctaatatggcttctgaagttcaaaagcgcacatttggttctgcggcaacacatattcaaaggaatccagcctattcaaagctgaactctgatgatgtttcttacttcaaaagcatcttgggtgacaatggtgtagttcaggatgaaaacagaatcgcagtaccaaacgtagacgggatgggtaaatacaggggtgcaagtcagctactacttttaccaaaaaatactacagaggtttctaaaattctttcatattgcaacaccaaacgattggctgtggttccacaaggtggcaatacaggcctcgtaggtggcagtgtgcctgtttatg

SEQ ID NO: 28925 - protein, 180 aa, Panicum virgatum
  misc_feature: Ceres CLONE 1888145
  misc_feature: SWISSPROT Homolog: EC 1.1.2.4 D-lactate dehydrogenase (cytochrome)
MARRAAAAARLLPRLGPLASKPPVRGIPHTQYEFPSRTVSSCKKFHWIPSLQRPPHGPKTNVETYEGKHSANMASEVQKRTFGSAATHIQRNPAYSKLNSDDVSYFKSILGDNGVVQDENRIAVPNVDGMGKYRGASQLLLLPKNTTEVSKILSYCNTKRLAVVPQGGNTGLVGGSVPVY

SEQ ID NO: 28926 - DNA, 685 bp, Panicum virgatum
  misc_feature: Ceres CLONE 1888153
  misc_feature: Encodes the peptide sequence at SEQ ID NO. 28927
ggtagccaagccaggcatcttcccaccctctctatttctcctccccatctcttgccgatccatctgactccgaaccctaaccaagtcagatctccgcctcagccgccgccggcgagagcaccgaatcagatccgccgcgatggcgttccgccgcatcctatccagcgcggtgcgccgccgctcggccatcgccgcggcggccgggaacgcgcgcgaggcctccacggccgtcgctgcgggccctggggtcctcgctcccgacgcgaccccggtgcgtgcccccgtgatgccgtacgaccgcttcgcagaggccgtgaacgccaggctccggcggctcgagcacccggacccgcgcttcctccgctacgccaatcccgtgccgacccacgccgaccatactgccatcctcgcggcgccggagacccgcgtcaccacgctgcccaacggccttcgcgtcgccacggagtcgtccctcgccgcgcgcacagccacagtcggcgtctggatcgacgcgggcagcaggtacgagaacgaggaggcggccggcgtcgcgcatttcgtcgagcacatgctgttcaagggcacgggcaagcgcagcgcggcgcagctggagaaggagatcgaggacatgggtggccaccttaatgcctacacgtctcgggagcagacaacctactacgcgaag

SEQ ID NO: 28927 - protein, 181 aa, Panicum virgatum
  misc_feature: Ceres CLONE 1888153
  misc_feature (105)..(181): Pfam Name: Peptidase_M16 Pfam Description: Insulinase (Peptidase family M16)
  misc_feature: SWISSPROT Homolog: EC 3.4.24.64 Mitochondrial processing peptidase
MAFRRILSSAVRRRSAIAAAAGNAREASTAVAAGPGVLAPDATPVRAPVMPYDRFAEAVNARLRRLEHPDPRFLRYANPVPTHADHTAILAAPETRVTTLPNGLRVATESSLAARTATVGVWIDAGSRYENEEAAGVAHFVEHMLFKGTGKRSAAQLEKEIEDMGGHLNAYTSREQTTYYA

SEQ ID NO: 28928 - DNA, 686 bp, Panicum virgatum
  misc_feature: Ceres CLONE 1888156
  misc_feature: Encodes the peptide sequence at SEQ ID NO. 28929
gcacgcgctgatgcgccgccgctctgctacaggatcagcgacgtcaccgcttctccgtcgccaccgtcgccctcccatccaatccagcagccgccccttccctataacagctagctcctcgccagtcgggcgccctccgcctgccgcccgtgcatcgaggagagcttggggaccggccggcgcggaagggatcgagatcgaccccccggagttgagttcccatggcttctgaatcaggggacggcaactgcgatgcttgggcagcgagagatccttctggagttctctcaccgtacaaatttaaccgcaggtggtctcccctttctgttttggttaaaaatccggcaccatttttactactctgaatactctctctctccttgctctgttagactccatggaacatctgtctatgtatgccgtatggaccgacttgtttccatgcgtttatatgtacataatgtttgggtttcagtgtgtttcgtgcctattttcaagtgtggaacgagtagtgcaggtatttctgctcgtcacatgtcaaagtaaggcttccaattgatgcttactacgaggcgatggatgggcattttaggtctgatgagactgcaggaatttgagtgcacacagcaagcatttgtctcttgtgcaattagctcagtggttttttcataccatgccatcttctt

SEQ ID NO: 28929 - protein, 47 aa, Panicum virgatum
  misc_feature: Ceres CLONE 1888156
  misc_feature: SWISSPROT Homolog: EC 1.1.1.195 Cinnamyl-alcohol dehydrogenase
MASESGDGNCDAWAARDPSGVLSPYKFNRRWSPLSVLVKNPAPFLLL

SEQ ID NO: 28930 - DNA, 545 bp, Panicum virgatum
  misc_feature: Ceres CLONE 1888162
  misc_feature: Encodes the peptide sequence at SEQ ID NO. 28931
ccgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccatcgaagccatgaacggcaaggagctcgacggccgcaacatcaccgtcaaccaggcccaatcccgcggcggtggcggcggcggcggcggcggcggttaccgcggcggtcgccagggaggctacggcggcggcggcggtcgctacggcggcggtcgccgtgagggcggctacggtggcggctcctactaccgtggcggcggcagataccgcggcggtctccgcgagggcggctacggcggtggtggctacggcacccgcgttgactccggtgg

SEQ ID NO: 28931 - protein, 155 aa, Panicum virgatum
  misc_feature: Ceres CLONE 1888162
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGYRGGRQGGYGGGGGRYGGGRREGGYGGGSYYRGGGRYRGGLREGGYGGGGYGTRVDSG

SEQ ID NO: 28932 - DNA, 2430 bp, Panicum virgatum
  misc_feature: Ceres CLONE 1888190
  misc_feature: Encodes the peptide sequence at SEQ ID NO. 28933
acagataataattgtaggaggggggcacgcttctggctccggccgcgtctgcctccgctttgccgtgctcgtcgcttgctgccttgctgcttcccctctcccagtcttgggcctctgcttccccttttggctctgctgcggaacctgtcgggcgttctgacgattcggccttgattgctggagctgtgctttcccccgttccatcttgaatctgcgaattcgcttttcgggctcggatgtctccccgagccacgaaatcgtcgtgcgagaggcttgaatcttgggagcaggaggggaagcttcgatctttcaggccttccaagtcccgctagtagctcacgcggacgaggcttctagaaccttcttcttctacccgctgccctcgcagccccgcctcgccccatggaggcctccaccattagcttctcgtccccgtcctcgtcgccccagtccccgccgccaccgcagccgccgcgggccacgccggcggagctcgaggccgtcaggctgcgccgcctcagcgacaacctcgagcgcctcctcgacccggccttcctcgactgcgccgacgccgagatcgcgctctccgcggggaagggcgccgccgccgtcggcgtccaccgctgcatcctcgccgccaggagcgccttcttcctcgaccacttcgcctccctcccgccccccgccgccgccggcgagaggccccggctcgagctcgacggtctcgtccccggcggccgccacatcggccgggacgccctcgtgcccgtcctcgggtacctctacaccggccgcctcaagtcgccgccgcaggaggtcaccgcctgcatggacgaagcgtgcggccacgcggcgtgccgaccggcgattgactttgtcgtcgagtccatgtacgccgcttctggcttccagatctccgagcttatctccctcttccagcgccatctctctgaccttgttagcacagctctggacgaagatgtggtgccgattgttcatgtttcttccacctgcgagcttcaggacctgctcaatcagtgtattcagaggattgcattctccactctcgatagcgggtacctggagaaggagcttccagatgatatatacggcaggatcaagcaaatccgccagagtgcatttcaggatgaatcagagaacgccattggggaccctgagcatgagaagagggttagaaacatcctcaaggccttggattctgacgacgttgaccttgttggcttgctgttaaaggagtctgcggtcaccttggatgatgcattcgctctacactacgctgcagcctactgcgagcctaaagtgtttgcggaattgctgaaactaaattccgccaatgtgaatctgaagaatagcagtgggtatacaccgctgcacatagcttgcatgaggcgagaaccggacatcattctttcacttgtggagaggggagcctctgtgctggagaggacgctggatgggcgtgatgctcttactatctgcaagagactgacaagagagaaggactgcaacaggaagttggagacatacgaggagaaaagcaagccttacttgtgtattgacatattggagcgagaacttaagaggaaatctatcattttggacccgatctcaatagaggagtcgattgccacacctttgttggttgataattttcacatgaggcttataaacttggaaaacagagttgcctttgcaaggatattcttcccttctgaggccaagcttgtcatgcgcatcgcacaagctgattcaactgaagagtttgctggcatcacaaatttcagtaaactgaaggaggttgatctgaatgagacccccacgatgcaaaacaggaggttacgtgaacgccttgatgccttaacaaatacagtcaaactaggaagacgatacttcccacattgttcggacgttcttgacaattttctcaacgaagaatccaccgacctgatcttccttgaaactggcactccagaggaccagcaagtcaagcggatgcgcttctctgaactcaaagaggatgtgcgcaaggccttcacaaaagataaggcggccgtcgcagccatagcttcatcagcatcctcatcttcgtctgcaaggtatgaagggaggggtacacaatccaataggaaatcaaagcaaccacggagatatcagtagtttaagtgcaatctgttctaaacacatgactttgagaaaagtggggaacgaaggcttgaagactgttttgacaacgtgtagcacagtgaagcaatttgacccagcatggcgagaaattttctggagctgccgagctttgacatgtaatgatgttttgttagataatttccaagtgctgactgtcagttttgcagccactatagttgtcttgcatgtaaaaactgctttttgactgggaaatggagtggtgct

SEQ ID NO: 28933 - protein, 591 aa, Panicum virgatum
  misc_feature: Ceres CLONE 1888190
  misc_feature (325)..(357): Pfam Name: Ank Pfam Description: Ankyrin repeat
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 10 in US patent 7148398
  misc_feature: The sequence is a functional homolog of SEQ ID NO 10 in US patent 7294757
  misc_feature: The sequence is a functional homolog of SEQ ID NO 4 in US patent 7030293
MEASTISFSSPSSSPQSPPPPQPPRATPAELEAVRLRRLSDNLERLLDPAFLDCADAEIALSAGKGAAAVGVHRCILAARSAFFLDHFASLPPPAAAGERPRLELDGLVPGGRHIGRDALVPVLGYLYTGRLKSPPQEVTACMDEACGHAACRPAIDFVVESMYAASGFQISELISLFQRHLSDLVSTALDEDVVPIVHVSSTCELQDLLNQCIQRIAFSTLDSGYLEKELPDDIYGRIKQIRQSAFQDESENAIGDPEHEKRVRNILKALDSDDVDLVGLLLKESAVTLDDAFALHYAAAYCEPKVFAELLKLNSANVNLKNSSGYTPLHIACMRREPDIILSLVERGASVLERTLDGRDALTICKRLTREKDCNRKLETYEEKSKPYLCIDILERELKRKSIILDPISIEESIATPLLVDNFHMRLINLENRVAFARIFFPSEAKLVMRIAQADSTEEFAGITNFSKLKEVDLNETPTMQNRRLRERLDALTNTVKLGRRYFPHCSDVLDNFLNEESTDLIFLETGTPEDQQVKRMRFSELKEDVRKAFTKDKAAVAAIASSASSSSSARYEGRGTQSNRKSKQPRRYQ

SEQ ID NO: 28934 - DNA, 734 bp, Panicum virgatum
  misc_feature: Ceres CLONE 1888212
  misc_feature: Encodes the peptide sequence at SEQ ID NO. 28935
gcgtgagccgcacgcagcctctgcgttccgccggcaggtcaactcagacagagcaagcgccgccgccgcggacttgccggtggtttcgggcccccgaccggaccggaccggacgagatgcagtcgctgcaggacaaggcgtcggagtggagcggcgtggcggccgccgacgccttcgccatcgacgacggcaacatcttcgaggccctcggcggcaccccgcagcccttcgtcgacctctccaccaatttctacaccagggtgtacgaggatgaggaggagtggttccgcgagatattcgcggtgtcgaagaaggaggacgccacccagaaccagtacgagttcctgatccagcgcatgggcggcccgccgctcttctcccagaggagaggacatcctgcccttataggacgacatcgaccattcctggtaacccaccgagctgcagagcggtggctgcaccacatgcagcaagctttggatacaactgaaagcatagatgctgactcaaaaaccaaaatgatgaactttttcaggcacactgcttacttcctcgttgctggcaatgagatgactaggcagcagagccaaggagtagcctgcaagcatgcaacaagcaaacgagctgagtatgatagataattactcatgctcatgcttgctttttccatgcctagtagtagtagtagcactagcttgtactcagtccagcctgccatttactcttgggcggca

SEQ ID NO: 28935 - protein, 174 aa, Panicum virgatum
  misc_feature: Ceres CLONE 1888212
  misc_feature (26)..(146): Pfam Name: Bac_globin Pfam Description: Bacterial-like globin
MQSLQDKASEWSGVAAADAFAIDDGNIFEALGGTPQPFVDLSTNFYTRVYEDEEEWFREIFAVSKKEDATQNQYEFLIQRMGGPPLFSQRRGHPALIGRHRPFLVTHRAAERWLHHMQQALDTTESIDADSKTKMMNFFRHTAYFLVAGNEMTRQQSQGVACKHATSKRAEYDR

SEQ ID NO: 28936 - DNA, 746 bp, Panicum virgatum
  misc_feature: Ceres CLONE 1888213
  misc_feature: Encodes the peptide sequence at SEQ ID NO. 28937
acgcctcgacacggcaccaccccgcgcgcctcggcctcggcctcgctgcgctgctccccctccgttcctctcccgcggcggccgggcgtccccaggtgccgggagcacgcccaccgcccgcgccgcgcgcgcgcccgatgcccagggcgcgcggtttatgggcggccgcgcccgctccctcctccgctggctccgacaccgctcgcgccgcgtctcctccttccacctgacctccaccaccaacaacgaccacaccgccaccagcaaagacctccacgcccattcgctcccgcaccagtacaacgccgaggaggagcaggagcaggaggaggaagggtggcaggaggtcgccgagggcccggagtccgcgcccgaggggtgcattgtcttcgaggagcggggcgcaggtccgcgcgcgccggtgcgcacgaagccgccacccatggatccgagcaagaaggagtctgaattctttacagaatatggcgaggcgagccggtatcaggtcagcgaagtcattggcaaaggtagctacggtgttgtggctgccgctgtcgacacccagactggtgagcgtgtagctatcaagaagatcgttgatgtctttgatcatgtctccgatgcaactcgcatccttagggagatcaagctgctccggttgctgcgtcacccagacttagttgagatcaagcacattatgctccctccttcgaggagagaattcagggacatatatgtaatctttg

SEQ ID NO: 28937 - protein, 196 aa, Panicum virgatum
  misc_feature: Ceres CLONE 1888213
  misc_feature: SWISSPROT Homolog: EC 2.7.11.24 Mitogen-activated protein kinase
MGGRARSLLRWLRHRSRRVSSFHLTSTTNNDHTATSKDLHAHSLPHQYNAEEEQEQEEEGWQEVAEGPESAPEGCIVFEERGAGPRAPVRTKPPPMDPSKKESEFFTEYGEASRYQVSEVIGKGSYGVVAAAVDTQTGERVAIKKIVDVFDHVSDATRILREIKLLRLLRHPDLVEIKHIMLPPSRREFRDIYVIF

SEQ ID NO: 28938 - DNA, 640 bp, Panicum virgatum
  misc_feature: Ceres CLONE 1888213-R
  misc_feature: Encodes the peptide sequence at SEQ ID NO. 28939
tgcaagaatatatacgtggaggtgaccagacccagatgaccttcatgttcccaagtggggtggatcgctttagacgacaatttgctcatttggaagaaggtactgcaaagggtgaaaaacccagtccacagctgcggcagaatgtttcattaccaagggaaagagtaattggcaataaacatggagatggcaatgcgggtgataagccagcacaagcttcagtgacggatgggataaaccaaccgggcttgagtgcgagaagcttgctgaaaagtgaaagcatcagtgcttccaagtgtataggtgaaaaatcaaagcatgtcaatgatgaggactctatcatggagactgacgaaacagttgatgaagtctcgaagaagattgctcaactgaaaacctgattctctcaaggtcactggagtagcatgataactacctcaaagctgagaatgagcctacgacaagagtctatagccaataagaccacaagctctcatgccagtaactttgttgtgatgtaaatttcctcccgttttttgactgcacgcaaacttatgtctgactgaatagctccgcgtgttttcctctgtggagccatcacaatcctgtaaatttttcagttaaaagtaaatattgacgc

SEQ ID NO: 28939 - protein, 132 aa, Panicum virgatum
  misc_feature: Ceres CLONE 1888213-R
  misc_feature: SWISSPROT Homolog: EC 2.7.11.24 Mitogen-activated protein kinase
QEYIRGGDQTQMTFMFPSGVDRFRRQFAHLEEGTAKGEKPSPQLRQNVSLPRERVIGNKHGDGNAGDKPAQASVTDGINQPGLSARSLLKSESISASKCIGEKSKHVNDEDSIMETDETVDEVSKKIAQLKT

SEQ ID NO: 28940 - DNA, 2570 bp, Panicum virgatum
  misc_feature: Ceres CLONE 1888214
  misc_feature: Encodes the peptide sequence at SEQ ID NO. 28941
aaaacgccacctccgtccccgtccccgtccccctcctccccgaccagagagcgagcgccgtaaccggctaaccgccgccgcgccaccacaccctccgcccgctcccgcgcgcgcacaagcgtttcggacaagctgagcgcggcgggggcgccatgcacagccaccggccgggcgccgacgccggcggcggcggggacatcgtcgagatgtcctcggccgccgcgccgccgccgcaggaggcgcgagaccgggaccgggagcgggtgatcccgcacagcggcccgctgagcaagaagtccgggccgcgcaagagcgcgcgcttcgcggagtccgtctcggcgccgctctccgcgccgccgccccgcgcgtccccctcctccgccgccggcgacgacgacgactacgtcgagatcaccctcgacgtgcgcgacgactcggtggcggtgcacagcgtcaagccggcccaccacggcggcggcggcgccgccgccgacgaccccgacgtgacgctgctggcgcgcacgctcgagagccggcggtcctcgtcctacggccactccgccatccgcagcgcctcgtcgcggatcaagcaggtgtcgcaggagctccgccgcctcgcctccctcaaccgccgcaacatctccggcgacagcatcagcaaggcggagctgctcgagttctgggaccaaatctccgacaccagcttcgacggccgcctccagaccttcttcgacatggtggacaaggacgcggacggcaggatcaccgaggaggaggtgaaggagatcatcacgctgagcgcgtcggcgaacaagctgtccaagatccaggagcagtcggaggagtacgcccggctgatcatggaggagctggacccgggcaacctgggctacatcgacctctacaacctggagatgctgctgctgcaggcgcccagccagtcggtgcgcatcggcaccaccaacagccgcaacctgagccagatgctgagccagagcctccgccccacgccggagcccaacccgctccgccgctggtgccgccgcgccggctacttcctcgaggacaactggcgccgcgtgtgggtgctcctcctctggctcgccgtctgcgcggggctcttcgcctggaagttcgtccagtaccgccgccgctacgtgttcgaggtgatgggctactgcgtgtgcgtcgccaagggcggcgccgagacgctcaagttcaacatggcgctcatcctgctccccgtctgccggaacaccatcacctggatccgcaaccgcaccgccgccgcccgcgccgtgcccttcgacgacaacctcaacttccacaaggtggtcgccgcggggatcaccgccggcgccgcgctccacatcgtctcccacctgacctgcgacttcccgcggctgctccacgccaccgacgccgagtacgcgccgctggccaagaacttcggcgagcggcggccgcccaactactggtggttcgtgaaggggaaagaggggtggacggggctggtgatgctggcgctcatggcggcggcgttcacgctggcgacgccgtggttccggcgcgggcggctgcggctgcccggcccgctccggcggctcacggggttcaacgccttctggtactcgcaccactgcttcgtggtggtgtacgcgctgctcatcgtgcacggccacttcctgtacctgaccaaggagtggtacaagaagacgacgtggatgtacctggcggtgcccatggcgctgtacgccggcgagcggctgacgcgggcgctgcgctccagcgtgcgccccgtgcggatcctcaaggtggccgtgtaccccggcaacgtcctctcgctgcacttctccaagccgccggggttccggtacaggagcggccagtacatcttcgtcaactgcgccgccgtgtcgccgttccagtggcacccgttctccatcacgtcggcgccgcaggacgactacgtgagcgtgcacatcaggacgctgggggactggacgcgcgagctcaagaccgtcttctcgagggtgtgccggccgccgccggagggcaagagcggcctgctccgggccgagtacgaccgcgacggcggcgccatgaccaaccccagcttcccgaaggtgctgatcgacgggccctacggcgcgccggcgcaggactacaagcagtacgacgtggtgctgctcgtcggcctgggcatcggcgccacgcccatgatctccatcatcaaggacatcatcaacaacatgaagaccctcgacggcgacctggaggccgcctccggcggcggcgccggcgcggacgcctccttccgcacgcgccgggcctacttctactgggtgacccgggagcagggctccttcgagtggttccgcggcgtcatggacgaggtggccgagaccgacaagaagggcgtcatcgagctccacaactactgcaccagcgtctacgaggagggcgacgcccgctccgccctcatcgccatgctccagcagctcaaccacgccaagaacggcgtcgacgtcgtctccggcacccgcgtccggacccacttcgcccggccc

SEQ ID NO: 28941 - protein, 805 aa, Panicum virgatum
  misc_feature: Ceres CLONE 1888214
  misc_feature (547)..(669): Pfam Name: FAD_binding_8 Pfam Description: FAD-binding domain
  misc_feature (348)..(506): Pfam Name: Ferric_reduct Pfam Description: Ferric reductase like transmembrane component
  misc_feature (675)..(804): Pfam Name: NAD_binding_6 Pfam Description: Ferric reductase NAD binding domain
  misc_feature (188)..(216): Pfam Name: efhand Pfam Description: EF hand
  misc_feature (128)..(187): Pfam Name: NADPH_Ox Pfam Description: Respiratory burst NADPH oxidase
  misc_feature: SWISSPROT Homolog: EC 1.6.3.1 NAD(P)H oxidase
MHSHRPGADAGGGGDIVEMSSAAAPPPQEARDRDRERVIPHSGPLSKKSGPRKSARFAESVSAPLSAPPPRASPSSAAGDDDDYVEITLDVRDDSVAVHSVKPAHHGGGGAAADDPDVTLLARTLESRRSSSYGHSAIRSASSRIKQVSQELRRLASLNRRNISGDSISKAELLEFWDQISDTSFDGRLQTFFDMVDKDADGRITEEEVKEIITLSASANKLSKIQEQSEEYARLIMEELDPGNLGYIDLYNLEMLLLQAPSQSVRIGTTNSRNLSQMLSQSLRPTPEPNPLRRWCRRAGYFLEDNWRRVWVLLLWLAVCAGLFAWKFVQYRRRYVFEVMGYCVCVAKGGAETLKFNMALILLPVCRNTITWIRNRTAAARAVPFDDNLNFHKVVAAGITAGAALHIVSHLTCDFPRLLHATDAEYAPLAKNFGERRPPNYWWFVKGKEGWTGLVMLALMAAAFTLATPWFRRGRLRLPGPLRRLTGFNAFWYSHHCFVVVYALLIVHGHFLYLTKEWYKKTTWMYLAVPMALYAGERLTRALRSSVRPVRILKVAVYPGNVLSLHFSKPPGFRYRSGQYIFVNCAAVSPFQWHPFSITSAPQDDYVSVHIRTLGDWTRELKTVFSRVCRPPPEGKSGLLRAEYDRDGGAMTNPSFPKVLIDGPYGAPAQDYKQYDVVLLVGLGIGATPMISIIKDIINNMKTLDGDLEAASGGGAGADASFRTRRAYFYWVTREQGSFEWFRGVMDEVAETDKKGVIELHNYCTSVYEEGDARSALIAMLQQLNHAKNGVDVVSGTRVRTHFAR

SEQ ID NO: 28942 - DNA, 145 bp, Panicum virgatum
  misc_feature: Ceres CLONE 1888214-R
cagttgggtcaaaatcccatcagttttttgtttgctctagaagaattaataatacaaatgcctttgtaaagatcctctctgtatctctctgtgatatactgtgtcacttagacagtttgactagacagcttgatcaagcagcagc

SEQ ID NO: 28943 - DNA, 1848 bp, Panicum virgatum
  misc_feature: Ceres CLONE 1888238
  misc_feature: Encodes the peptide sequence at SEQ ID NO. 28944
tcccatccccggcagccaggtctcacaatcaccgcagctgggcagccgctgtcggtcatcaggatctactcaggtgagctgaggtaggagaagaagaagggttaaccacctgtccacccagccggcgagcgatccccacaggccacagaccacggcgtcagccaagccgcatcgagtcccggcagccgtcggggaatcctaaacttaaccgcgctattattaatcagcggaggcttaaccgcgcccgagtgctcgtgcgcacgggggaaggcgaggaggaggccacgtctcggaggcgcgcgcgcccagggggtgtggggcgacgaaggccatggacgcgctgaggttcgtgcgcgccgccgcgccgccgccgccgcagcctccggtggcgccggcctcggtgccgccgccgacgatgccggcgcagcagcggcggcggcagcagcagcagcagcacccgccgcgcgcgccgctgctccgcctggggccgcgcggcgggggcggggccgggggagagaaaccggccgcggcgggcggcgctgtccgcggcgcggagccgaggagtagtcctccgcccgaggaggagcgggaggcggaggcgggcgggcgcgggcaggggaattcgaactgggtgctgcagatgctgcgggtgcagccgcggtgggcggacgcggcggacgcggaggctaccggcggcggcggcggcggcggacgagaaccggagggggaggaggcggaggccgctggcggtggcgtcgaggagtgcgcttcctgcggcgccgggggcgaggacgaaggctgcgccgtcgggtacgacgagggcgaggtgttcgaccgcgcgtccttctcgcggctcctgcggaagacgtcgctcggcgaggccaaggagtactccatgatgtcctacctctgcaacatcgcctacatgatccccaggattcagccaaaatgtctccggaggtacaatttgcggtttgtgacttcgtcaatgcaagacaaggccagaactatccctgaacagaagcaggagcataacaacgcaaaggatgaatctcaagatgaagtatctgaagctgtcggcaatgctgcatccacaagcaaagaggatcgcattggcctggggataaaccccttcggtgcgtaccatgttgtgtcatctgctgcatcttacttgcattcccgggccatgggcattatgccatttggttctaggaatgatgtcaaggaagatccgacggccatcatggcatttatgaacggtgagaatggtgaagggttaagtatggacgaagcctcatttgtggccacaacgaattcagtaacttccatggttgcggcaaaggaagagacaaggcaagctgtcgcagatgatctgaattcttcgagatcttgcccctgcgagtggttcgtttgtgatgatgatcaaaacagcacaaggtacttcgtggttcagggctcagaatcaattgcttcttggcaggccaaccttttatttgagcctgtcaaatttgaggaactcgacgtgctagttcacaggggcatatacgaggctgcaaaggggatatatcaacagatgctaccatacgtgaaatcccacctggaagcctgcggcaaatctgccaggctgcggttcaccggccactccctcggcgggagcctggccctgctcgtgaacctgatgctgctgatgcggggcgaggcccccgcttcggcactgctgccggtgatcacgttcggtgccccgtgcatcatgtgcggcggcgacctcctgctccgccggctcgggctgccacggagccacgtgcagtccatcaccatgcaccgggacatcgtgccccgcgtgttctc

SEQ ID NO: 28944 - protein, 505 aa, Panicum virgatum
  misc_feature: Ceres CLONE 1888238
  misc_feature (370)..(505): Pfam Name: Lipase_3 Pfam Description: Lipase (class 3)
MDALRFVRAAAPPPPQPPVAPASVPPPTMPAQQRRRQQQQQHPPRAPLLRLGPRGGGGAGGEKPAAAGGAVRGAEPRSSPPPEEEREAEAGGRGQGNSNWVLQMLRVQPRWADAADAEATGGGGGGGREPEGEEAEAAGGGVEECASCGAGGEDEGCAVGYDEGEVFDRASFSRLLRKTSLGEAKEYSMMSYLCNIAYMIPRIQPKCLRRYNLRFVTSSMQDKARTIPEQKQEHNNAKDESQDEVSEAVGNAASTSKEDRIGLGINPFGAYHVVSSAASYLHSRAMGIMPFGSRNDVKEDPTAIMAFMNGENGEGLSMDEASFVATTNSVTSMVAAKEETRQAVADDLNSSRSCPCEWFVCDDDQNSTRYFVVQGSESIASWQANLLFEPVKFEELDVLVHRGIYEAAKGIYQQMLPYVKSHLEACGKSARLRFTGHSLGGSLALLVNLMLLMRGEAPASALLPVITFGAPCIMCGGDLLLRRLGLPRSHVQSITMHRDIVPRVF

SEQ ID NO: 28945 - DNA, 289 bp, Panicum virgatum
  misc_feature: Ceres CLONE 1888238-R
cgtgctgccgtcgggcgcggggcgccgcggcggcggcgggttcgtggacgccgtggccgaggcggcgcggcgcgcgcacctgctggcggtggtgctgctccccgcggagctgctcgcccacggcgcgctcctggtcgtcgctaggctcaggtgatagggggttcgatccgtccgtccgtccgtccattggaccgtcgatagattcatcattcacacgattcttttgtaacagaaacgcgtccccaggacgcatgtgaaatggaaatagaaactttctttcattctttcg

SEQ ID NO: 28946 - DNA, 665 bp, Panicum virgatum
  misc_feature: Ceres CLONE 1888245
  misc_feature: Encodes the peptide sequence at SEQ ID NO. 28947
agagggaggagacacaacacaacaaccgcgtccgtccagtgtgtccactcctcgcgtgagaaagaagcggtagggtgcgcgcgcgagacagagatggcaactccggcgacggaggcggcggcggcggcggcggcggcgacaccggtggcaccggctgaggggacggtgatcgcgatccacagcctggacgcgtggagcacccagatcgagcaggccaacagcgccaagaagctggtgctgatcgacttcaccgcatcttggtgtggaccatgccgcatcatggctccaattttcactgatatggccaagaagaatccaaatgtcgttttcctgaaggttgatgttgatgaaatgaaggccattgctgagcaattcagtgtcgaggccatgccgaccttcctgttcatgaaggaaggtgacgtcaaggacagggtcgtcggcgcaattaaggatgaactggcccagaagcttcagctccaccagaccctgtagaccagtataatgctataatgaagtagtattcgcctaaataagaagaagcatcaactcagagagaactagtgcctctataatggtacttcgtatgtagtattaactatcctactctgctgcccagtttctggataatgatatgatcaggccctgcttgttccaagattatgctt

SEQ ID NO: 28947 - protein, 132 aa, Panicum virgatum
  misc_feature: Ceres CLONE 1888245
  misc_feature (25)..(129): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MATPATEAAAAAAAATPVAPAEGTVIAIHSLDAWSTQIEQANSAKKLVLIDFTASWCGPCRIMAPIFTDMAKKNPNVVFLKVDVDEMKAIAEQFSVEAMPTFLFMKEGDVKDRVVGAIKDELAQKLQLHQTL

SEQ ID NO: 28948 - DNA, 751 bp, Panicum virgatum
  misc_feature: Ceres CLONE 1888256
  misc_feature: Encodes the peptide sequence at SEQ ID NO. 28949
aaagcaagcaagcgaccattctcttctccaccagcgccgcctcctcccccgatctttctccgcctccgccgtgatcccaaggaccaccaaaccctagcacgaagtcgcctcctctgtccaatcatggccaacagcaacctccctcgccgcatcatcaaggagacgcagcggctgctcagcgagccagctccaggaatcagtgcctcgccatctgaagagaacatgcgctacttcaatgtcatgatccttggcccgtcgcagtcaccctatgagggaggagttttcaagcttgagttattcttgcctgaagaatatccaatgactccaccaaaggttcgctttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgacccgcttgctgataacgttgcaaagcactggaaagctaatgagactgaagctgtaggaacagccaaagagtggacccgtgtatatgcaagcggagcatgagctttggacgatgcaaaagtggagctcaactcgaacggccattggctggttacatttgaaacttaaggggtctaggggtctactcatatgtggaaatttatcctctttattatggtgtgtacttgagtctgatgtacattagtctagctgggcatgtaaagtgttt

SEQ ID NO: 28949 - protein, 153 aa, Panicum virgatum
  misc_feature: Ceres CLONE 1888256
  misc_feature (9)..(146): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPSQSPYEGGVFKLELFLPEEYPMTPPKVRFLTKIYHPNIDKLGRICLDILKDKWSPALQIRTVLLSIQALLSAPNPDDPLADNVAKHWKANETEAVGTAKEWTRVYASGA

SEQ ID NO: 28950 - DNA, 1758 bp, Panicum virgatum
  misc_feature: Ceres CLONE 1888260
  misc_feature: Encodes the peptide sequence at SEQ ID NO. 28951
aagggaaagcactcgccactcgcgtcgcagcacttcctctgcatctctctctctctctctctctctctctagaaaaaattgaaaagagaagggaaaaatccccaactcctcgccccataaaccctaatctcgtcggattcgcaccacaagcctcccaaatcgaagccctccggtggtccagccgcctgcgggagctgagccgtgctcggtttggtggaaaattccggggttttctgcgctcggtgccgccatttctccgggctgttcctccgagggcagcggctccccggctcgggttctccggtgctcgccggcgccggatccggacgtgtcccggcgagaggtcgggtttcgcgtggggtcggttcagcttcgagctcgatttgcccgcttgagttgggtcgcggctgccgtggcggtgattgaggtagtcgcgtcgattttgggggcgcgaaggtttcgttgcgaggcagcagcgtttcttggtaatccttgggtctttctgccgtgcgatgcaccccaaggctcgaatccacgcggacccggtgctggaggtcgaccagttcgactgcctgccggattcgctcgtcctgctcatcctgaacaaggtggaggacgtgcggtcgctgggccggtgctccgccgtctcgaagcggttctgcgggcttgtctccctcgtccacgacgtgtatgtcaagatcgaccgcgtcgtggcggtcgacggcgacgccgaggacacgctcaacctgtcctcgcccaagcctcggaacatcttctcgcacttcctgaagctgatgctcttcacaatcatcaagccgttccacagcatgcgcaacccgaatggcaatgggaggccactgttcgctcagctctcacagcactcgccagcccaggtgctccggaacttcacgcacatccggaatcttcgggttgagctcccctctggggatgtgggtaccgaggagggagtgctcctgaaatggcgggcagagtatgggagtacacttcagagctgtgtgattctgggcggtacccgggttgatcgcaggcctgttggtggagagcatgaaccatctttggaggataatggaagcatgccagagtctttctataccaatggtgggctgaaactccgtgtcgtctggacaatcagctctctgattgcggcatcaacgagacactatcttctccggtcaattatcaaggaccatcccacacttacaagcctggtactaaccgacgccgatggccaaggcacattatgcatgggggcggaacagctgaaggagttcagagagaaccagttatcagcctcagcatgctccaacaggactcaggtcccagcctgcaacatgaagctcaagtacgccccatatctcgagctgcctggtggtatagctttgcaaggtgctacgttggtggctatcaagccatcgaccgagggaagcaatggaggccataccagccgtaaggaaactgatgctttcatctctggagcatttgatgggccattcaaggtagctgtgaaggcactgacgaagagacgtacttaccttctggagatgaatggcttctaggtatccgcagttttcatatctagcttggtggtgctaggcatggcacctttagttgacctttccatctgtgtaatatccaagatggcgccatctctagatttctagatggtgcttatctgctgttttagctctttgtacagtggtgacatttggctctatgaaaatcacatgaagttagtgt

SEQ ID NO: 28951 - protein, 354 aa, Panicum virgatum; identical to SEQ ID NO: 15056
  misc_feature: Ceres CLONE 1888260
  misc_feature: Functional homolog of the protein sequence given in SEQ ID NO 50588
  misc_feature: Useful for making plants with modulated low light sensitivity
  misc_feature: Useful for making plants with modulated nitrogen use efficiency

SEQ ID NO: 28952 - DNA, 654 bp, Panicum virgatum
  misc_feature: Ceres CLONE 1888270
  misc_feature: Encodes the peptide sequence at SEQ ID NO. 28953
acacaaccacttccagagctaacctcagcaaggcacaccagagtaccagacgtcaagaccaccagacaacctgacctgccaccgggccggagccccatttgaaaagtttgcgacggaggaagagagaagctgagctgaacgccagtactcaaccgctgccgagtgccgatcgagtggcgacgaccatgacttccctgcgggaaaccgggcggcgcctcctctgctgcttcttcctctgcctctcgctgtccgcggccgcgcgcgcggcgacgctaaaccacgagtgggagatcagctaccagttcaagtcccccgactgcgtgtgcaagctcgccgtcaccatcaacgggcagacccccggcccgaccatccgcgccgcgcaggacgacaccgtcgtggtcagggtgagcaactcgctgctgacggagaacgtggccatccactggcacggcatccggcagatcggcacgccctgggccgacggcaccgagggcgtcacgcagtgccccatcctccccggcgacgtcttcacctacaccttcgtcgtcgaccgcccgggcacctacatgtaccacgcccactacgggatgcagcggtcggcggggctctacgggctcatcgtcgtcgcggcggcgcccggcgcggagccgttcg

SEQ ID NO: 28953 - protein, 156 aa, Panicum virgatum
  misc_feature: Ceres CLONE 1888270
  misc_feature (35)..(152): Pfam Name: Cu-oxidase_3 Pfam Description: Multicopper oxidase
  misc_feature: SWISSPROT Homolog: EC 1.10.3.3 L-ascorbate oxidase
MTSLRETGRRLLCCFFLCLSLSAAARAATLNHEWEISYQFKSPDCVCKLAVTINGQTPGPTIRAAQDDTVVVRVSNSLLTENVAIHWHGIRQIGTPWADGTEGVTQCPILPGDVFTYTFVVDRPGTYMYHAHYGMQRSAGLYGLIVVAAAPGAEPF

SEQ ID NO: 28954 - DNA, 1820 bp, Panicum virgatum
  misc_feature: Ceres CLONE 1888274
  misc_feature: Encodes the peptide sequence at SEQ ID NO. 28955
actgaccagttgagtcccgcccgggcgagaagagccgagcctgccgcctcccgccggcccagcgggagcgcctggtgatcaccggcgatggcggtgcgcgactcgctcgaggtggtggacgggcgctgcggctgcgacgacgacgggcggcgcccgcggcgggccggcacggcgtggacgtgcgcggcgcacgtgatcacggcggtgatcggctccggggtgctgtcgctggcctggagcgtcgcgcagctgggctgggtcgtcggccccgcctgcatgctctgcttcgcgctcgtcacctacgcctccgccgcgctgctcgccgactgctaccgccgcggcgaccccgggaagggcctgccgaggaaccgctcctacaccgacgccgtccgcgcctacctcggcaagaagcacacctgggcctgcggctcgctgcagttcgtgagcctgtacggctgcggcgtcgcctataccatcaccaccgccactagcataagggcaatcctgaaggccaactgctaccacgagcacgggcacgatgcgtcctgcagctacggcggcagctactacatgctcgtcttcggcgccgcgcagctcctcctctccttcataccggacttccacgacatggcgtggctctccgtcgtcgccgccgtcatgtccttctcctacgccttcatcggcctcgggctcggcctcgccaccaccattactaacgggacgatcaaaggaagcataacaggtgttccgatgaggacgcctgtgcagaagatctggcgcgtctcgcaggccataggcgacatcgcgttcgcgtacccgtactccctaatcctcctggaaatacaggacaccctgaagtcgccgccagccgagaacaagacgatgaagagggcgtcgatgatctcgatcctcgtcacgaccttcttctacctctgctgcggctgcttcggctacgccgccttcgggagcgacgcgccgggcaacctcctcaccggcttcggcttctacgagccctactggctcatcgacttcgccaacgcctgcatcatcctccacctgctgggcgggtatcaggtgtacagccagcccatcttccagttggcggacaggttcttcgcggagcggttcccggacagcgggttcgtgaacgacgtccacaccgtgcgggtcccgtgcctgccgccgtggcgggtgaacctgctgcgggtgtgcttccggacgctgtacgtggcgtccacgacggcggtggccgtggccttcccctacttcaacgaggtgctggccctgctgggcgcgctcaacttctggccgctggccatctacttccccgtggagatgtacttcatccagcggaacgtgccccggtggtccgcccgctgggtcgtcctgcagaccttcagcgtcgtctgcctcctcgtcagcgccttcgcgctcgtcggctccatcgaggggctcgtcacccagaagctggggtaggacacgcctggctcgtgtagtgtgtgtgtgcccttcctcgatcgtctgtgttttgcattggattgcttctcttcctgttgtagtgggctagtggcaatggagaacgcagcgagtggggaggatggcgtctctctccctgggatgacgaggagcagcagcataccagtggcaggtcatctgcgttctgcaggacccgggagtgccgggttgcgcagtgttctttgatgccttcctgctgcattagagacttaaagagtgaaacatgtacacagtgtcacattgcatacatgtagtggtattgcccaagacacttcagaagttcagaagaactaatttgaggaacc

SEQ ID NO: 28955 - protein, 462 aa, Panicum virgatum
  misc_feature: Ceres CLONE 1888274
  misc_feature (25)..(458): Pfam Name: Aa_trans Pfam Description: Transmembrane amino acid transporter protein
MAVRDSLEVVDGRCGCDDDGRRPRRAGTAWTCAAHVITAVIGSGVLSLAWSVAQLGWVVGPACMLCFALVTYASAALLADCYRRGDPGKGLPRNRSYTDAVRAYLGKKHTWACGSLQFVSLYGCGVAYTITTATSIRAILKANCYHEHGHDASCSYGGSYYMLVFGAAQLLLSFIPDFHDMAWLSVVAAVMSFSYAFIGLGLGLATTITNGTIKGSITGVPMRTPVQKIWRVSQAIGDIAFAYPYSLILLEIQDTLKSPPAENKTMKRASMISILVTTFFYLCCGCFGYAAFGSDAPGNLLTGFGFYEPYWLIDFANACIILHLLGGYQVYSQPIFQLADRFFAERFPDSGFVNDVHTVRVPCLPPWRVNLLRVCFRTLYVASTTAVAVAFPYFNEVLALLGALNFWPLAIYFPVEMYFIQRNVPRWSARWVVLQTFSVVCLLVSAFALVGSIEGLVTQKLG

SEQ ID NO: 28956 - DNA, 396 bp, Panicum virgatum
  misc_feature: Ceres CLONE 1888296-R
  misc_feature: Encodes the peptide sequence at SEQ ID NO. 28957
gaggcatatgaacgactcatcttggatacaatacgaggaggccagcagcactttgttcgcagagatgagctaaaggctgcttggcagatcttcactcctttgctgcatgacattgatgacggcaagctgaaggccgttccatatcaacctgggagtcgaggccccaaggaagctgatgaattgagcacgagagttggttatgtccagacccacggttatatatggataccacccacccttgcatagaagagaaaggtctttttccatggcctcataggaattgtgtatctaggaagagtgccctacaataaagtcacgaatatatatcaacgcccattttcactgtaccaacaactacagcaactccgatatgaaataaaaatgcatgtttcaatc

SEQ ID NO: 28957 - protein, 81 aa, Panicum virgatum
  misc_feature: Ceres CLONE 1888296-R
  misc_feature: SWISSPROT Homolog: EC 1.1.1.49 Glucose-6-phosphate 1-dehydrogenase
EAYERLILDTIRGGQQHFVRRDELKAAWQIFTPLLHDIDDGKLKAVPYQPGSRGPKEADELSTRVGYVQTHGYIWIPPTLA

SEQ ID NO: 28958 - DNA, 606 bp, Panicum virgatum
  misc_feature: Ceres CLONE 1888296
ctgcgcatctgacggccccgccctctctcccagctccggcgacgattccccgatggcctccgccgccggcagcgccgtgacactccggcgggtgctgctcgcgtctgccgcgctccggctcgcactggtggtgttcggggagtggcaggatgctcacctcgaggtgcgctacaccgacgtcgactacctcgtcttctccgatgccgctgcctccgtcgccgccggcggatccccgttcgcccgcgcgacctaccgctactctccgctcctggccttcctgcttcttccgaactcactcctccatgccgcctggggcaagctcctcttctccgccgcagatttgctagtgggattgttcatagataccattctgaaactacgtggaatccctgagaaaatgcggatgtggtccgtgatagcttggctgttcaatcccttcacattcaccattggtacaagaggaaactgcgagccaatagtctgcgctgccatgctctggattctcatatgtttgatgaagggtgtaagctctgattctcttttgctgtttgttcagtttatcgctacctttgtataaagttgttataaatggaatatgataaaacc

SEQ ID NO: 28959 - DNA, 2214 bp, Panicum virgatum
  misc_feature: Ceres CLONE 1888310
  misc_feature: Encodes the peptide sequence at SEQ ID NO. 28960
aaagcctaaacaatttcaaaacgtgaagctctccttcccgtcgaccgtcgtctccgcgtcccgcacccaccccaacgacgcggcggcgaatcgccaccggccggccggcgaccgccgccggcgcgctccggcagcaatggcgctcgacctcgctgtcgcgggctcggcggcccgcaagccggaggtccaaaccctagcgcccgtgctgctcctgggtccgccacctccgccgcctatcccgccgacgccggggatgtacctcccaggtcccccgccccccggggttctcctgccgcgcccgatccccgccccgctcactcgcgaggtcatcgcgcacatggacgagtgccgcagccgctccctcctcaagttcatttccgatgtgggggctgtgccttcgctagaggacgagcagaggagggagcgggtggtacgcgaactgggcaagatagtgatggattgggcaaagagggtggcgtacgagcaggggaaacaacattggatcacatcagctgcggtgttgaccttcggctcctatgccttgggggcatacggacctgaatccgatattgatgttctctgtgtcggtccctatattacatcattgcaacatcatttttttgttgttctgcgacacatgcttgaagggaggccagaagtatcagaattgcattcaattgaaggagctaaggttccattgatgcgttttaaattcaacggaattttagttgactttccttatgtccaactcccagtgatcaatgctgcagaggctatacgtgcatttgatccccgcgtgctagagaatgttgatggggcaagctggaaatgtctatctggagttcgtgttaatagacagatcattcaattggttcctaatatgaagaagtttcaatatctgttgcggtgtcttaaactatgggcaagaaaaagaggacttcattgccatctacttggcttctttgctgggattcatttggcgattcttgctgcatatgtttgtcgcagacatccaaatgctagtataaatactttgttatctctgttcttcgatatttttgttcattggccttggcctctcccagtgagtttgcttgatccaccagctctttgtcggggtcctgatgggtgctctcacatgcccataatgttgccctgtattccaccagaattttgctcttctagtatgacagaaagtactttcagcaaaatcaaagaagaacttcagcgaggttatgctttgaccaaggataccaggactactgattttgactggagttggctctttgcaccttttccatacggtgcaagatacaaatgctttctccgtatatttctctctgctccgatggctgaagaattacttgactgggttggatgggtgaaatcacgtttccgcaaccttattctcaagctcgagagtcttggtgtttactgtgacccagatccatcggagcaagttgatcataccagtaatgagccgaatgctgtattcttctggggtctcatgtacagaaggaatattcaaatatgtacaagttctctcaaagaagacttcatgagaagtgtcctgaataacatctatggaaagaaaaagtgtgcccattcggatatcacaatgtccattgttgggtctccccagctgcccaaaagtgtttttgatcactcagtttactcagagaagctgccaccacatatgatggggcaccaactaatgaagcagagctacaatgcagttagttagggctccagtgtcatattgcccgtgagcttcgtttgtgcatatgagaacagtgagaagccgatgttgaggtcgtttccaacatcagaactcagaatttttgtctgtccctttagaggcaggggcttgctcatgcctgtggcacaaggaatatggaagtttttttcttggagctggatgtcgagagctggatcattcttcaagcatccagcacaaaatagggccattcaagcgacttattcctgttgtgaggcttgtgcaggtacatgtatattcatgtacacaacatagcatttggtatacaagtgacaaggaggtaccttgtagctgtatgtatactgtaggtattgtttgtacccggcagcaaaaaatgtgtaaattgcttcctgttgttagagatgctgctgggcagtgagcaaagatgtggacattggtatgaaatgggttgtgaatgaaagttataggtcgatacg

SEQ ID NO: 28960 - protein, 535 aa, Panicum virgatum
  misc_feature: Ceres CLONE 1888310
  misc_feature (69)..(387): Pfam Name: PAP_central Pfam Description: Poly(A) polymerase central domain
  misc_feature (388)..(518): Pfam Name: PAP_RNA-bind Pfam Description: Poly(A) polymerase predicted RNA binding domain
  misc_feature: SWISSPROT Homolog: EC 2.7.7.19 Polynucleotide adenylyltransferase
MALDLAVAGSAARKPEVQTLAPVLLLGPPPPPPIPPTPGMYLPGPPPPGVLLPRPIPAPLTREVIAHMDECRSRSLLKFISDVGAVPSLEDEQRRERVVRELGKIVMDWAKRVAYEQGKQHWITSAAVLTFGSYALGAYGPESDIDVLCVGPYITSLQHHFFVVLRHMLEGRPEVSELHSIEGAKVPLMRFKFNGILVDFPYVQLPVINAAEAIRAFDPRVLENVDGASWKCLSGVRVNRQIIQLVPNMKKFQYLLRCLKLWARKRGLHCHLLGFFAGIHLAILAAYVCRRHPNASINTLLSLFFDIFVHWPWPLPVSLLDPPALCRGPDGCSHMPIMLPCIPPEFCSSSMTESTFSKIKEELQRGYALTKDTRTTDFDWSWLFAPFPYGARYKCFLRIFLSAPMAEELLDWVGWVKSRFRNLILKLESLGVYCDPDPSEQVDHTSNEPNAVFFWGLMYRRNIQICTSSLKEDFMRSVLNNIYGKKKCAHSDITMSIVGSPQLPKSVFDHSVYSEKLPPHMMGHQLMKQSYNAVS

SEQ ID NO: 28961 - DNA, 641 bp, Panicum virgatum
  misc_feature: Ceres CLONE 1888318
  misc_feature: Encodes the peptide sequence at SEQ ID NO. 28962
tttccccttctctgcactccgggaagcacacggccggaagcaagggaccatggggcagaagcatcttctgttgctcacttgtttttgggtcctgtcatgtgccttgctgcttcatgcatcctccgatgggctgctaaaaatcaacctcaacaagaacagaatggacaagggagctttgacacctgccaaattagctaggaatgagagtcgccttcggagaaggttctatggttctcaccagtctctcggcgcctcatgcgatgacatatttcctttggacaactacctgtacactcaatactttggagagattgtcattggcacgacaccacagaacttcactgtgatatttgacactggaagctctaacttgtggattccctcctcgaaatgctatttctcgatagcatgctacttacaccacaaatacaggtcagccaagtcgaacacttacaaaaagaacggggaaacttgcacaataacatatggttctgggcaaattgctggcttcttcagtgaagacaatgtgttggtcagcaaccttattgtaaaaaatcagaagttcattgacactacccgttaaaccagccctacctttatcattgtaaagtttgacggaattcttggcctctgattacctg

SEQ ID NO: 28962 - protein, 177 aa, Panicum virgatum
  misc_feature: Ceres CLONE 1888318
  misc_feature (83)..(177): Pfam Name: Asp Pfam Description: Eukaryotic aspartyl protease
  misc_feature: SWISSPROT Homolog: EC 3.4.23.40 Phytepsin
MGQKHLLLLTCFWVLSCALLLHASSDGLLKINLNKNRMDKGALTPAKLARNESRLRRRFYGSHQSLGASCDDIFPLDNYLYTQYFGEIVIGTTPQNFTVIFDTGSSNLWIPSSKCYFSIACYLHHKYRSAKSNTYKKNGETCTITYGSGQIAGFFSEDNVLVSNLIVKNQKFIDTTR

SEQ ID NO: 28963 - DNA, 710 bp, Panicum virgatum
  misc_feature: Ceres CLONE 1888323
  misc_feature: Encodes the peptide sequence at SEQ ID NO. 28964
gacacgcacaaaatacaaaaatatcgtcgatcacctcacgtactagtttaaatgaatttcatttcataataatcactactccgtagtagcttttgcatttgcagcccgagcaaggaggcaaaagctagccaaatggaaatgcagccactctccctgctggcctcatggcctctcctcctcgtcctgctcctcctccccctcgtctgcttgctgtacctgcgccagcaggatcacggcagcaagcagcagccatcggacgacgacctcaagtcgtacccgatcgtcggcaggttccctcacctggtcaagaacggccaccgcctcatcgaatggtccgtcgaggtcgcgaagcgaagcccgacgcagaccacggccttcaaggccctcggcctgcccggcgtcgtcatcaccgcccacccggacaacgtcgagcacatcgccaagacgagcttcgccatctaccccaagggcgactacatgtcgtcgacgctcgaggacttcctcggccgcggcatcttcaactccgacggcgagcagtggctgtggcagcgcaaggccaccagcttcgagttcagcaaccgctcgctgcgcaagttcatcgtcgacaccgtccaggccgaggtcgccggccggttcctgccgctgctcgagcaggccgagcgccacggccgcgcgctggacatgcagcacgtcttcgagtgcttcgcttc

SEQ ID NO: 28964 - protein, 192 aa, Panicum virgatum
  misc_feature: Ceres CLONE 1888323
  misc_feature: SWISSPROT Homolog: EC 1.14.14.1 Unspecific monooxygenase
MEMQPLSLLASWPLLLVLLLLPLVCLLYLRQQDHGSKQQPSDDDLKSYPIVGRFPHLVKNGHRLIEWSVEVAKRSPTQTTAFKALGLPGVVITAHPDNVEHIAKTSFAIYPKGDYMSSTLEDFLGRGIFNSDGEQWLWQRKATSFEFSNRSLRKFIVDTVQAEVAGRFLPLLEQAERHGRALDMQHVFECFA

SEQ ID NO: 28965 - DNA, 702 bp, Panicum virgatum
  misc_feature: Ceres CLONE 1888344
  misc_feature: Encodes the peptide sequence at SEQ ID NO. 28966
gtaagctacttcagttgcaggcaggcgggtctttctatctagtcgtcttaataattaaaccaccagctagctagctccgatgactagctgcttcaacggcggcaccggctggccggagcccgtggtgcgcgtgcaggccgtgtcggacacctgcggcgacacgatcccggagcgttacgtcaagccgctgtcggagcggccgtcgctctcgccagccgccgccgacggcgccgggggcggcccgaacatcccggtcgtggacctgtcaatgccggacgcggacgcgacgtcccaagccgtggcggcggcgtgccgggagtggggcttctttcaggcggtgaaccacggcgtgcgcccggagctgctgcgccgcgcgcgcgcggcgtggcgcggcttcttccggcagcccgcggaggtgcgcgagcgctacgcgaactcgccggcgacgtacgagggctacggcagccgcctcggcaccgccaagggcggccccctcgactggggcgactactacttcctccacctcctgccgccgtccctcaagagccacgacaagtggccgtccctgcctgcctcgctgcgggagacgacggaggagtacggcgaggaggtggtgcagctgtgccggcgggtgatgcggctgctgtcgacggggctggggctggaggcagggaggctgcaggcggcgttcggcggggaggg

SEQ ID NO: 28966 - protein, 207 aa, Panicum virgatum
  misc_feature: Ceres CLONE 1888344
  misc_feature: SWISSPROT Homolog: EC 1.14.11.19 Leucocyanidin oxygenase
MTSCFNGGTGWPEPVVRVQAVSDTCGDTIPERYVKPLSERPSLSPAAADGAGGGPNIPVVDLSMPDADATSQAVAAACREWGFFQAVNHGVRPELLRRARAAWRGFFRQPAEVRERYANSPATYEGYGSRLGTAKGGPLDWGDYYFLHLLPPSLKSHDKWPSLPASLRETTEEYGEEVVQLCRRVMRLLSTGLGLEAGRLQAAFGGE

SEQ ID NO: 28967 - DNA, 1794 bp, Panicum virgatum
  misc_feature: Ceres CLONE 1888368
  misc_feature: Encodes the peptide sequence at SEQ ID NO. 28968
cctactgaagctgaaaaacatggtcgtatcatacaaccttgtcaaaattatatcatgagcaggttcagaatatgcaatgccaaagactattacaaatctgttcaagctccctacatgcttgaattaacctgccatacacgtgtatcacacactgaagagcctggttcatttcccaattatgtatacaacttgacaccattttctgaactgcaacaattcgttggtgacagaaagaaatttcatgatgtactcggaatactgattgaggccgctgaacctgaatggatatctttctccaatcaacctaaaccaaaccttcgtagaaatattttgctgcgagatgccaccggtaatgaggtacgagtttttctatggggccaaaaagcttccgcatttaacattgacaatttaaacgactcaagtggaccttcaccaaccacaattctgttaactggctgcctggtgaaaacattccaaggccaactttatctgagcggccactctgcttgtcactggtatataaatcctgaaattcccgaatctgagactctgctccaaagtgtcgggagccaaaatattacagttcgaaagacaggaacgcctctggaggatcttccagttcctcagactcaacagaacaaagaacacctaactcttagggagatgcaagatattgatccttatgaattcccagaaaaaggttgtatgtgtaccgttactataactcgcttgatagacgcctcaacatggtggttcccttcatgcaatttctgcaacaagtcatgtaagcaagaaggttgtgatttcatctgttatgaatgtgggactactaataaattttcttacaagtacaagctaaactttataaccagtgacggtacagaagaagctgaaatgatatgttttggtgagatcggccgtcggattgtaggaaagccagtcgaaacagttatgcgcaccccaaaaggaaatgatttactacctctagatgttgccggcattgcctcttccaaattcacatttactgtattaatgactgaaaagagctaccgggtgccgaagaaaagttatcgaataacttcaattgttaccgcctatggaaagcaaaagatcacaccaagcctctctcagaatgctccacaatcatctcaggacataggaacatctgataaagaaattgccaaagtagaaactatctctgcagcaagttgtccttcaagcagtcagctgtatggtctccttactcccacaaagacgctccctatacaatccatgcacttacagacaccagaaaaaagtgtcctactatcttccaaggatgctgatgtacaagttgtagaggatgctgaagcaacaaataaatctgcaaaaaaacgtctgtacacgtctgttatggaggcagaaaagtccaaagttccaaataagtcgtcagacaaagacatgcctgatataccaactgaacttgccaaaaatgatgccgccattccaagtctatctacaaagatggctgaaaaacaagagccaatcaatcaggaaaaggcaatttatggcaaaggaacaaaatccagcaagaaatgatgactgctgagccttttgtcaacctgctcagctacatcagcctacaaggatgctgctcacaaaacagctcaaactatctgatgaaacgttgtttactataacaactgaacttgagctgggttgcaataactgtctgcatcacttatgaagtatgcaaacgactattagaactactattaatatgtatgtgctgtccagtaatagaaatcagtagtt

SEQ ID NO: 28968 - protein, 525 aa, Panicum virgatum
  misc_feature: Ceres CLONE 1888368
  misc_feature (236)..(370): Pfam Name: Rep_fac-A_C Pfam Description: Replication factor-A C terminal domain
PTEAEKHGRIIQPCQNYIMSRFRICNAKDYYKSVQAPYMLELTCHTRVSHTEEPGSFPNYVYNLTPFSELQQFVGDRKKFHDVLGILIEAAEPEWISFSNQPKPNLRRNILLRDATGNEVRVFLWGQKASAFNIDNLNDSSGPSPTTILLTGCLVKTFQGQLYLSGHSACHWYINPEIPESETLLQSVGSQNITVRKTGTPLEDLPVPQTQQNKEHLTLREMQDIDPYEFPEKGCMCTVTITRLIDASTWWFPSCNFCNKSCKQEGCDFICYECGTTNKFSYKYKLNFITSDGTEEAEMICFGEIGRRIVGKPVETVMRTPKGNDLLPLDVAGIASSKFTFTVLMTEKSYRVPKKSYRITSIVTAYGKQKITPSLSQNAPQSSQDIGTSDKEIAKVETISAASCPSSSQLYGLLTPTKTLPIQSMHLQTPEKSVLLSSKDADVQVVEDAEATNKSAKKRLYTSVMEAEKSKVPNKSSDKDMPDIPTELAKNDAAIPSLSTKMAEKQEPINQEKAIYGKGTKSSKK

SEQ ID NO: 28969 - DNA, 711 bp, Panicum virgatum
  misc_feature: Ceres CLONE 1888389
  misc_feature: Encodes the peptide sequence at SEQ ID NO. 28970
tgttcaatctaccatccaagatcctatgcagtgtagtcaacgtggaactacgggcggaagctgattcagatgaagtttatgctcagatcatgctgcaacctgaagctgatcaaagcaaactcaccagcccggaccatgaactacaagaacctgacaaatgcactgctcattccttctgcaagacactgacagcttcagatacgagcactcatggcggtttttctgttcttcggaggcatgctgaagaatgtcttcctcagctggacatgtctcagaatccaccttgccaagaactggtggccaaagatctccatggcactgaatggcattttcggcacatttttcgaggacaaccgaagaggcatctccttactactggctggagtgtctttgttagctcaaaaagactggttgctggtgatgcatttatcttcatgagaggtgaaaatggtgagctacgagttggcgtaaggaggctcatgagacaagtaaatagcatgccctcatccgtcatatcaagccacagcatgcatcttggagtcttggcaacagcctcccatgccatctccactggaaccctcttttctgttttctacaaaccaagaactagccgctctgattttattgtgagcgtcaacaaataccttgaagctaagaagcagaaaatatctgttggaatgaggtttaagatgagatttgaaggtgatgaag

SEQ ID NO: 28970 - protein, 236 aa, Panicum virgatum
  misc_feature: Ceres CLONE 1888389
  misc_feature (57)..(162): Pfam Name: B3 Pfam Description: B3 DNA binding domain
  misc_feature (184)..(236): Pfam Name: Auxin_resp Pfam Description: Auxin response factor
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 100 in the 10/666,642 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 576 in the 10/666,642 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
FNLPSKILCSVVNVELRAEADSDEVYAQIMLQPEADQSKLTSPDHELQEPDKCTAHSFCKTLTASDTSTHGGFSVLRRHAEECLPQLDMSQNPPCQELVAKDLHGTEWHFRHIFRGQPKRHLLTTGWSVFVSSKRLVAGDAFIFMRGENGELRVGVRRLMRQVNSMPSSVISSHSMHLGVLATASHAISTGTLFSVFYKPRTSRSDFIVSVNKYLEAKKQKISVGMRFKMRFEGDE

SEQ ID NO: 28971 - DNA, 1645 bp, Panicum virgatum
  misc_feature: Ceres CLONE 1888392
  misc_feature: Encodes the peptide sequence at SEQ ID NO. 28972
acggggagatcccgtttcccatcgcttcccttccctccacatgttcgctcgcagacgcagcctccgacgcagctgcctccgcccttgacacgtcactaccaccacccctgcccgaccgccgccgccaccgcgaacgggccccaccaccgccgcgccgcgcccgcgcccgccggcggcggcgcgggggccggggccggggcgggcggcgtgtccatcgacgtgaacggcctgaagcggcgcggcggcgggccgcgctcgtgggcgcgcgtcgacgcggcgacgggggccgcggaggccgactaggtcgccactccggcgctgatgaggcgcctggacctgcccgcgcgcaacctccgcctcctcgaccggctcttcgtgtacccgtccgccatcctcggcagctagcgcgccgtcgtctgcgacctcgagcgggtgcgctgcatcatcaccgccgacgaggcgctcgtcctgcgcgagcaggacgcggaggaggccgtgcggaggtacgtcgacgagctgcagcgacgcctcgtggaccgcgccgacgacctgccgttcgagttcatcgctctggaggtcgcgctcgaggccgcctgctccttcctggactcgcaggctattgaattagaggctgaagcttacccattattagatgagctgacaacaaaaatcagcaccctcaacttggaacgtgtccggcgcctaaagagcaagctggttgcattgacaagaagagtccagaaggtcagagatgagatagagcagctgatggatgatgatggtgatatggctgaaatgtatctcaccgagaagaagatgaggatggaagaatcaatgttaaatgatgaggaccttcagggaattggcaataaccatagtgggttcagtgcatctctctcagctccagtttcaccagtttcgactccccctgcatctcggaggcttgagaaggaattcagtttcgccagaagcaggcacagcagcttcaaaagctcagatagcagtcagtacaacatagaagaactggaaatgttgttagaaggttactttgttgtcatcgattacaccctcagcaagttaacttcactgaaggagtatattgatgatacagaggatttcatcaacatacagctggataacgtccggaaccagctgatccagttcgagctgctcctgaccaccgccacattcgtggtggccatcttcggcgtggtctcgggggtcttcggcatgaacttcgaggtccctctgttctcggtgccccacgcgttcgagtggacccttgccataacaggggtctgcggcgccgtcgtgttctgctgcttcctctggtacttcaggaagaggaggtttttccccttgtagatggaagctctcaggccaggtgttccttcccttcttttctcctcctccggtcctcccttcctccatgctgctgtggataaagcagcatacacattgcaagttggtcacggcaattgtacatgcatttttctcgaatgcgcggcgatgaagccctgctgtctggatctggacacgtgatctttctcctttcgagcttacgggcgctgatcctgtagctttacccgtctacttgtacatcgtttactattgctgctttctacatgtgacgctgttccgcccg

SEQ ID NO: 28972 - protein, 198 aa, Panicum virgatum
  misc_feature: Ceres CLONE 1888392
  misc_feature (1)..(196): Pfam Name: CorA Pfam Description: CorA-like Mg2+ transporter protein
MDDDGDMAEMYLTEKKMRMEESMLNDEDLQGIGNNHSGFSASLSAPVSPVSTPPASRRLEKEFSFARSRHSSFKSSDSSQYNIEELEMLLEGYFVVIDYTLSKLTSLKEYIDDTEDFINIQLDNVRNQLIQFELLLTTATFVVAIFGVVSGVFGMNFEVPLFSVPHAFEWTLAITGVCGAVVFCCFLWYFRKRRFFPL

SEQ ID NO: 28973 - DNA, 1330 bp, Panicum virgatum
  misc_feature: Ceres CLONE 1888399
  misc_feature: Encodes the peptide sequence at SEQ ID NO. 28974
cccgagacagccgctcctccgccggccgcctcctccccctcctcgcggctcgcggcgcggccatccatcccacccccggaacacacccccgaccactggcacctcgcgccacggccccccgaccaccgccaccgccgcctttgactcgttgaccgacaagtgtgagcgccgccggccatggatgcgcgccgcaagctggggcagcagggcgccgccgcggtgccggcggcggcggcccggctgccgagggtgcaggccggggacgcgctgccgctgccgatccggcacaccaacctcatcttctcggccctgttcgcggtctcgctcgcctacctgatgcgccgctggcgcgagaagatccgcagctccacgccgctccacgccgtggggctcgccgagatgctcgccatcttcgggctcatcgcctcgctcatctacctcctcagtttcttcggcatcgccttcgtgcagtccatcgtctcctccagcgacgaggacgaggacttcctcggcgtcggggccggggctccggcgccgcccgccccgtgcgcgctgctggggagccccgccgccgcgcccgagaaaatgccggaggaggacgaggagatcgtcgccgcggtcgtcgccgggaaratcccgtcctacgtgctcraraccaggctcggggactgccgccgcgccgcggggatccggcgcgaggcggtgcgcaggatcacggggagggagatcgaggggctcccgctcaacggcttcaactattcctccgtcctgggccagtgcatcaagctgccggtcgggtacttgcagctgcccgtcggggtcgccgggccgctcctgctggacggccaaaagtactacgtgcccatggccacaaccaaggggtgcctcgtcgccagcaccaaccgcgaatgcaaggccatcgcgaagtctggcggcgccaccagcgtcgtgctccgcaacgggatgacccgcgctcccgtcgcccgcctccccaccgcgcgccgcgccgccaaggtcagggcgttcctcgaggatcctgacaatttcaagacgctttccatggttttcaacaggtcaagcaggttcgctaggctgcagggggtgcagtgcgcaatggcaggcaggaacttgtacatgaaattcacctcaagcacagggaacgccatgggtatgaacatgatctcaaagggcgtgcagaatgtgctggatttccttcaggatgacttccctgacatgaatgtcattagcatctcaggtaacttttgctctgacaagaagcccgctgctgtgaattggatcgaagggcgtgggaagtctgtggtttgtgagg

SEQ ID NO: 28974 - protein, 384 aa, Panicum virgatum
  misc_feature: Ceres CLONE 1888399
  misc_feature (152)..(384): Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
  misc_feature (159)..(159): Xaa is any aa, unknown, or other
MDARRKLGQQGAAAVPAAAARLPRVQAGDALPLPIRHTNLIFSALFAVSLAYLMRRWREKIRSSTPLHAVGLAEMLAIFGLIASLIYLLSFFGIAFVQSIVSSSDEDEDFLGVGAGAPAPPAPCALLGSPAAAPEKMPEEDEEIVAAVVAGKIPSYVLXTRLGDCRRAAGIRREAVRRITGREIEGLPLNGFNYSSVLGQCIKLPVGYLQLPVGVAGPLLLDGQKYYVPMATTKGCLVASTNRECKAIAKSGGATSVVLRNGMTRAPVARLPTARRAAKVRAFLEDPDNFKTLSMVFNRSSRFARLQGVQCAMAGRNLYMKFTSSTGNAMGMNMISKGVQNVLDFLQDDFPDMNVISISGNFCSDKKPAAVNWIEGRGKSVVCE

SEQ ID NO: 28975 - DNA, 628 bp, Panicum virgatum
  misc_feature: Ceres CLONE 1888399-R
gccggggagatatccctcctgtccgcactcgctgctggccagctcgtgaagagccacatgaagtacaacagatccagcaaggacatgtccaagatcgtgccttgatcctggatttggatcgtcgcagggggaagatggacggatccggatagtgaaaatgccgtggaataagtttttcatgtccggtggaagcgcagaggtggggttggagggactgggcatggacagggctgaggttgtttgacacctggtcactttcccaagagccaaaagaagaattcaccgtcgacatcaagtgagctgcgaacagtgtgcatcaagcgaaaccgtcaagattgtgaattggccaggtccttgttctggagctgacccatttctttcttgacgccggccactccaactcggtcatgaaaccctgccaccgccgtcccctgcgcgctgaccaccggagaagcgagctaaccaacctctgtgtttcgtgttcataaaagctttgatcaccttggtgcagaaagcgttgttgttattgttgtaggcccttgttagatctctcgccccttgcttcaggaagcagcagcttgtgaacctttttctattccccctttcagatctgcaactatttttctct

SEQ ID NO: 28976 - DNA, 2278 bp, Panicum virgatum
  misc_feature: Ceres CLONE 1888409
  misc_feature: Encodes the peptide sequence at SEQ ID NO. 28977
aacggaatcggattccccatggcagcatccaccacctcccatggcgccgccgctcgccgtcgttggcccggccgtagccgcgccgagcttccgcaccgcccgcatctcccgtctacggccgcggaagctcccctcttggccccgggctgccctccccaatgacgaggattactacttgatcgatgcggaggagtccattggggacggcttctccttcagtggagggaagtacggggaaggaccaagtaagtcggacgagtggtttgctcaggggaaaatggtaaatgcttaccctgtatatggggataaagggaaggcaaaggaccccttctttggcctgacgatgggatcaggatctcaaccttcagatgacgttttcagatggttctgtgtagaggctgggagctcttctaatcctatagtgcttttaattcatggcttgccatctcaggcatactcttatcgcaatgtgctgcctttactatcagacaaatatcatgccattgcttttgattggctcggatttggattttctgataagcctcaaccgaaatatggttttgactatactcttgatgagtatactgcgtccttgggatctctaatcaatgctgttgctcctgataagctctctattgttgtccagggctactttgctccagttgcagtcaaatatgctagtgaacatcaagacaaactgaaccatcttgttctagtgaatccaccgataactgataaacatgtgagccttccatctcccctggcttcattcagcaacttcttgttgggcgagatattttctcaggaccctctcagagctagtgataagttattgactagttgtggtccatacatgatgaaggaagaagatgctatggtgtatagaaggccataccttgtctctggttcctctggatttgcactgaatgcaataagcaaagctatgaaaaaggaccttaaggcatacattgaatccatgagaagcatattaggaagtgattcgtggaaaacaaagacgacagtatgctggggcatgagagatcgttggctcagctatgatggggtggaagagttttttgggggtctaaaccagaagattgtagagctgccaatggcaggacaccatgtgcaggaggaccgtggtgaagagttaggcaatataatcaaaagtatattcaggtaatcctgtttcttgctttcctcctctggtaagttttcaaatgggcaaacttaggttggctcttaataaagttaggcaataatgaatttatatctctgccatttttttataactaacaacttttcctgcttagaccggctcagtgataacaaactcaaaatcaaatctgcatgctacacattcattttaataacagaatgaataagcattcttcgtacataatacgtgtcaaaacatatttgatattactcaataactccctttgcagttttgtgcaatgaggaaagaaagcaggagacatttctcagcacttgtcagtatgcatgtttgggcagcttcaagggaagaacgtgtttcatcattaggcttaaggctgtgcacccttgtctatctaattaactctaaaacaatataaaatccaactagcaacggcaaggagacaagcatcccaaaaataaccctgcaaaattgagcaacaatatggwtaaggctgagaaattgcaggagcaagccttcaactactagcaacctgtagccagatcaaaatacttacgcggtactgagaacatcagcatgcaacccatattcttttgcgaatataaatgatgtgatggattgaggtagtgcagcctgtagaaagtttgtacaaatattagcctatgcataagttctatacttcaggtggaaacaaaatctcaagagatcaatattgtacacatatgctcgcattactcactagaaacaaattgaaaacacaatggggcaccaaattggctctcaaaaatgaatcgggtttgacatccttttatcatacggtaaatccaacttggcaaacagaaataatttttatctttgagcataaggaagctcctatctctctaaaacaaaactgataccattttacatccttttgtcatattatatatatgactcgaagtgtctaaaatctaaatggggcatcagtcaatacggcgaataaattattctcttctgttatttgacggtgctcctcatcaaaaacctttccttctcccaagaaagcaaacctttttttttatcgagttgaagttagttcatctccagtgagatgcgcattag

SEQ ID NO: 28977 - protein, 380 aa, Panicum virgatum
  misc_feature: Ceres CLONE 1888409
  misc_feature (152)..(377): Pfam Name: Abhydrolase_1 Pfam Description: alpha/beta hydrolase fold
  misc_feature: SWISSPROT Homolog: EC 3.8.1.5 Haloalkane dehalogenase
MAPPLAVVGPAVAAPSFRTARISRLRPRKLPSWPRAALPNDEDYYLIDAEESIGDGFSFSGGKYGEGPSKSDEWFAQGKMVNAYPVYGDKGKAKDPFFGLTMGSGSQPSDDVFRWFCVEAGSSSNPIVLLIHGLPSQAYSYRNVLPLLSDKYHAIAFDWLGFGFSDKPQPKYGFDYTLDEYTASLGSLINAVAPDKLSIVVQGYFAPVAVKYASEHQDKLNHLVLVNPPITDKHVSLPSPLASFSNFLLGEIFSQDPLRASDKLLTSCGPYMMKEEDAMVYRRPYLVSGSSGFALNAISKAMKKDLKAYIESMRSILGSDSWKTKTTVCWGMRDRWLSYDGVEEFFGGLNQKIVELPMAGHHVQEDRGEELGNIIKSIFR

SEQ ID NO: 28978 - DNA, 109 bp, Panicum virgatum
  misc_feature: Ceres CLONE 1888409-R
caaaacaggggcaggaggcaaaaagcggggaagcaacagggaaacgcacaaaccgcaacgaaaagggaggcggcaccgacccacagaggcaaacccacccccacgcggg

SEQ ID NO: 28979 - DNA, 723 bp, Panicum virgatum
  misc_feature: Ceres CLONE 1888431
  misc_feature: Encodes the peptide sequence at SEQ ID NO. 28980
atgagtgtttgttttttcagcttcgatttcggattttgttgtcgagggaatttgaagggggggtgtttttacgagctattcggcgggctggaatgcagatggagatcacggtgaggcggtcgacgatggtgcgcccggcgcgggagacgccgcggcagcggctgtggaactccaacctcgacctcgtggtgccgcgcttccacacgcccagcgtctacttctaccgccgcggcggccccgaggtggaggggttcttcgacagcgagcggatgcggcgcgcgctggcggaggcgctcgtgccgttctacccgatggcggggcgcctcgcgcgggacgaggacggcagggtcgagatcgactgcaacggcgaaggggtgctcttcgtcgaggtcgacgcgcccaacgccgccgtcgacaactacggcgatttcgcgcccaccatggagctcaagcgcctaatcccggcggtcgattacaccgatgacatctcggccttcccgctcctcgtgctccaggtgacttacttcaaatgtggaggcgtctcccttggtgttggcatgcaacaccatgtagcggatggcatgtccggcttgcacttcatttactcatggtctgacctctgccgtggagctcaaatttctgtcatgcccttcattgaccgcactctcctccgcgctcgtgatccaccgactccatctttccaacatattgagtaccagcctg

SEQ ID NO: 28980 - protein, 208 aa, Panicum virgatum
  misc_feature: Ceres CLONE 1888431
  misc_feature (1)..(208): Pfam Name: Transferase Pfam Description: Transferase family
  misc_feature: SWISSPROT Homolog: EC 2.3.1.144 Anthranilate N-benzoyltransferase
  misc_feature: Functional homolog of the protein sequence given in SEQ ID NO 51297
  misc_feature: Useful for making plants with altered carbohydrate content
  misc_feature: Functional homolog of the protein sequence given in SEQ ID NO 50937
  misc_feature: Useful for making plants with altered cell wall content and/or composition
  misc_feature: Useful for making plants with altered lignin content
MEITVRRSTMVRPARETPRQRLWNSNLDLVVPRFHTPSVYFYRRGGPEVEGFFDSERMRRALAEALVPFYPMAGRLARDEDGRVEIDCNGEGVLFVEVDAPNAAVDNYGDFAPTMELKRLIPAVDYTDDISAFPLLVLQVTYFKCGGVSLGVGMQHHVADGMSGLHFIYSWSDLCRGAQISVMPFIDRTLLRARDPPTPSFQHIEYQP

SEQ ID NO: 28981 - DNA, 551 bp, Panicum virgatum
  misc_feature: Ceres CLONE 1888441
  misc_feature: Encodes the peptide sequence at SEQ ID NO. 28982
gtcggatgccgccgccctgccgcaggtaatgccgtgaccggccgccgagcgacggacgacggtcgacgaggctgcgcgccaccgacgccgcgacgcgatgggcgagaggaggaggcgcgggagcgctgctgccgccgccgcccccggaggtggcgtcgcgcgggttgctgaggaggagaaggccgcggcggcggcgccggggaaggggccgccgccgacggtgtggttcgcgctcaagcggtcgctgcactgccgctcggagccgtcggaggtccacgtgccgagggccaaggcggccggccccgccgcgggcgccgggcacctgtcgtcgatcgccaccaagcgcgccgcgccgcggtcggggtgctcgcgctccatcgccaacctgcgggacgtcatccacgggagcaagcgccacccggggcagccgcccagctgcagcccgcggtccatcggcagcagcgagttcctcaaccccatcgcgcacgaggtcgtgctcagcaccaactcccgctgcgagctcaagatcaccggcttcggcggctgcgggg

SEQ ID NO: 28982 - protein, 151 aa, Panicum virgatum
  misc_feature: Ceres CLONE 1888441
  misc_feature: The sequence is a functional homolog of SEQ ID NO 1546 in the 10/666,642 US patent application
  misc_feature: The sequence is a functional homolog of SEQ ID NO 652 in the 10/666,642 US patent application
MGERRRRGSAAAAAAPGGGVARVAEEEKAAAAAPGKGPPPTVWFALKRSLHCRSEPSEVHVPRAKAAGPAAGAGHLSSIATKRAAPRSGCSRSIANLRDVIHGSKRHPGQPPSCSPRSIGSSEFLNPIAHEVVLSTNSRCELKITGFGGCG

SEQ ID NO: 28983 - DNA, 1379 bp, Panicum virgatum
  misc_feature: Ceres CLONE 1888484
  misc_feature: Encodes the peptide sequence at SEQ ID NO. 28984
atgacccggtagtagtagaaaggaaacgccccccgacgacctgctcctcagtttgctccccttccgcctccgcgtccgcttcccatcttggcctggacacctgggctgcccccctccgtttccgcgctccccggatgcgcaccgatctcgcgccgcgcgcctaagtcgccgccggaatccgcccctccctcgcgccgctgccagcgtcgggcgacaaggtgatactggtgccaaggtaggacgagaggggtcaagttcttactggtttcattcttgaagccgccgacttcacatgccaacaaccccgaggagcagaagccaggctaggaccactaggccttggatcttgccagggatggactttgcggattcaagacggaagcctaatttcacggggaagattgctgtggctgctgccctcactgtcatgtgcataattgtattgaaacagtcgcctggtttcagcggtaccaatgtgttctctcgccatgaaattggggtgacccatgtcttagtgacaggaggggctgggtatattggctcgcatgctactcttcgtctccttaaggacaactaccgtgttaccattgtggataacctttccagaggtaacatgggagctgtaagagttcttcaacggctgtttccacagcctggaaggcttcaatttatttatgctgatttaggcgatgccaaagctgtgaacaaactattttcggaaaatgcatttgacgctgttatgcactttgcggctgttgcttatgttggggagagcacaatggagccactgaggtactaccacaacataacatcaaatacactgacagtgcttgaggcaatggcggcgcataatgtaaatactctgatttactcgagtacttgtgcaacgtatggtgaacctgatacgatgcctattgtagaaactactcctcagaatcctatcaatccttatggtaaggcaaagaagatggcagaggatatcatcttagatttcacaaagtcgaagaaatcaaacatggctgtcatgatcttaagatacttcaatgtgattggatctgatccagaggggcggctaggagaagctccaaggccagagctgcgtgagcatggtcgaatttctggtgcttgcttcgatgcagctttgggaatcatttcagggcttaagattcgtggaactgattaccccactacagatggaacttgcatcagagactacatagatgtcacagatcttgttgatgcccatgtcaaagctcttgataaggctcaacctggcaaagttggaatctacaatgttggcacaggccaaggtagatcagtgaaggagtttgtagaagcttgcaagacggcaacaggagcttccatcaaggttgaatatc

SEQ ID NO: 28984 - protein, 341 aa, Panicum virgatum
  misc_feature: Ceres CLONE 1888484
  misc_feature (52)..(315): Pfam Name: Epimerase Pfam Description: NAD dependent epimerase/dehydratase family
  misc_feature: SWISSPROT Homolog: EC 5.1.3.5 UDP-arabinose 4-epimerase
  misc_feature: Functional homolog of the protein sequence given in SEQ ID NO 51011
  misc_feature: Useful for making plants with altered carbohydrate content
  misc_feature: Functional homolog of the protein sequence given in SEQ ID NO 50959
  misc_feature: Useful for making plants with altered cell wall content and/or composition
MDFADSRRKPNFTGKIAVAAALTVMCIIVLKQSPGFSGTNVFSRHEIGVTHVLVTGGAGYIGSHATLRLLKDNYRVTIVDNLSRGNMGAVRVLQRLFPQPGRLQFIYADLGDAKAVNKLFSENAFDAVMHFAAVAYVGESTMEPLRYYHNITSNTLTVLEAMAAHNVNTLIYSSTCATYGEPDTMPIVETTPQNPINPYGKAKKMAEDIILDFTKSKKSNMAVMILRYFNVIGSDPEGRLGEAPRPELREHGRISGACFDAALGIISGLKIRGTDYPTTDGTCIRDYIDVTDLVDAHVKALDKAQPGKVGIYNVGTGQGRSVKEFVEACKTATGASIKVEY

SEQ ID NO: 28985 - DNA, 430 bp, Panicum virgatum
  misc_feature: Ceres CLONE 1888484-R
cccaggcgtggaaatggcagaaagcccacccaaatggatacggatcagcctgattcagagtttaataggttcatcacgcagattcgtgggtccatgtgcagtcatataggcttcatcagactctttgttcttgaccatagaaaaagcatcggggacagtcacagaaagtcctgaaattttttgattcatgggtccatgtgcagtcaaatggaagaagacggaatcacagagagaatggcttacgtgttccttgattaggttcatatatatataggttctcttttgagtgttgacattttatttgttttgatatgtgccgaggcactatataataacacaaatgcaaaattgtgttgtagacagagtagatgaatcgtttgtacggaacctattatggtggtggaatgaaaggatataaataagtttatgt

SEQ ID NO: 28986 - DNA, 1357 bp, Panicum virgatum
  misc_feature: Ceres CLONE 1888487
  misc_feature: Encodes the peptide sequence at SEQ ID NO. 28987
gcaaaactgcggccattcattctgcctacctcctccgtatgaggcagctcgtgctcgttcgggactgagacacacccgaacgttcgcggccgcctccctccgcccagatctcgccgccgacgagatgctccgccgcggcgtgctcctcctggcggccgtcctcctcgccgtcgcgcgcccacctcacgcatatgcatccgaggccgaccacaagtacaaaacagaagaaccggttaagctatgggtaaacaaagttggaccttacaataaccctcaagaaacatacaactattacagcctcccattttgccaaccatctgaaaaccccacacataaatggggtggactgggagaggtcctcggtggaaatgagctgatcgatagtcagattgatatcaaattcttaaaaaatgtggacaagggccccatatgcacaattgaccttgatgctcaaaaggttcagcagttttctgatgccattgagagctcatattggtttgagcttttcatagatgatctgccattgtggggtttcgttggggaaactgacaaaaacaatgagaacaagcactacctttacactcacaagaacattgttgttaaatacaatggtaacaggataattcatgtcaatctcacgcaagagtcacctaagcttcttgaagctggtaaaaagttggatatgacatattcagtaaagtgggtgcaaacaaatgtggcatttgcacggcgttttgaagtttacttggactacccattctttgaacatcagattcattggttctccatcttcaattcattcatgatggttattttcttgactggtttagtgtcaatgatattgatgaggacactaagaaatgattatgcaaaatatgctcgtgaagatgacgacctggaatcccttgagcgagatgttaatgaggaatctggatggaagcttgtccatggcgatgtatttcggcctcctcgtggcctggtgtttctttctgcccttgttggtattggcactcagctggcagctcttatcctgcttgtgattgtgttggccatagttggcatgttatatgttggacgaggagctatcatcacaacctttattgtgtgctatgctcttacatccttcatctctggatatgttagtggtggcctctattcaaggaatggtggtaaaaactggataaagtccatgatccttacggcatccctttttccattcttgtgcttctcaattggattagtgttaaacaccattgctatcttctaccgatcattagcagctataccatttggtacaatggttgtcatatttgttctttgggctttcatctccttcccattggtgcttttgggaact

SEQ ID NO: 28987 - protein, 410 aa, Panicum virgatum
  misc_feature: Ceres CLONE 1888487
  misc_feature (52)..(410): Pfam Name: EMP70 Pfam Description: Endomembrane protein 70
MLRRGVLLLAAVLLAVARPPHAYASEADHKYKTEEPVKLWVNKVGPYNNPQETYNYYSLPFCQPSENPTHKWGGLGEVLGGNELIDSQIDIKFLKNVDKGPICTIDLDAQKVQQFSDAIESSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGLVFLSALVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLG

SEQ ID NO: 28988 - DNA, 659 bp, Panicum virgatum
  misc_feature: Ceres CLONE 1888487-R
  misc_feature: Encodes the peptide sequence at SEQ ID NO. 28989
tacttatttcctgttgaatgctgagaactatcactggcaatggacatcattcttctctgctgcttctaccgccttgtatgtatatttatactccatatactattatcatgtgaagacaaagatgtcaggcttcttccagacaagcttctactttggttacaccctgatgttctgtcttggattgggaatactttgcggtgctgttggctacgtgggctctactctatttgtgaggagaatctaccgaaatatcaaatgcgactaaatttctgcaccttgctgatagaggctgttagcaaattatgtcttgtcgcagtctggtgcggagtaatacttgattctgattaacttctgaaactacacaggaggtcgctctccctctgtttactccttttttggcctatctatttcctccatggaactgccctgataaatgtattcctattagttggggaattagtctgaggtgaggactggaaagtacatgtaggttcttttgtgaggcctcttttggtcagttgtaggagttcattgatgaatattactgcagtgcagattccagtgggctagatttgcccctcttatgaattgccacatccagttttcataccctctttgtagtataagcaagctaatatattgaagttacatgtattctc

SEQ ID NO: 28989 - protein, 87 aa, Panicum virgatum
  misc_feature: Ceres CLONE 1888487-R
  misc_feature: Functional homolog of the protein sequence given in SEQ ID NO 50395
  misc_feature: Useful for making plants with altered cell wall content and/or composition
TYFLLNAENYHWQWTSFFSAASTALYVYLYSIYYYHVKTKMSGFFQTSFYFGYTLMFCLGLGILCGAVGYVGSTLFVRRIYRNIKCD

SEQ ID NO: 28990 - DNA, 1856 bp, Panicum virgatum
  misc_feature: Ceres CLONE 1888533
  misc_feature: Encodes the peptide sequence at SEQ ID NO. 28991
gctgattgctggctcagcgaactcttcttccgaatccttcctccctacagcgcggcgcaaccgcgctccggcacttcgtggcttcgtgctccccctctctcacgcgcgcggacgcgccatgacgtcagggctccgagctcacgcgggcacgatccataaagccgcgacccagcattccgggcctctccccgccccggcccccgacgaccgccagcctccggcacgaccggccatggagtccgccgcctgccccgcgcgcgccgccgcgtccgtcgacctccgctggctgctctcggtggccgcgggggggctcttcgcgctgctcctcctgctcgccgcctccccgttccagctcccctcctcctcccgcctcttcctctccccagcctcctcctccacccagcagcgcccgccgccgccgctctacgtcgagtccacgctctcccgcgcggcgccccccgccgcctccctcccgccgcgcttcgcgtacctcatctccggctcggcgggggacgccggcatgatgcgccgctgcctgctcgcgctctaccacccccggaaccgctacatcctccacctcgacgcggaggcgcccgacgccgaccgcgcggggctcgccgccttcgtcgcggcgcacccggtcctgtccgccgccgggaacgtcagggtgatcgagaaggccaacctcgtcacctacaggggccccaccatggtgaccaccacgctgcacgccgccgcggcgttcctgtggggcgagggccacggccgcggcgccgactgggactggttcatcaacctctccgcctccgactaccctctcgtcacgcaggacgatttgatgcacgtcttctcgaagctgccgcgcgacctcaacttcatcgatcacacgagcaacatcagctggaaagcgttcgcgagggcgatgccggtgatcatagacccggcgctgtacatgaagacgaagggcgacctgttctgggtgccggagaagcggagcttgccgacggccttcaagctcttcactggttctgcgtggatggtgctgtcgcgtgcgttcgtggagtacctgatctgggggtgggacaacctgccgcgcacggtgctcatgtactacgccaacttcatctcctcgccggagggctacttccacacggtggcctgcaacgcggcggcgttccgcaacaccaccgtcaacagcgacctacacttcatctcctgggacaacccgccgatgcagcacccgcaccacctcaccctcgccgactgggaccggatgctcgccagcggcgcgcccttcgcgcgcaagttcccccgggacgaccccgtgctcgaccggatcgacgccgacgtcctcggccggcggccgggcgccgccggcacggtcgcgccgggcgggtggtgcgctgctggtggcggggagggcgacgggagcggcgccggcggcgacccgtgcgcggcggtcggcgacgcggcggccctgaggcccgggcccggggccgagcggctgcagcggctcgtgacgtcgctgctgtcgtcggagaacttccggccgaggcagtgcgtcgtggaagaggagaactgatgatgagctggtggtatggacgtatggtgctccgccgatccgttctggcaggcgttccagcatggcgcctggcaatgctggggttgtgccagtgtcacggcaaacgcacggcatgtagatgatacctgaagatgcatgcatggtacatgatgctaggtgccggctatcgatccatccttctcttggatacatatatatacatgtcagtatgcataaaaaggggacgaaatgtgtgccctcatatatgatattgataatacctattcgttcttct

SEQ ID NO: 28991 - protein, 449 aa, Panicum virgatum
  misc_feature: Ceres CLONE 1888533
  misc_feature (84)..(314): Pfam Name: Branch Pfam Description: Core-2/I-Branching enzyme
  misc_feature: SWISSPROT Homolog: EC 2.4.2.26 Protein xylosyltransferase
  misc_feature: Functional homolog of the protein sequence given in SEQ ID NO 50706
  misc_feature: Useful for making plants with altered carbohydrate content
MESAACPARAAASVDLRWLLSVAAGGLFALLLLLAASPFQLPSSSRLFLSPASSSTQQRPPPPLYVESTLSRAAPPAASLPPRFAYLISGSAGDAGMMRRCLLALYHPRNRYILHLDAEAPDADRAGLAAFVAAHPVLSAAGNVRVIEKANLVTYRGPTMVTTTLHAAAAFLWGEGHGRGADWDWFINLSASDYPLVTQDDLMHVFSKLPRDLNFIDHTSNISWKAFARAMPVIIDPALYMKTKGDLFWVPEKRSLPTAFKLFTGSAWMVLSRAFVEYLIWGWDNLPRTVLMYYANFISSPEGYFHTVACNAAAFRNTTVNSDLHFISWDNPPMQHPHHLTLADWDRMLASGAPFARKFPRDDPVLDRIDADVLGRRPGAAGTVAPGGWCAAGGGEGDGSGAGGDPCAAVGDAAALRPGPGAERLQRLVTSLLSSENFRPRQCVVEEEN

SEQ ID NO: 28992 - DNA, 670 bp, Panicum virgatum
  misc_feature: Ceres CLONE 1888544
  misc_feature: Encodes the peptide sequence at SEQ ID NO. 28993
aagcgcagaaacacacacacacacacacacacacacagcccgaagagaccttcttgtcattgatctcccacggacattgccatttgccaacaggcccaacacgaacgagcagcagcctagttcgccgatgggtctcagattcgcgagcgaaggcagcaacatggctcgcgtactctcgttggtgttgttattggccacgctctcgagcatcctgccgccgtccgcgagccaggcggcaaccaggtgcgagtacccgaggcacgccgggcacgggtacaagcacccggtgggcgtgcggaaggtggtcgtggacgccggcggcgccggcgacttcacctccatccagcaggccgtcgactcagtgccggtgaacaacaccgtgcgcgtcatcgtgcagatcaacgccggcacctacagggagaaggtgctggtgccggcgtcgaagccgtacatcacgttccacggcgccgggcgtgacgtgacggtggagtggcacgaccgtgccagcgaccgcggccccgacgggcagccgctccgcacctacaacaccgcctccgtaaccgtcctctcttactatttcaccgctaagaacatcagcttcaaggtgagcacccgttcgcccagtggtccatgatgagagcgtcgtcgtcgtcgtcgtacgcgaggtcac

SEQ ID NO: 28993 - protein, 157 aa, Panicum virgatum
  misc_feature: Ceres CLONE 1888544
  misc_feature (47)..(157): Pfam Name: Pectinesterase Pfam Description: Pectinesterase
  misc_feature: SWISSPROT Homolog: EC 3.1.1.11 Pectinesterase
  misc_feature: Functional homolog of the protein sequence given in SEQ ID NO 51298
  misc_feature: Useful for making plants with altered cell wall content and/or composition
MARVLSLVLLLATLSSILPPSASQAATRCEYPRHAGHGYKHPVGVRKVVVDAGGAGDFTSIQQAVDSVPVNNTVRVIVQINAGTYREKVLVPASKPYITFHGAGRDVTVEWHDRASDRGPDGQPLRTYNTASVTVLSYYFTAKNISFKVSTRSPSGP

SEQ ID NO: 28994 - DNA, 693 bp, Panicum virgatum
  misc_feature: Ceres CLONE 1888545
  misc_feature: Encodes the peptide sequence at SEQ ID NO. 28995
gtgtatccgagagactgagactctgacctctcagtcaaagctactgctcggtgaagagggcgaggccttggagcactcgaggccttgtggagactgggaggggatcttctccgcttccagaggccaagatcgagcgtccacctcgtccgctcacctcgatccagcaatgcgtgcggccgccggaggtgccccgccgcgacgtgctggtggtatccgtgtccgcgccccactggtggagtctgtctcctggtactgcagggtagatggaggtcttaaaaccgttgtaagtgctaggaagtttgtccctggtgcaaagctgtgcatgcaacctgatatcataccaaacaagcgcaagtcaaggagcttgcgcaaggagaggtcccaaactcaatcaccactgctacctgggcttcctgatgaactggctatttcctgtctcatgcgggttgctcgggttgagcacccaaatatgcggttagtatgtaaacgatggaaccgacttttgtctgggaattattattattccttgcgtaagaaattcggcatggcagaagaatgggtttatgtcttcaaaagggaccgtgatcagaagctatcttggtatgcctttgatccagtaaaccagctctggaagtcattgcctccacttccaccagagtattcagaagctgtttggctttgggtgtgcgggtc

SEQ ID NO: 28995 - protein, 175 aa, Panicum virgatum
  misc_feature: Ceres CLONE 1888545
  misc_feature (77)..(124): Pfam Name: F-box Pfam Description: F-box domain
MRAAAGGAPPRRAGGIRVRAPLVESVSWYCRVDGGLKTVVSARKFVPGAKLCMQPDIIPNKRKSRSLRKERSQTQSPLLPGLPDELAISCLMRVARVEHPNMRLVCKRWNRLLSGNYYYSLRKKFGMAEEWVYVFKRDRDQKLSWYAFDPVNQLWKSLPPLPPEYSEAVWLWVCG

SEQ ID NO: 28996 - DNA, 193 bp, Panicum virgatum
  misc_feature: Ceres CLONE 1888545-R
tccctgaaaacctgaggaacaacaggctaccagtggcagttaatgtgcgtttaactggatcaggaagtatctggaaacgaagagttctttgataccttcctgttgcatgagaaagataaagagtgtcatatgtacacagtgtcacattgcatccaggtagtggtatagctcaacacacttcagaagttgataa

SEQ ID NO: 28997 - DNA, 689 bp, Panicum virgatum
  misc_feature: Ceres CLONE 1888546
  misc_feature: Encodes the peptide sequence at SEQ ID NO. 28998
actcctctccgcgccgccgctccttcgagcgcacaaaccctcctcgcctccgccgccgctgccccgccgtcgctgccccgccgtcgctgccccgccgtcgccgaggaggaggaagaagaagaagaagaagaagcgccggccaagatgaagaccattctggcgtcggagaccatggacatcccggaggaggtcacggttaaggtggccgccaaggtggtgacggtggagggcccccgcgggaagctcacccgcaacttcaagcacctcaacctcgacttccagctgcaggacggcggccgcaagctcaaggtcgacgcctggttcggcacccgccgcaccatggccgccatccgcaccgccatctcccacgtccagaacctcatcaccggcgtcaccaaaggttaccgctacaagatgaggttcgtctacgctcacttccccatcaacgcctccatcaccaacggcaacaccgccatcgagatcaggaacttcctgggcgagaagaaggtcaggaaggtggacatgcttgagggtgtgaccatcttgcggtccgagaaggtcaaggatgagctcatcctcgacggcaacgacatcgagctcgtctctcgatctgccgccctcatcaaccagaaatgccatgtgaagaacaaggatatcagaaagttcttggatggcatctacgtcagtga

SEQ ID NO: 28998 - protein, 181 aa, Panicum virgatum
  misc_feature: Ceres CLONE 1888546
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASETMDIPEEVTVKVAAKVVTVEGPRGKLTRNFKHLNLDFQLQDGGRKLKVDAWFGTRRTMAAIRTAISHVQNLITGVTKGYRYKMRFVYAHFPINASITNGNTAIEIRNFLGEKKVRKVDMLEGVTILRSEKVKDELILDGNDIELVSRSAALINQKCHVKNKDIRKFLDGIYVS

SEQ ID NO: 28999 - DNA, 1938 bp, Panicum virgatum
  misc_feature: Ceres CLONE 1888547
  misc_feature: Encodes the peptide sequence at SEQ ID NO. 29000
atcccatctcatctcgtcgtcctccttcgccccaaaaccctaaccctagcgccggtcatggcgctcactagccgctgcggcggcggcggcggtccccaatcccgtttataatctttcccatcccatcccatctcatcgtcctccttcgccccaaaaccctaaccctagcgccggtcatggcgctcactacccgcggcggcgccggcggaggtgaccccgcgaagccgccgtccgcctccgaccccagcctaggcttccttaccaagcgcgacacggaggtcaagctgccccgcgccacgcgggtcaagaacaagacccccgcgccgatccagatcacggcggagcagatcctccgggaggcccgggagcggcaggagcccgagatacgcccgcccaagcagaagatcaccgacacccacgagctctccgagtaccgcctccgcaagcggaaggagttcgaggacgtcatccgccgcgtgcggtggagcgtctcggcgtgggtcaagtacgcgcgctgggaggagcagcagcgcgacttcgcgcgcgcgcggtccgtctacgagcgcgcgctcgacgtcgcccaccgcgaccacacgctctggctcaagtatgccgagttcgagatgcggaaccgcttcgtcaaccacgccaggaacgtctgggaccgcgcggtgtcgctcctcccgcgagtggaccagctatggtacaagtacatccacatggaggaactgcttggcgcagttgccaatgcgcgccaggtgtttgagcgctggatggcgtggcgacccgacacagcaggctggaactcctacatcaagtttgagttgcggtatggagaggtcgagcgtgccagggctatctatgagcggtttgtggccgagcatccacgaccagacaccttcattcgctatgccaagtttgagatgaagcgtggtgaagtagagagggcacgacgggtgtatgagcgtgcagcagacctgcttgcggatgatgaggatgcagaggtgctgtttgtggcatttgcagagtttgaggagaggtgccgtgaggttgagcgtgcgcgtgcaatatacaagtatgcgctggacagggtgcccaagggtcgggctgaggaattgtacaggaagtttttagcttttgagaagcaatttggtgaccgcgaggggattgaggatgccattgtgggcaagaggagatttcagtacgaggatgaggtgaggaagaaccctctgaactatgactcatggtttgattacatccggctggaggaaagtgttgggaatgaggacaggatccgggaggtttacgagagagccatttccaatgtgccccctgcagaggagaagcgatattggcagaggtacatatacctctggattaactatgcactttatgaggagcttgatgcacaagacatagagcgaaccagggaagtttacaaggaatgcctgaggctgattcctcacaagaagttcacattcgcaaagatatggctcatggcagcccagtttgagataaggcagagaaatcttaagtctgctcgacaaattcttggaaatgcaatcggggtggctccaaagggcaagatatttaagaaatatattgaaattgagctatatttgggcaatttcgaccgttgcaggactctctatgagaaatacattgaatggtccccagcaaactgttatgcctggaggaagtatgctgaattggaaaagaaccttagtgagactgatcgcgctcgatcaatatacgaacttgctattgcacagccagcccttgatacgccagaggttctgtggaaggagtacctgcagtttgaaattgatgaaagtgaatttggtagagcaagggatctatatgaaagactgcttgatagaacaaagcatttgaaggtatggatcagttatgctgagtttgaggcctcagctggcttgg

SEQ ID NO: 29000 - protein, 587 aa, Panicum virgatum
  misc_feature: Ceres CLONE 1888547
  misc_feature (119)..(151): Pfam Name: HAT Pfam Description: HAT (Half-A-TPR) repeat
  misc_feature (220)..(251): Pfam Name: HAT Pfam Description: HAT (Half-A-TPR) repeat
  misc_feature (553)..(584): Pfam Name: HAT Pfam Description: HAT (Half-A-TPR) repeat
MALTTRGGAGGGDPAKPPSASDPSLGFLTKRDTEVKLPRATRVKNKTPAPIQITAEQILREARERQEPEIRPPKQKITDTHELSEYRLRKRKEFEDVIRRVRWSVSAWVKYARWEEQQRDFARARSVYERALDVAHRDHTLWLKYAEFEMRNRFVNHARNVWDRAVSLLPRVDQLWYKYIHMEELLGAVANARQVFERWMAWRPDTAGWNSYIKFELRYGEVERARAIYERFVAEHPRPDTFIRYAKFEMKRGEVERARRVYERAADLLADDEDAEVLFVAFAEFEERCREVERARAIYKYALDRVPKGRAEELYRKFLAFEKQFGDREGIEDAIVGKRRFQYEDEVRKNPLNYDSWFDYIRLEESVGNEDRIREVYERAISNVPPAEEKRYWQRYIYLWINYALYEELDAQDIERTREVYKECLRLIPHKKFTFAKIWLMAAQFEIRQRNLKSARQILGNAIGVAPKGKIFKKYIEIELYLGNFDRCRTLYEKYIEWSPANCYAWRKYAELEKNLSETDRARSIYELAIAQPALDTPEVLWKEYLQFEIDESEFGRARDLYERLLDRTKHLKVWISYAEFEASAGL

SEQ ID NO: 29001 - DNA, 746 bp, Panicum virgatum
  misc_feature: Ceres CLONE 1888559
  misc_feature: Encodes the peptide sequence at SEQ ID NO. 29002
gttcccgtgcccctccttcccgagtgtccggggaggaccgagcgagaggacagtaggacaccactcgtcggctccgctccgtctcgctcgctgtgtcccccaggccccagaggcaggcagccggcgaacggccgaagcgcgccgccgcggagcaatggatttcaaggggttctgggagtccagattcgggggcaagaaggagcgggagccggagcagaacgggagcgccaacggcgaagccaacgggagcgccccgaagaggaccgccgatctggcggtctacgagcagttcgagcagcaggccaggcagacccaggtccgagctgccgcgatccgcgatggggctgccgatgtgatccagaagccccttcttccaccattcgagtcagctgaaatgcgtaatctcgcggagacattgttgagggatattattcgtgggagtccagatgtgaaatgggagagcatcaaaggattagagaatgcgaaacgccttctaaaagaggcagttgtcatgcccataaagtacccaaaatacttcactggtctcctttctccatggaaaggcatcttactttttgggcccccagggacaggaaagacaatgctggcaaaagcggtcgctactgagtgcaaaaccaccttcttcaacatttcagcatcatcaattgtcagcaaatggcgtggagattcagagaagcttgtcaaagttctgtttgagcttgctaggcatcatgcaccatccacat

SEQ ID NO: 29002 - protein, 197 aa, Panicum virgatum
  misc_feature: Ceres CLONE 1888559
  misc_feature: SWISSPROT Homolog: EC 3.6.4.3 Microtubule-severing ATPase
MDFKGFWESRFGGKKEREPEQNGSANGEANGSAPKRTADLAVYEQFEQQARQTQVRAAAIRDGAADVIQKPLLPPFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPST

SEQ ID NO: 29003 - DNA, 613 bp, Panicum virgatum
  misc_feature: Ceres CLONE 1888566
  misc_feature: Encodes the peptide sequence at SEQ ID NO. 29004
agaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggacctggacggccgcagcatcaccgtcggcgaaacgcaggggtggagtctgggcgtcgactacaccacctgggccaacggcaagaccttcaaggtcggagacatgctaacgttcaacttcgccaccgggagccacgatgtgttggaggtctccaagagcgactacgacgcctgcaacgccggcaacgccatgaacaccatccagaacggcccggccaccgtcaccctcaccgccggcagccactactacatctgcggcatcagcggccactgcggcggcggcatgaagctcgccgtcagcgtcggctccggc

SEQ ID NO: 29004 - protein, 175 aa, Panicum virgatum
  misc_feature: Ceres CLONE 1888566
  misc_feature (87)..(167): Pfam Name: Cu_bind_like Pfam Description: Plastocyanin-like domain
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50578
  misc_feature: Useful for making plants with altered lignin content
MAASDVEYRCFVGGLAWATDDNSLHNAFSPFGEVLESKIILDRETQRSRGFGFVTFSSEQAMRDAIEGMNGKDLDGRSITVGETQGWSLGVDYTTWANGKTFKVGDMLTFNFATGSHDVLEVSKSDYDACNAGNAMNTIQNGPATVTLTAGSHYYICGISGHCGGGMKLAVSVGS

SEQ ID NO: 29005 - DNA, 735 bp, Panicum virgatum
  misc_feature: Ceres CLONE 1888574
  misc_feature: Encodes the peptide sequence at SEQ ID NO. 29006
gcgaggagcgccttgctatcctttcttcagaactctctcctccgaactgccaaacccgtccctctcctcgccgtcgctcgcctcgcctcgcctcccgcggtcggatcaaaaccctagcaaacccttcctccctcgcggcccggtcggccggcgatggcttccgccgcgctcggaactcaggttgctgcagcagccttggagcccgtcggctcggacggtttcctcaagggctcgtcgcgcaagagtaacaattgtctaaacttccggagcaaaccatgggttgggaagagcttagcatgggaaaaaacccagcagtcaaggcatttgaacaaggtcttctgtatgtctgttcaacaagcaagcaaaagcaaagttgctgttaagcctgttgaattggagaatgcaaatgagccgccgctcaacttatacaaaccaaaggaaccttacacagccacgattgtctcagttgagaggcttgtaggccctaaagcccctggtgaaacatgccacattgtcattgaccatggcggcaatgttccatactgggaaggacagagttatggtgtcattcctccggcaagtacttccttgttctgctaagcataatgcagcacttctgtagttttgttttccttcatggactttacacattttccttccatttttttgccagtgtgtagtgttcactgaatagtctcttggattttcaaagattctttatttatcattgttgct

SEQ ID NO: 29006 - protein, 148 aa, Panicum virgatum
  misc_feature: Ceres CLONE 1888574
  misc_feature: SWISSPROT Homolog: EC 1.18.1.2 Ferredoxin--NADP(+) reductase
MASAALGTQVAAAALEPVGSDGFLKGSSRKSNNCLNFRSKPWVGKSLAWEKTQQSRHLNKVFCMSVQQASKSKVAVKPVELENANEPPLNLYKPKEPYTATIVSVERLVGPKAPGETCHIVIDHGGNVPYWEGQSYGVIPPASTSLFC

SEQ ID NO: 29007 - DNA, 626 bp, Panicum virgatum
  misc_feature: Ceres CLONE 1888575
  misc_feature: Encodes the peptide sequence at SEQ ID NO. 29008
agcagctagcatcacaagtaatccggccacacacaatcatcatccgatcctattgtcactctcgcacttgaaggttaagttccatccatggcggaggagaagcaccaccaccacctcttccaccacaagagggacgaggaggagcagcccgccggcgggtacggcggcgaggccgccaccgccgagtacacggagaccaccgtgacggaggtggtgtccaccggcgccttcgcgctgtacgagaagcacgaggcgaagaaggaccccgagcacgcgcaccggcacaagatcgaggaggagatcgcggcggcggcggccgtgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatttctccgtgtgctactgctacgtacgcgtgtactgtaagagtgagaggctgagaggtggccccgcgcgccagctgtgtgtgtgtgtgtttgctttcctg

SEQ ID NO: 29008 - protein, 112 aa, Panicum virgatum
  misc_feature: Ceres CLONE 1888575
  misc_feature (4)..(101): Pfam Name: ABA_WDS Pfam Description: ABA/WDS induced protein
MAEEKHHHHLFHHKRDEEEQPAGGYGGEAATAEYTETTVTEVVSTGAFALYEKHEAKKDPEHAHRHKIEEEIAAAAAVGSGGYAFHEHHEKKKDHKDAEEAGGEKKHHHLFG

SEQ ID NO: 29009 - DNA, 723 bp, Panicum virgatum
  misc_feature: Ceres CLONE 1888579
  misc_feature: Encodes the peptide sequence at SEQ ID NO. 29010
gcacgagcacgagcagcagctcgtccgcggtccgcctcccagcgcaaccatggccgccacctctacctccccgctattctccctctcctccatctccgcctcactcccttcccctacccggctccccaccaccctctccctccgcgccctctccccacgcgcctgcctctcggtctccctccccttcgcctccccacatggcgtatacgggacctgggccgcggcgtcgacgtcgacgtcgtcggcggggaggttgagacggcgggggctggaggtggtgtgtgaggccgcgacaggccggcggcctgactcggtcgcgaagagggagcgccagaacgagaagcaccgcatccgcaaccatgctcgcaaggctgagatgcgcaccaggatgaagaaggtcttcagagcacttgaaaagtttaggaagaaagctgatgcccagcctgaagaaataattgaaatagagaaaatgatctctgaggcttacaaagccatcgacaagacagtgcaagttggtgccctgcacatgaacactgggaaccatcgcaagtccagattggcaaggaggaagaaggccattgagatagtccgtggctggtatgttccaaatgctgaacctgttgctgccacctaggattcttgagaaatcattgtcatggattagtggaagcttttcattaaagctcaccaattttgggcgacatatgttatttcacggatctc

SEQ ID NO: 29010 - protein, 194 aa, Panicum virgatum
  misc_feature: Ceres CLONE 1888579
  misc_feature (84)..(176): Pfam Name: Ribosomal_S20p Pfam Description: Ribosomal protein S20
MAATSTSPLFSLSSISASLPSPTRLPTTLSLRALSPRACLSVSLPFASPHGVYGTWAAASTSTSSAGRLRRRGLEVVCEAATGRRPDSVAKRERQNEKHRIRNHARKAEMRTRMKKVFRALEKFRKKADAQPEEIIEIEKMISEAYKAIDKTVQVGALHMNTGNHRKSRLARRKKAIEIVRGWYVPNAEPVAAT

SEQ ID NO: 29011 - DNA, 1586 bp, Panicum virgatum
  misc_feature: Ceres CLONE 1888580
  misc_feature: Encodes the peptide sequence at SEQ ID NO. 29012
ctgcgggcggcgcaccgacgctcgtctaccatcgcagccgtttcgttcagtgatggcgcgggccgtgctgcttctgctcgcggccgccgtcgcagttctcctgccggacgccgccgagccccgcatcctcctcacgctcgacgacttcggcgccgtcggtgacggcgtcgcggacgacaccaaggtacgccaacgccgcttctcagaataatcagccgcacccggcgggtcgtcctcctacctgcgccacgacgcgattggctgcatcagtagcatctaccaaccggatgtgccttgtgctgtttctttctcgaggccctcgccggcgcatgggcggccgcgtgcgccgccgccgacagcgtcgtcctcaacgtgcccgccggcaggaccttccggatctggccgctcacgctcgccgggccctgcagcagcgagatcaagctgctcatttccgggaacatcgttgcgccggagagcccgggcgactggggctccggcgagcgcaggcagtggctccacttccacaaggtccaggacctgaaggtgaccggcggcggcatcatcgacggcagggggcagcagtggtgggcgcgcgaggagaaggtaaccgatggcgcaagcgcaacctgaggccgggtgttggggagtgacggcatggccaaactaaccgtgtgctctgctcgtgttcctgcagaatcgcgccgcgcagcctgctcccaaggcggttcactttgaggactgccaggggatcagcgtgaaaggcatcacgctgcagaacagccagcagtaccacctgacgttcacccggagctccgacgtcgaggccaattacctgagggtgacctcgccggaggacagcatcgacaccaaaggcatccacctagtcgactcgaaaaatgttcacgtcatggataaccttatatccacagaatggtgtcggtggtttcgcccgcaaggtgaagttcgagagcatcgtgatgaggaacgttactaaccccatcatcgtagatcagggaaactccgacgatctggcagattcatctgaagcaccggtagatactgcagcaggtagagaagatcaactacatcgacatcaagggggcgtcggtgtcggagcacgcggtcatgttctcgtgcagcgacaccaagccttgcaggcacctgtcgcaccaacgtgaacctgacccgggtggacgggcgcaagacgtcgccctactgccgcaaggcgttcggtaaaagtatcggcaccgtcatcccagagtcctgcctctccaaggaggaccacatccagcacgtcccacggcatcctgaagaaggcgaagaagaagattcagattcgtgaattcctggtgcttggccactagttaatgttgttctaagatctccagagtagtagttgctgctttggatcttggaactaggcgtctgttctttttcctagccctaaacatctagtgcagatatctgtgtgaactgaaggaccgtgttgttgccaagtttggctttctgtaatgggatacactttcagctaagattgcctatctttctgtgattaatcaggctaaactaaattaccatttttgcgc

SEQ ID NO: 29012 - protein, 52 aa, Panicum virgatum
  misc_feature: Ceres CLONE 1888580
  misc_feature: Functional homolog of the protein sequence given in SEQ ID NO 51299
  misc_feature: Useful for making plants with altered carbohydrate content
MARAVLLLLAAAVAVLLPDAAEPRILLTLDDFGAVGDGVADDTKVRQRRFSE

SEQ ID NO: 29013 - DNA, 2373 bp, Panicum virgatum
  misc_feature: Ceres CLONE 1888614
  misc_feature: Encodes the peptide sequence at SEQ ID NO. 29014
acgcctcacaatccactggagcagtctgccacccaccccctccacctcgcctggcctccactctggtcagacgctatgtatcaccgatacgcgatacgggtacggcgatatggatatggtgatatgtgagtttaaaaaacgatatagtggtagtatagagagtatcgaagtatggaagtatcgaatacggctgggttagcgaagtatcggtgattcgtataggtcagaagcgccgcacatagataccggggcggcggcacacgcaagaggggcctggccaagtagcctgaccgcttcttgctggctcctcctgtgctccgtttccttttctgctcccgggctccctctcctcgagttctcgcacgcctctcttcctcttgggttgggtccgtccagcaagtggagaaaggggcagggatgaagtccggggagcggccgaagctggtgcggggcctccggcaggagtcgcggcggttccggctgctggtcatcgtcgtcggcttcttcctcgtctccctcaccttcgtcgtcatctccaagcccgacgccatcctcttcagcctgaacggcaagctgccggtggagcaggcgccgacgtccatcctgatcaagcagaaggtcgactcgccgcccgccacctcccggaagactgccaccgacgctctcccaggtggagatcctagagtggtcgacgacgaagccgatgtgagaccaaaaggtaccaaacgcgaggaggaggagagccgggtgctgagcgagcccgacccgaccagcgggatgacggagctgaccgccaacaaggacgggggcggccgtaaatccgacgaggagacgttaggcggcgaggggaaagggaagcaggatggggaggagcgtgggcacgcggcggagaagcacaaagtcacgctcccaaccgtttccaattacaccattcatgactccgaggacaccgaaaatggcaagcaagacgacggtacaggttctgacctgcagggaagcaagcccctgtgtgatttctcaaactttagagcaaatgtgtgcgagatgcgtggtgatgttagggttcacccaaacgctacctcaatcatgtttatggagcctgccggttcgcagagagatgagctctggaagatcaagccataccctcggaagggggacgagttctgcctcagccatatcactgagctgacagtgaaatcaagcaaagtggccccagagtgcaccaagtaccacgacgtgcctgctgtgatcttttcactgacaggatacacggggaacctgttccatgatttcacggacgtgatggtcccccttttcacgaccgcaagcgagttcaatggtgaagttcagttcctcataaccgacatggcactttggtggacaatcaagtatcacactgtactccagaagctgtccaaatacccactgattgatttcagcaaggatgagcaggtgcattgcttcaagcatgtcatcgtcggcctccatgcttacatggagttcacaatcgactcgtccaaggccccgcacaactattctatggtcgacttcaacagattcatgcgcggagcttactcgctgcccagggacaccgttacagtgcttggagagtaccccaaggtcaagccaagattgctcatcatcaagaggcaccgaacgaggatgttcctcaacctcgatgagatcattgctatggctgaggagctcggctttgaggtggtgaccgatgaggccaatgtgagctctgacatctcaaagttcgccaggctggttaacacggtcgatgtgatgatgggagtccatggggctgggctcacaaactgtgtgttcctgccacagaatgccactctgattcagatcgtgccgtggggagggctggaatgggtatcccgcaccgatttcggcaacccagcagagctcatgggcatgcactacaagcaatacagcatcagcgtagacgagagcagcctcacggagcagtacccacgggaccatgagatcttcaagaaccctattgcattccataagcacgggttcgacttcatcaggcagactttcatggacaagcagaacgtgaagctggattgcaagaggttcaggccgattctcttggaggcattagacaatctcaacccatgaagattgtgatcgattgcttgttgggcatggtaatagagattcttgtacacaatccatttttttcttcaccattcgttcccgtttaattagtaagaaaaattcttgtttgttctatccttacctgagaatgtccccattctggaaattgtaggatagaagctgtgtgtacactgtataaattgctgtaggtgcaaagatggaacgaaattcattcaaatcacatatagcctcatc

SEQ ID NO: 29014 - protein, 573 aa, Panicum virgatum
  misc_feature: Ceres CLONE 1888614
  misc_feature: Functional homolog of the protein sequence given in SEQ ID NO 51300
  misc_feature: Useful for making plants with altered carbohydrate content
MKSGERPKLVRGLRQESRRFRLLVIVVGFFLVSLTFVVISKPDAILFSLNGKLPVEQAPTSILIKQKVDSPPATSRKTATDALPGGDPRVVDDEADVRPKGTKREEEESRVLSEPDPTSGMTELTANKDGGGRKSDEETLGGEGKGKQDGEERGHAAEKHKVTLPTVSNYTIHDSEDTENGKQDDGTGSDLQGSKPLCDFSNFRANVCEMRGDVRVHPNATSIMFMEPAGSQRDELWKIKPYPRKGDEFCLSHITELTVKSSKVAPECTKYHDVPAVIFSLTGYTGNLFHDFTDVMVPLFTTASEFNGEVQFLITDMALWWTIKYHTVLQKLSKYPLIDFSKDEQVHCFKHVIVGLHAYMEFTIDSSKAPHNYSMVDFNRFMRGAYSLPRDTVTVLGEYPKVKPRLLIIKRHRTRMFLNLDEIIAMAEELGFEVVTDEANVSSDISKFARLVNTVDVMMGVHGAGLTNCVFLPQNATLIQIVPWGGLEWVSRTDFGNPAELMGMHYKQYSISVDESSLTEQYPRDHEIFKNPIAFHKHGFDFIRQTFMDKQNVKLDCKRFRPILLEALDNLNP

SEQ ID NO: 29015 - DNA, 2889 bp, Panicum virgatum
  misc_feature: Ceres CLONE 1888632
  misc_feature: Encodes the peptide sequence at SEQ ID NO. 29016
tccctcgaatctcactcaggtctcccgcccgccagcacccaccggccggctcacctaccccgccggcgcggaaccctattcggcggccgcgtccctcttcatccccatggcggagcaggacggcgccgccgggcagagcccgctcgactctgctccggggattagtgctgaaaatggggatgggaatactgagcagcgtcaaccattcttctccatgtgccagtcaattcgctctgttagctactcaaattcgtgggaaagcatttgtgctcctgctgccaatgaaaatgaccccaatagtggcctgaactcaatggtggatgatcatgtcctgatcacatcttcttctcttggaagcgagcaccctgaacctgagggcatatctggtactgtagatggggacggaaagtcgcgttcaccacatcaaatcaataaggaagcctgtttggtagaagatgccatggaaatggaagtggatgaatttgatgtgccacatggagaaagaagtgagcagccagaaccttttagcacagagcagccccattcaattgatggattggatttatgggatgacaaagataatcagaaactgtttcccctcaacggcgaccagtgcaactccaatattgttgaagttggttatgctgaagataagctgtttccttcgtccttttctttcagaaggcaatcccaatctgtgggagcaggtcttagcaatatgggaaacacatgcttcttaaatgcaactcttcagtgcatcactcacactgtgccgctttttctcaagcttcgctcaactgatcattccactccatgttcatataataaagatggcttctgttctttctgtgcccttaaagaacatgtcgatgattcaattcgaaggtctggatctgttataatgccagtgaagttcagagataatttaagaaagttatcttctgattttagaccaggacagcaagaggatgcacatgaattcctacgttgcttgcttgataacttgcataagtgtacccttgatcccatgtcgaagggcaagggctcatcctttgatgaagaaagtatagtcaaggagatttttggaggccaactgaaaagccagttgtcttgctgcgagtgtgagcacatctcggagacatttgagcccttcttggatctaagcttggagatcgatcaggttgatcacctggaagatgctttggaatcttttaccaaggtagagcagattggggactctgaagacaagctcacctgtgaaggatgcaatgctcaagtttgtaagaacaagcagcttacacttcatagagcaccagatgttattgcatttcatctgaagcgttttaccacccttgacaactctgtcgaaaagatcgacaaacatgtgtcataccctctggaggttgatttgaagcggttccacagtaacccagacactgcaggggagttgaaatacgatctttatggcgttgttgagcattctgggttacccaactatggccattatgtgtgcagtattcgttcttcaccaagcacttggtacttgatgaatgactcccatgttgattctattactgatgaaactgcattaaagcaggaagcatatattctcttctatgttaggcagggcaaatttccatggttctgtagtttgctagagagcaaggatgccctacatgctgagaatactcgcggtgcatctcctgtgtcagttttggaaaatattgatgcaaactgttcaacttctggaggaggtagtagcagtaattctggtgacaagttacagaaaaatgaagccagacagttagaggagtcagagaaggatgaaaccagtcaatacaaagcatcattctgtcctgaggagccatttaagagaagttcacatagtgcttccaacatcaacaacacaagagatgaaatcagtccatcaagaccatctccccaagttgatgccattagatgtccccatagcgtagaaactaccaatctggatatgccctctactcctctgcgctccaagctattgttttctcataatgaggttggtgtgtttgagttcgaggactacgatgacgaagagactcctttgcttccagataagaaatttctaactaaggcgaataaaactaaggctgcatccgcatctaaagctgtgaagggtccttgcattgatcagaatgcaaggcgtttgatgagtaccatgccatcctcaagaagaaaaggcctcatggactgcatgctcacacagcaaaatgcaaatcaggagcctcgtagtcgcagatgccccgcaagtgaccctctgaacaaaaagaaaagaaagatggttattcaatgctaggtattttcaagtttgggtgccacaaatcttgtattgctgtatagcctttttgttttcttttgctactcttttgctgtatacctgtatctatgctgccctctgttgctccctaataggtattcaagcggcagcccgcgaaacccacatataagcttaattaagtgggttgccataataacccgtgaaaatttagcctgtatatgggtttgcggggtagcccacttgcatccctgctccctaatttaatttggctgtcataggctttatggccggctagattgattgcagggtacagaagagcttaagagttagttaatctatcttatatttttgcttttcgtgatgtgtcatcgcacacctatgctctataggatttgcacctgtaccagctgcccattttgtttagtatgtagcagtacttggacagaacagggcttatcttttatggaacataacccgggaaaagaaattaaaccgagttctatctgaagtcttgttcaatcctgtaacatatcaagcaacaattttgatagccgacagtgatgtttctt

SEQ ID NO: 29016 - protein, 743 aa, Panicum virgatum
  misc_feature: Ceres CLONE 1888632
  misc_feature (197)..(504): Pfam Name: UCH Pfam Description: Ubiquitin carboxyl-terminal hydrolase
  misc_feature: SWISSPROT Homolog: EC 3.1.2.15 Ubiquitin thiolesterase
MAEQDGAAGQSPLDSAPGISAENGDGNTEQRQPFFSMCQSIRSVSYSNSWESICAPAANENDPNSGLNSMVDDHVLITSSSLGSEHPEPEGISGTVDGDGKSRSPHQINKEACLVEDAMEMEVDEFDVPHGERSEQPEPFSTEQPHSIDGLDLWDDKDNQKLFPLNGDQCNSNIVEVGYAEDKLFPSSFSFRRQSQSVGAGLSNMGNTCFLNATLQCITHTVPLFLKLRSTDHSTPCSYNKDGFCSFCALKEHVDDSIRRSGSVIMPVKFRDNLRKLSSDFRPGQQEDAHEFLRCLLDNLHKCTLDPMSKGKGSSFDEESIVKEIFGGQLKSQLSCCECEHISETFEPFLDLSLEIDQVDHLEDALESFTKVEQIGDSEDKLTCEGCNAQVCKNKQLTLHRAPDVIAFHLKRFTTLDNSVEKIDKHVSYPLEVDLKRFHSNPDTAGELKYDLYGVVEHSGLPNYGHYVCSIRSSPSTWYLMNDSHVDSITDETALKQEAYILFYVRQGKFPWFCSLLESKDALHAENTRGASPVSVLENIDANCSTSGGGSSSNSGDKLQKNEARQLEESEKDETSQYKASFCPEEPFKRSSHSASNINNTRDEISPSRPSPQVDAIRCPHSVETTNLDMPSTPLRSKLLFSHNEVGVFEFEDYDDEETPLLPDKKFLTKANKTKAASASKAVKGPCIDQNARRLMSTMPSSRRKGLMDCMLTQQNANQEPRSRRCPASDPLNKKKRKMVIQC

SEQ ID NO: 29017 - DNA, 713 bp, Panicum virgatum
  misc_feature: Ceres CLONE 1888646
  misc_feature: Encodes the peptide sequence at SEQ ID NO. 29018
catatcagtgagttaagttcgggttggttggccaaggctgaggatgcttttaaagttggtgatcgcatagatgtcaagcttattgagataaatgacaagggtcaacttcgactaagttctcgagctttgcttcctgatgcggattcagaatccaacagcaagcagcaatcaagtggttcaacaaaagaaaaggcgccgcagaaagatgatcttatcaagatgacaactaggagatccaaacgtaagaagcagtctgagccgtcgggagctgaaaatgccacaacaaagactcttgaaaagagtgctgctgctccagctacttcaaaaggcagtgaaaccgcataatagcatcaccaacaacttagcgctttaatcagatgattgtttcacatgactggccgagttaaaaggatccatacaccacgtgacctatatgatggtcgtaaggcaggcagtccataacaagagttcagtctgaagtcgaaattggatcgtacagaagaattggttgatgctgacgacaagcagagtgtgcagagtttttgaaatccctttcttgtatgtggttggtgcagcttcatcatgcagtattttataacgggctgcacaacgccatgatttttgtggtgaccaaggctgtagtttcctagaagcgggatctacacgagtacaggatgcaataacaagtagcccattgcacttcaaatattagt

SEQ ID NO: 29018 - protein, 114 aa, Panicum virgatum
  misc_feature: Ceres CLONE 1888646
  misc_feature: SWISSPROT Homolog: EC 2.7.7.8 Polyribonucleotide nucleotidyltransferase
HISELSSGWLAKAEDAFKVGDRIDVKLIEINDKGQLRLSSRALLPDADSESNSKQQSSGSTKEKAPQKDDLIKMTTRRSKRKKQSEPSGAENATTKTLEKSAAAPATSKGSETA

SEQ ID NO: 29019 - DNA, 709 bp, Panicum virgatum
  misc_feature: Ceres CLONE 1888658
  misc_feature: Encodes the peptide sequence at SEQ ID NO. 29020
caacttcggcttatgccgcctcggggagcgctgcaagctcaaccacccgcgcgatcgcgcgtccttgctggttggcgaccttgttgtggacgggggaggccgcgcctcggcgtggatatggaagcgtggagcggccaagctgccggagcggccgctccggccgggggagccggactgcgactactatctcaagtttggcacctgccgcctcggggagcactgcaacttcaaccacccgcttcatcgcatataagctgaagatcctctgcaacaccctgcaggctccggaagcagcagttcactaccagagtctgtggcaccatctaggctcatcgctcaggaatatccttcattatctctgcaacaccgtgctgactctggaagcagcaattcacagcaagaggctgtgctacatgttgacgatgcagggctttcaccatctaggcccgcatatgatgaggacgaggcggcagagcccttactacttcttgagcaccctgctgactctggaagcaacaatcaagagcaagaggatgcggtagatgttggtgcaggcatttcattgcagccagagccttcactaccgctgcagcaccctgctgactctggaagcaacaatcaagagcaagaggatgcggtagatgttggtgcatgcatttcattgcagccagagctttcactaccgctgcagcaccctgctgactctggg

SEQ ID NO: 29020 - protein, 83 aa, Panicum virgatum
  misc_feature: Ceres CLONE 1888658
  misc_feature (54)..(80): Pfam Name: zf-CCCH Pfam Description: Zinc finger C-x8-C-x5-C-x3-H type (and similar)
NFGLCRLGERCKLNHPRDRASLLVGDLVVDGGGRASAWIWKRGAAKLPERPLRPGEPDCDYYLKFGTCRLGEHCNFNHPLHRI

SEQ ID NO: 29021 - DNA, 495 bp, Panicum virgatum
  misc_feature: Ceres CLONE 1888673
  misc_feature: Encodes the peptide sequence at SEQ ID NO. 29022
atcggaggggagacgcgacgagaggggtggggaaggaacgcctgcgccatggcgggaggattcatgaccaccggcgcgaaggtgagcatctccaggggcgccgccccatcggcagcgacaacggcctccctggttctccccgccgtgcttgccttatcctcctcttccgcgagcgtcttgccgctgcggattcggctgcaactgccgctccagctgccactgccgcgagatgtgtcctgaccttcaggagaagagcaccagcggtgctcaggccaccgtcgtcctcgggctgccgccggagaagaaggccagcctcttccaagcggcagctgagtgctgtgagaccccccccccctgcgagagcagccacaggagcacctgccacccctgcaactgctgatttggatggggaacgtacacgcctgcgtgcatgctagctactgctactctgcttgtgtgtgacttcatctgaacaagaaaaaggatgagcctgag

SEQ ID NO: 29022 - protein, 56 aa, Panicum virgatum
  misc_feature: Ceres CLONE 1888673
  misc_feature (1)..(56): Pfam Name: Metallothio_2 Pfam Description: Metallothionein
MCPDLQEKSTSGAQATVVLGLPPEKKASLFQAAAECCETPPPCESSHRSTCHPCNC

SEQ ID NO: 29023 - DNA, 1760 bp, Panicum virgatum
  misc_feature: Ceres CLONE 1888674
  misc_feature: Encodes the peptide sequence at SEQ ID NO. 29024
atggatcgatgagctcctctgatcttcattagctcctacgttattgaatggcgggcaagatcaagactgtggtggtgctggtgcaggagaaccgctccttcgaccacatgctgggctggatcaagtcgctcaacccggacattgacggcgtcaccggcgacgagaccaaccgcgtggacgcctccgacccctcctcccgcgccgtccgcttcagcgaccgcgcacagtacgtggacccggacccgggccactccatccaggccatctacgagcagctctacgggacgccctttgtcgacgccgccgccacgcccatcacgccgaccggcgtccccgcgccgcccatgtccggcttcgcgcagcaggcggagaaggagaagcccggcatggcggacacggtcatgagtggcttccgccccgacgccgtgcccgtctaccgggagctggtgcgggagttcgccgtgtgcgaccgctggttcgcctccgtgccggcgtccacgcagcccaaccggctgttcgtgcactcggccacctcccgcggcctcgtcagcaacgacgccagcatcctcgtcgccggcctgccgcagaggacaatcttcgacaaccttcatgaccagggcttctccttcggcatctactaccagtacccgccctccacgctcttctacaggaacctgcgccggctcaagtacgccggctgcttccaccagttcgacctccacttcaggcgccattgccgggagggcaagctgcccaactacgtcgtcgtcgagcagcgctacttcgacctcaagctcctccccggcaacgacgaccacccctcccacgacgtcgccgagggccagcgcttcgtcaaggacgtctacgaggcgctgcgctccggcccgcagtgggaggaggcgctgctcgtcatcacctacgacgagcacggcggcttctacgaccacgtccccacccccgtcggcgtgcccagccccgacggcatcgccagcgccgcgcccttcttcttccacttcgaccgcctcggcgtccgcgtcccggcgctcttcgtctcgccgtggatcgagccggggaccgtcctgcaccggcccacgggaccctacccgacgtccgagttcgagcactcctccatcccggccaccgtcaagaacatcttcagcctcgacggcttcctcaccaagcgcgacgcctgggccggcaccttcgactccgtgctcacgcgcgacacgccgcgcgccgactgcccagtcaccctgcctgagcccgtgaagctgcggcacacggcggcggcggaacatgccccgctgtcggagttccaggaggagctcgtccagctcgccgcggtgctcaacggcgaccacaccaaggactcctacccgcacaagctcgtcgagggcatgacggtgccggaggcggccaagtactgcgtcgacgccttcagggccttcttggacgagtgcgaccgctgcagcaagtgcggcgaggacggctgccacatccccaccgtgaagccgtcgtctgctgcgccgggcaagaacaagagcagcttcgcgtccatggtgctggcttcccttgcgtgtgcccatccatcttcctcttcctagacgtcacgctacttcttcgttctctctgtctcatcagggaacgagatgggttgcttgctagctcatacttgggtttgtgttgcagcaggggaagagcagtgtacagagcctgattcattatacgatttaatttacagagcctgattgatatggttt

SEQ ID NO: 29024 - protein, 518 aa, Panicum virgatum
  misc_feature: Ceres CLONE 1888674
  misc_feature (5)..(373): Pfam Name: Phosphoesterase Pfam Description: Phosphoesterase family
  misc_feature: SWISSPROT Homolog: EC 3.1.4.3 Phospholipase C
MAGKIKTVVVLVQENRSFDHMLGWIKSLNPDIDGVTGDETNRVDASDPSSRAVRFSDRAQYVDPDPGHSIQAIYEQLYGTPFVDAAATPITPTGVPAPPMSGFAQQAEKEKPGMADTVMSGFRPDAVPVYRELVREFAVCDRWFASVPASTQPNRLFVHSATSRGLVSNDASILVAGLPQRTIFDNLHDQGFSFGIYYQYPPSTLFYRNLRRLKYAGCFHQFDLHFRRHCREGKLPNYVVVEQRYFDLKLLPGNDDHPSHDVAEGQRFVKDVYEALRSGPQWEEALLVITYDEHGGFYDHVPTPVGVPSPDGIASAAPFFFHFDRLGVRVPALFVSPWIEPGTVLHRPTGPYPTSEFEHSSIPATVKNIFSLDGFLTKRDAWAGTFDSVLTRDTPRADCPVTLPEPVKLRHTAAAEHAPLSEFQEELVQLAAVLNGDHTKDSYPHKLVEGMTVPEAAKYCVDAFRAFLDECDRCSKCGEDGCHIPTVKPSSAAPGKNKSSFASMVLASLACAHPSSSS

SEQ ID NO: 29025 - DNA, 2852 bp, Panicum virgatum
  misc_feature: Ceres CLONE 1888675
  misc_feature: Encodes the peptide sequence at SEQ ID NO. 29026
ggaatccctcagctacctcgccgtcgtcgcccatgaggcaagccggcacggcggcgcctgacaccaaacgcactcgctcggcctcgtccccccggccgcgacacgtctcggcgcggcggtcgcgcaggccatcgtgttcgtgtccccggccgcgccgacgaaagcccctggccgcgcgtcaccaccgcgccttttgtgggtggcctgtccgcctgtgccgcgcgcacccggagcagctagcgtgcgctcttgtagccagacgtgcaccggagaaaaagggggcccgcgtttctcgcctcgcctcctcctcctcctcctctcgcggcggtctcgccgagtcgccatcgccgatcccccacccgggcacccggccaccccgaccgcccaactcgcgaggaaagggaagggaagggacggggaagcgagctcaaatccccagattttcgtcccgtcattttgaacgcgcggcactgggacaaggcacgcttgtcgccaaccaaccaaccacggcgaccgctgccggagccgcacgccaatcccggccgctcgctcgcgcgccgccgcccgctcggttgggcgccgccgctccggtctgaatcggcgcgcgttgttcggcgccgtccgccgggttctcggtttcggttcggttgggagctcgcggtccggtggaggaggagggcggcgggggcgcaatggtggacgtggggagccgggttcaggggttcctgcggaaccggtggctggtgttcgtggcggcgatgtggatgcagtcctgcgcgggggtggggtacctcttcggcagcctctcgccggtgatcaagagctcgctggggtacaaccagcgccaggtggccgggctcggcgtcgccaaggacctcggcgacagcgtcggcttcctcgcggggacgctctgcgcgctgctcccgctctgggccgcgctcctcgtcggcgccgcgcagaacctcgtcggctacggatgggtctggctcgccgtcacgcgacgggtccccgtgccaccgctctgggcgatgtgcattctaatcttcattggtaacaatggtgagacgtacttcaacactgctgcactcgtctcgtgtgttcagaacttccccaagagccgtggaccaattgttggtatcctcaagggattcgctgggttaagtggtgcaattctgacacaaatctatgcaatgataaactcgcctgatgatgctgcactgatcttcatggttgccgttggcccaacaatggtagttatagctttaatgttcattgtaagaccagttggaggtcacaggcaaatacggccttctgatggcacaagtttcacatttgtatacagcgtctgcttgctcttggccgcttatctgatgggcgtcatgctacttgaagaccttgtcgacctaagccagtcaatgactgtcttgctgaccatcattctaatcatctttttattagttccaatagtcatcccagtgctactcagcttcttttcagatgatgatgatactttgtatgcactattactgccatcacctcggaaagaagaaccaagtgcatcaacatcttctgaggagcaacaagaggttatactcagtgaattggaggatgaaaaaccaagggatgttgatcttctttctgccttagagaggcaaaaaaggattgcagcattgcaggcaaggctgtttcaggcagctgctgttggtgcagtgagggttaagaggaggaaaggtccacgacgaggtgaagatttcacactgatgcaagcgctcatcaaggcagatttttggcttctatttttctcccttttattgggctctggatccggtctcactgtgattgataatcttgggcaaatgagccagtcattgggttacgatgaaacccacatttttgtgtcgatgattagcatttggaacttccttggtcgcatcgggggtggttacttctcagagattattgtcaaagattatgcatatcctagagcaattgcattagctatagctcaagttttgatggcaattgggcacttcaactttgcaatggcttggcctgggacaatgtacatcggcacactgcttgttggaattggctatggcgctcactgggccattgtgccagccgctgcatctgaactgtttggggtgaaatattttggagcactatacaatttcctcactgttgcaaatccagcaggctccctggtattctcggggattattgccagtggcatctatgacgctgaagctgcaaagcaggctcagcagcgccacaactccacattgttggcaatgcctgctagagtggttagcatgatatctgaagctgctccatcactgaagtgcgagggtgccatctgtttcttcctctcatccctgatcatgtccgggttctgcatcattgctgttattttgagcttgatcctggtctatcggacaaaaattgtatacacaaatttatacgggaagccgcatacttgaaagatcaattcttaagggctaaagggcatgatatagtttcagagttttgaattcaggctatatgatatcccggcatggtgttggccttcaagttgctctggaccacgtttgataagcctggaactcttagagtggccgaagttgctcccaagcagcatccaagtttgtggctgcagatgagatcatgggggtgctgggtacgagtacaacatcgtgaaaatgtatgaaagctaatggttgaattgtgccttttgcttgaattttgctgtatttagttggaaaatattgtatacacgtgtaataagctggagatctttctatgttccctcacactgggaaagacattctttcttattagttaaaaaaattcgt

SEQ ID NO: 29026 - protein, 595 aa, Panicum virgatum
  misc_feature: Ceres CLONE 1888675
  misc_feature (15)..(262): Pfam Name: Nodulin-like Pfam Description: Nodulin-like
MVDVGSRVQGFLRNRWLVFVAAMWMQSCAGVGYLFGSLSPVIKSSLGYNQRQVAGLGVAKDLGDSVGFLAGTLCALLPLWAALLVGAAQNLVGYGWVWLAVTRRVPVPPLWAMCILIFIGNNGETYFNTAALVSCVQNFPKSRGPIVGILKGFAGLSGAILTQIYAMINSPDDAALIFMVAVGPTMVVIALMFIVRPVGGHRQIRPSDGTSFTFVYSVCLLLAAYLMGVMLLEDLVDLSQSMTVLLTIILIIFLLVPIVIPVLLSFFSDDDDTLYALLLPSPRKEEPSASTSSEEQQEVILSELEDEKPRDVDLLSALERQKRIAALQARLFQAAAVGAVRVKRRKGPRRGEDFTLMQALIKADFWLLFFSLLLGSGSGLTVIDNLGQMSQSLGYDETHIFVSMISIWNFLGRIGGGYFSEIIVKDYAYPRAIALAIAQVLMAIGHFNFAMAWPGTMYIGTLLVGIGYGAHWAIVPAAASELFGVKYFGALYNFLTVANPAGSLVFSGIIASGIYDAEAAKQAQQRHNSTLLAMPARVVSMISEAAPSLKCEGAICFFLSSLIMSGFCIIAVILSLILVYRTKIVYTNLYGKPHT

SEQ ID NO: 29027 - DNA, 1208 bp, Panicum virgatum
  misc_feature: Ceres CLONE 1888685
  misc_feature: Encodes the peptide sequence at SEQ ID NO. 29028
accatcccatccgtagcagcatggcccctgaagttcagggggtggtgaaaaagtttagatttagttattgtagcacattttgttattatttgataattaatgtctaattatagattaattagcatcattagattcatctcgtaggaatcagttagactatgtaattagttattttttacaactgcatttaataccttatacatgtatccgaaaattcgatgtaattgatactgcacaaacttttttggaactaaacgcagtaaacgcaggctcagcactgatgctgaacatggcggcgccattgctgattgctctgtctcgcgctgctcctagcgtccggcgccggcgccggcgccaccggcgctctcgaagactacccacaagttcagttcagcaccgcctcggcgacgccggagaagtacagcagcttcatcgccgcggtccgcgccgcgctggtgagcaaagcaggcgggaagagcaacgggatccccgtgctgctcgaccaggacgacccgctcgcgctccaaacctacctcaacatcactgacgaactcggcggggcactccgtcagcctgaagatggatgtcaccggcgcttacttctcggcctacgtggcggggaagtactcgtgcctgctcaaacgatcaggccggacattctcgtcggcgatctgctacactgatgcatggtcgagtactcgagttcagcttcagccgtcattgctacgccgctgctgcagtccggctccggcgtcaggagaggcgccggccgctaccctgctgcaggccaggatctcggagcagccgcgacatggcgggcgaaagatctggactgggccgtctcgtcgctgttcctgttccccgccggcaacgccacggaggaggacctgcgccgcgccgtcgccgcctgcgacatgatggtcgcggccgcggcggcgttcccgtacgtccagcggcgggtgagcgccagcatgcgggacggcaacggcgtccccgacgacccgagcctgcgcggcctccaggcgcgctggccggcgctctccgccgcggtccaggagtctttccagggcgccttcccggctccggccgtgccgctcgtggacaacgtgccgctcgtggcaatggcaggtggctgcgcgtggacaacgtgcgcgcggccgtgccgctcgtgtccttcctggagcatgacagctgcaaatcggcggcgg

SEQ ID NO: 29028 - protein, 173 aa, Panicum virgatum
  misc_feature: Ceres CLONE 1888685
  misc_feature: SWISSPROT Homolog: EC 3.2.2.22 rRNA N-glycosylase
MVEYSSSASAVIATPLLQSGSGVRRGAGRYPAAGQDLGAAATWRAKDLDWAVSSLFLFPAGNATEEDLRRAVAACDMMVAAAAAFPYVQRRVSASMRDGNGVPDDPSLRGLQARWPALSAAVQESFQGAFPAPAVPLVDNVPLVAMAGGCAWTTCARPCRSCPSWSMTAANRR

SEQ ID NO: 29029 - DNA, 666 bp, Panicum virgatum
  misc_feature: Ceres CLONE 1888685-R
  misc_feature: Encodes the peptide sequence at SEQ ID NO. 29030
cgtcggcgtcacggtgcggctcgacgatagcggcacgggccagtcgtggacccccaccaacgagaccgcgccgctggccgcccccgtcgtcgggttcggcgacctctgcctgcaggcggacagcgcgggggcggtctccctcgcggcctgcggcggcggcggcatggcgtggtcgctctaccccgacggctcggtgcggccgccggcgtggctgttcctccagtggcggtgcctggccgcggacgcgagcgggcgggtggcggtgaggttctgcgacgggtccggctcggcctgcgagcgctgggtgttccgcagcgacggcaccgtcctcaacactggcaccgggatggtcctggacgcgaggccgtcggccagcaggaggggctgctacgacgtcgtcgtgtcgccggccaccggcagcgccacccagcagtgggcgctcatgctgtgatctccgatccgaatccgatccatctgcacagcctacagggggctactgtgttttgtacaataaagtcgtgtgttgcatgcatgctgaataaagtcgtgtgttgcatgcatgctgaataaagtcatgttcaggtctagctctgtactaccactgcatgtggccgttgttgtcagtgcggtgagtgtgagtctgcaacaatggtacattcgtactcc

SEQ ID NO: 29030 - protein, 149 aa, Panicum virgatum
  misc_feature: Ceres CLONE 1888685-R
  misc_feature (26)..(145): Pfam Name: Ricin_B_lectin Pfam Description: Ricin-type beta-trefoil lectin domain
  misc_feature: SWISSPROT Homolog: EC 3.2.2.22 rRNA N-glycosylase
VGVTVRLDDSGTGQSWTPTNETAPLAAPVVGFGDLCLQADSAGAVSLAACGGGGMAWSLYPDGSVRPPAWLFLQWRCLAADASGRVAVRFCDGSGSACERWVFRSDGTVLNTGTGMVLDARPSASRRGCYDVVVSPATGSATQQWALML

SEQ ID NO: 29031 - DNA, 730 bp, Panicum virgatum
  misc_feature: Ceres CLONE 1888688
  misc_feature: Encodes the peptide sequence at SEQ ID NO. 29032
cttccaaagcctcgccttttccctctccctcgtcttccctcgctcgcctccccctcccctccaaatcccccctccctcgccttccagtcctccacattcttcctgctctgcagctagctgcttttggctggggatcggaaatggcaatcgacgacgaatcgccgccgctcagggtcaacaccagaggcggcgccatgggaggaggggagtgcggcggggcggagaaccagcggtggccgccgtggctcaagccgctgctgggcacgagcttcttcggtcaatgcaagctgcacgcggacgcgcacaagagcgagtgcaacatgtactgcctcgactgcatgaacggcgcgctctgctcccagtgcctcgcctaccaccgcgaccaccacgccatccaagtgagctcgcattccttgccgtcggattggagcagccggcgccgggccctttctctccctcgagagaaacggcagccagcttccatccaaaggcgcttctctcggtctctcctccttcgcttagactcgttgttcgttgcgtccaagattgcaacggccaatctttccttagacgcgttgggaaaaatccaaggatcagggataactgacttccttgaaccggcaggcagcgaatgcgcctgttccattccatccgccgcggcatctcgctgacggcgatgcgcgctctgcttcttttgttctgggcgcagatacggaggtcctcctaccac

SEQ ID NO: 29032 - protein, 176 aa, Panicum virgatum
  misc_feature: Ceres CLONE 1888688
  misc_feature (48)..(136): Pfam Name: PLATZ Pfam Description: PLATZ transcription factor
MAIDDESPPLRVNTRGGAMGGGECGGAENQRWPPWLKPLLGTSFFGQCKLHADAHKSECNMYCLDCMNGALCSQCLAYHRDHHAIQVSSHSLPSDWSSRRRALSLPREKRQPASIQRRFSRSLLLRLDSLFVASKIATANLSLDALGKIQGSGITDFLEPAGSECACSIPSAAASR

SEQ ID NO: 29033 - DNA, 735 bp, Panicum virgatum
  misc_feature: Ceres CLONE 1888695
  misc_feature: Encodes the peptide sequence at SEQ ID NO. 29034
ctacttgacagttcatgtcattgaagaggtcatgccttctttagatgttgggacaggagctcagtatgcaaatacgttaagtggctaccctgtggtgaacaggaagcgcagttgggaaaactttcgactttttaatagggaactgaactcatgtgagatgccttttgcacccgttgcatctgactcagtaaacttgataatatcagttgaagatactggtgttggtattccattcgaagctcagtcccgtgtcttcacccctttcatgcaagtaggtccgtccattgctcgcatccatgggggcactggcattggattaagcatcagcaaatgcttggttggtctcatgaagggagagatcggatttgcaagtaaaccccaagttggttctactttcaccttcactgcagtgcttacgagggcctgttctagcggaaatgagaataaaccgtcagagtttaaagagatcagtgcattggtgtttgatcatagaccggtccgagccaaggttaccaagtaccatttgcagagactgggagttcagactgaatcgatgactgacctagatcagtatatttctaaagtaaattttggattacaggttgcaaagcttgtgctgattgacaaagaaacctggctgaaggaatcccattccatgcctatgttggttagtaaattgaggaacaaagatcagcgagactctccaaagtatttcttttggagaaacttaaaagt

SEQ ID NO: 29034 - protein, 244 aa, Panicum virgatum
  misc_feature: Ceres CLONE 1888695
  misc_feature (1)..(139): Pfam Name: HATPase_c Pfam Description: Histidine kinase-, DNA gyrase B-, and HSP90-like ATPase
  misc_feature: SWISSPROT Homolog: EC 2.7.13.3 Histidine kinase
YLTVHVIEEVMPSLDVGTGAQYANTLSGYPVVNRKRSWENFRLFNRELNSCEMPFAPVASDSVNLIISVEDTGVGIPFEAQSRVFTPFMQVGPSIARIHGGTGIGLSISKCLVGLMKGEIGFASKPQVGSTFTFTAVLTRACSSGNENKPSEFKEISALVFDHRPVRAKVTKYHLQRLGVQTESMTDLDQYISKVNFGLQVAKLVLIDKETWLKESHSMPMLVSKLRNKDQRDSPKYFFWRNLK

SEQ ID NO: 29035 - DNA, 987 bp, Panicum virgatum
  misc_feature: Ceres CLONE 1888699
  misc_feature: Encodes the peptide sequence at SEQ ID NO. 29036
aaaaaagaaacatgacccattcaagcaactagtcgtggaagccaactctgtccctgtgtgctatttcgcagaaaccaagcgaaaaccgccggatgcagcaatcgccaggaggagcaaagcctgcaattacctgtacttcggttggcatgcaacggggagactgcttccaagaagctcatggactccgagatctccttccaccatccccttatataaactcctcttcctccattgcccatcaaccacaatcccacgcataattcttgccatctattcccagatcttcgatcttcaccatgatctcgcgggataattccagtatgggctcagacaagagctcctccgtgcagtttcaggatttcctgccgttgatggcgaggaagctcagcgtggaggggctgattcaggagctctgcaaggggttccagctgctgatggagcccagcaggggcaagatcaccttccagagcctgaagcggaacgcatccaggctcggactaggtgagttccgggatgatgagctcctggatatgatgagggaaggggacctggacggggacggagcgctggaccacatggagttctgcattctcatggtcagactgagcccggagctgatggaagaagaggcacacagggcgtttgactttgaacactgatgcaatttgatccttgtttcttgaatacaacagaatacagtgatttgtcgtcaatttgtttgtccaactccattgtggttctgaattttgaaactcaaatgtagtctaacagactgacattgctcatattataggattctaacacaaggtaaaagaataggctatagagtgccacgaggattcactttgcagtcactgcatgtaagaccacttcatctctagtctatcaatacaaagatactatgtattgtgatcagcaaagggaagttatttattccaaagtgtgcaaatgtgtagaacaacaaaattttgtgataaaccatattac

SEQ ID NO: 29036 - protein, 120 aa, Panicum virgatum
  misc_feature: Ceres CLONE 1888699
  misc_feature (75)..(103): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 51220
  misc_feature: Useful for making plants with altered glycerol content
MISRDNSSMGSDKSSSVQFQDFLPLMARKLSVEGLIQELCKGFQLLMEPSRGKITFQSLKRNASRLGLGEFRDDELLDMMREGDLDGDGALDHMEFCILMVRLSPELMEEEAHRAFDFEH

SEQ ID NO: 29037 - DNA, 2358 bp, Panicum virgatum
  misc_feature: Ceres CLONE 1888701
  misc_feature: Encodes the peptide sequence at SEQ ID NO. 29038
gtgatttctgtcattctttgaatctgctttcttcctttcttcctgctgagtgtagctacaaacattgcatggcagatccagaagacccccctcatcctcaagcatccagtagtactcctgttgaagatcctcatccccaagcatccagtactgttgttgatcctcatcctcctcctcgtcaagcattcagtgttccttctcatcctcaagcgttcagtgttcgtcgacatcctcaagtactcggtgttcctgctgatcctcctcatccccaagcattcatcagtgttcatgttgttgatcctcctcatcctcgaggacgcttcttcacgctgaccacgagggtgaagaaagacattccactactacatggttcgatcgtagctatcctattgctgcttcacatcgtttattgctttaccccccgtagatgcatgctgctccggctatccactcaaatagtagcctaccctgccgttgcatgcctattcgttttcgccccctcccgtcgggcagggaagattgtttcctttgcatttcttggtgcccttacagtgattctggatattcttgaaattataatttaccgtgcacggattcaggtcttgttcacggtaaatattgtggccgtatccttgtactgcctgtcgaagctttacccggttgcagagccttggctccagtactgcgtctccaagctctttccgtttgcaaggccttgcatccagtactgcactggctacctttatccgattgcgcagccttggctcagataccttcctaggaatattacctttctactcctgcatgttttaatcgttgccatcctattgcttcacatcatcctggcacaagtttgtgatagtctagccatgcaaatagtggcataccctgccattgcttgtctgtacatttgggcgccctctggttggagggagaaaattgtttccggcaaatttcttgctgcgcttgctattattgttcttttaatctcaattggcgctaacggattaactaatgaaatcatgtacgttgccaatattgtggctctgtcctcgtactgcatctggaagcttttcctggctccaaaaccttggctccaccacaatcgtgcgcgctttgtggaagaacaacaagaagaaacagggctgctactcccgcatcaggccacgttccgcatccaagacctgctacggcaattctctcctggcgaggtccgcgccatgacgcacgacttccgaaccatggtggggcaaggcggcttcggccaggtctttcgaggcctcctcgacgacggcacggcggttgccgtcaagaggatagcgaacgccggcggcggcgaggacgatttcctcagggagaactccatcgtcgccaccgtgcaccaccgcagcctggtgcgcctcctcggctactgcctccagcgcgggggcgaccggtacctggtctacccgttcctcgagagcggctcgctggacgcgtggctcttccgcggcggcgaggggcggaggcgcctcctgccgtggccggcgcggcgctgcatcgccgtcgacgtcgccaaggcgctcgcgtacctccaccacgagtgccaccagcagatcctgcacctcgacatcaagccgggcaacatcctgctcgacggcgacctccgcgcgcacgtgtcggacttcggcatctccgtgtccataacccgggacctgagcaacgtcgacacgcgcgggaggggcacgcccgggtacatggcgccggagatgatgatcaacgcggtgtccgccaagtcggacgtgttcagctacggcatgaccctcctcgagctcgtcggcgggcgccggaacttcgaaccctcctcatccgcagacgccgcgtcggcgacgccggacttcacgcgggacttctttccgtacattgtgcgggagaagatggcgcgaggagagctcatggagacggtggacgcggccatggcgctcgtggaccaggaggaggtggaggtggtggtcaaggtggcgctatcctgcatccagaaccggtgggacaggaggcccaccatgctgaccgtggtggatatgctcgaagggcgggtcgccactgatctgccgcctgagatccggcgtccatcgactgtgaatttctcggatctactttcctcgtcactcacccacggtcggtaataaaacaagaaaaaaaattcaaattactcccttatgaccaaagtctggataacttttttaactctctctcaattctatttaactcataaattatatcattgggttcaatttacctcctcatacattttatcttttctatttcttcacgtacatgtaaaattttaatttataatttcgcaggattgtagagggc

SEQ ID NO: 29038 - protein, 577 aa, Panicum virgatum
  misc_feature: Ceres CLONE 1888701
  misc_feature (268)..(545): Pfam Name: Pkinase Pfam Description: Protein kinase domain
  misc_feature: SWISSPROT Homolog: EC 2.7.11.1 Non-specific serine/threonine protein kinase
MLLRLSTQIVAYPAVACLFVFAPSRRAGKIVSFAFLGALTVILDILEIIIYRARIQVLFTVNIVAVSLYCLSKLYPVAEPWLQYCVSKLFPFARPCIQYCTGYLYPIAQPWLRYLPRNITFLLLHVLIVAILLLHIILAQVCDSLAMQIVAYPAIACLYIWAPSGWREKIVSGKFLAALAIIVLLISIGANGLTNEIMYVANIVALSSYCIWKLFLAPKPWLHHNRARFVEEQQEETGLLLPHQATFRIQDLLRQFSPGEVRAMTHDFRTMVGQGGFGQVFRGLLDDGTAVAVKRIANAGGGEDDFLRENSIVATVHHRSLVRLLGYCLQRGGDRYLVYPFLESGSLDAWLFRGGEGRRRLLPWPARRCIAVDVAKALAYLHHECHQQILHLDIKPGNILLDGDLRAHVSDFGISVSITRDLSNVDTRGRGTPGYMAPEMMINAVSAKSDVFSYGMTLLELVGGRRNFEPSSSADAASATPDFTRDFFPYIVREKMARGELMETVDAAMALVDQEEVEVVVKVALSCIQNRWDRRPTMLTVVDMLEGRVATDLPPEIRRPSTVNFSDLLSSSLTHGR

SEQ ID NO: 29039 - DNA, 690 bp, Panicum virgatum
  misc_feature: Ceres CLONE 1888740
  misc_feature: Encodes the peptide sequence at SEQ ID NO. 29040
accaccaccgtcgttcccgtctgccgccggccacggggaaaggcaaacaagcagccaggcggctaggcgcaatacaaaatccggaggaactcgcaggaggccaagagcagatccgcttcctcgtccagcgatcgcccccttcctttcccgacttgtagcggaagccatggcgtcgtcggcgctaatctgcgacacggagcagtggaaggcccttcaggcgcacgtcggcgcgattcagaagacgcacctgcgggacctgatggccgacgccgaccgctgcaaggcaatgacggctgagtttgaagggatttttctggattactcgaggcagcaggcgacacgtgaaaccattgagaagctgctcaaattggcagaggctgcgaagctcaaggagaagattgagaagatgtttaaaggtgaaaagataaatagcacagaaaacaggtcagtgcttcatgtagctctaagggctccaagagatgcagtcataaacagtgatggggtaaatgtggtccctgaggtttggagtgttaaagataaaatcaagcagttttcagagacttttagaagtggatcatgggttggggcaactggaaaagcattgacaaatgttgtgtcagttggaataggtggtagctttcttgggcctctctttgtgcatactgcactccaaactgatccagaagcagc

SEQ ID NO: 29040 - protein, 174 aa, Panicum virgatum
  misc_feature: Ceres CLONE 1888740
  misc_feature: SWISSPROT Homolog: EC 5.3.1.9 Glucose-6-phosphate isomerase
  misc_feature: Functional homolog of the protein sequence given in SEQ ID NO 50766
  misc_feature: Useful for making plants with altered cell wall content and/or composition
MASSALICDTEQWKALQAHVGAIQKTHLRDLMADADRCKAMTAEFEGIFLDYSRQQATRETIEKLLKLAEAAKLKEKIEKMFKGEKINSTENRSVLHVALRAPRDAVINSDGVNVVPEVWSVKDKIKQFSETFRSGSWVGATGKALTNVVSVGIGGSFLGPLFVHTALQTDPEA

SEQ ID NO: 29041 - DNA, 688 bp, Panicum virgatum
  misc_feature: Ceres CLONE 1888746
  misc_feature: Encodes the peptide sequence at SEQ ID NO. 29042
gacgggagaaggggatgacgcggcggtggaggccagggcggtggtgctgattgacgtgtacctgcccgtcgccgcctggtccggttggcagttcccgcgctcccgcaccgctgccgccgcgctcttcaagcatgttagttgcaactgggatgctaggaaagctttgcttgctttcgactggacttctcatgacggtccacactgtgatgaccgttgcatttggagttgcactgattgtcacgtacttggttgtgaggaccatcagatagcatctatatcaaataacgagaagtcatttgacctgcacgaaatcttcaaaactctacctggtgttaggatggataagggcctgcagacaacaagaataataccagatgcagaagcacttggactgggtatttggtctgtccctgatgatgtattgcataaagtgctgtttctacttaaacccagggatttgataagagtggcagcaacttgtcatcatctaaggagtcttgctgcctccatcatgccttgcatgaagcttaagctttttcctcatcaagaggtggctgtcgaatggatgttgaagcgagaacagaacacgcaggttctagcacatcctctgtacaaggatttctgcactgaggatggttttcctttctacataaatgttatctccggtgaagtatttaccggacatgct

SEQ ID NO: 29042 - protein, 228 aa, Panicum virgatum
  misc_feature: Ceres CLONE 1888746
  misc_feature (131)..(178): Pfam Name: F-box Pfam Description: F-box domain
TGEGDDAAVEARAVVLIDVYLPVAAWSGWQFPRSRTAAAALFKHVSCNWDARKALLAFDWTSHDGPHCDDRCIWSCTDCHVLGCEDHQIASISNNEKSFDLHEIFKTLPGVRMDKGLQTTRIIPDAEALGLGIWSVPDDVLHKVLFLLKPRDLIRVAATCHHLRSLAASIMPCMKLKLFPHQEVAVEWMLKREQNTQVLAHPLYKDFCTEDGFPFYINVISGEVFTGH

SEQ ID NO: 29043 - DNA, 1417 bp, Panicum virgatum
  misc_feature: Ceres CLONE 1888749
  misc_feature: Encodes the peptide sequence at SEQ ID NO. 29044
gctactgttgccgcttttacttgcgcacacgttcgacgaaacgccgcggcgcggcctcctcccccgcgtccacggagattcgcctcgcgtccacggagatcccttcccccgctcccatctcatctcgcggaccccgccgagatcggccgccgtcccgcggggagcccccccggctggatctcctcctcccgcagccgccttgatggtccgggggccggcggggcggcggcggcggcggagtaggtagctctcgcggcgatgagcaggctcgcgacggggctccaccggctgcggaggtcggcgtcgtcgccgtgggaggtgctgtggtccgcgctcgcgtcatgcggcctcgtgctcttctcgcagctcgccgtggccatggtgccgcggctcttcccctccctctcgctcctcgccatgctacccatcgcgggcctggtgttcctcgcggctatcgtgctgggccggctgtggaggaggttcatcggggtggcggcgtccgcgccgctcttcgtgctcttcaacatccttctcctgtggggcgtctacgtcttcgtcatccggagagacacttctcctctgctggacatgttaataaatgcagaaagtgcactgcttctatggggactttacagaattttgtctggtgatcctggtattgttgcttgtgattcttcatatttagaggaagctggctgcaaggattttgtggaggctatttacccgagtgagaagctcccaatgctctctcgtgtcaggcagtgtaattggtgcaaagcaaatgttaggggctatgaccatcattgccctgcatttggtacttgcataggacagaagaatcatcggctgtttatggcccttttgacaggatttgttgttgctgaatcgacatatacaatgtgctcaacaaaatatattaccagatgcatcaattcaggaactctaagatctgagaatcctgtatctctaaacattgtaatcagtacgatgctcttctctatcctccaggtggtctggcagattgtgttcttgatgtggcacatatattgtatctgcttcaacatcaagacagatgagtggataaactggaagaaatatcctgaattccagatgagagaacagcctcaatcagattttgaagtcaaatttgtaaatccgtatgacaaaggcatgctatgtaacattagagaatttctgaagccgaaatgatatgaagccaattttgaaaacctgacctgatggaactgaacaatggggaatcagaatgtgcgtcacgactgagagaacaacacccagaattctggaagcctgttttcctagttgcagcggtagcatctaatgagattcatcgactcattgttgtgagcatcatttggactctgctgtcttaatttaaggtgcggttagcatttttttt

SEQ ID NO: 29044 - protein, 316 aa, Panicum virgatum
  misc_feature: Ceres CLONE 1888749
  misc_feature (145)..(208): Pfam Name: zf-DHHC Pfam Description: DHHC zinc finger domain
MSRLATGLHRLRRSASSPWEVLWSALASCGLVLFSQLAVAMVPRLFPSLSLLAMLPIAGLVFLAAIVLGRLWRRFIGVAASAPLFVLFNILLLWGVYVFVIRRDTSPLLDMLINAESALLLWGLYRILSGDPGIVACDSSYLEEAGCKDFVEAIYPSEKLPMLSRVRQCNWCKANVRGYDHHCPAFGTCIGQKNHRLFMALLTGFVVAESTYTMCSTKYITRCINSGTLRSENPVSLNIVISTMLFSILQVVWQIVFLMWHIYCICFNIKTDEWINWKKYPEFQMREQPQSDFEVKFVNPYDKGMLCNIREFLKPK

SEQ ID NO: 29045 - DNA, 1963 bp, Panicum virgatum
  misc_feature: Ceres CLONE 1888751
  misc_feature: Encodes the peptide sequence at SEQ ID NO. 29046
ctccgcggccaccgcccctttcccttccctcccctgcacggctgcacttccgtgtccgccgtcaccgccggcccccgtcgccaccactggcagctcggcgcgtactacctcgctgcttccccttctccgcggccatcccgctgctgctgatctgggcttcccacccgggagtgcccacgcagtttggtctctagtgcttggagccttctcggttgcaccaaatttggcctttttaggtgggcagcgccgatcttttcagctacagatttgtttccttgcagtgtttgtgctacagatttgctgcatctttgcgctcggacgattacccctgagccgtcctgcccatccgatcagatgagctgtgggtgtctcctcccaatccgaaattgcaggaggtggtcgtaacagtagcttcgtcccaatctccttccacgccgctacccgctttcccgtatccttcgcccagcctccgcggcttcatcagggatgcgccgccatacaacactcagtccccaccgcaggtgcagacggctagtgtcagcagcagcggcagtgggaagatcagccctgcggtgctgttcatcatagtgattcttgcggtcatcttcttcatctccgggctgctccacctcctcgtgaggctactgataaagaagcagcacggccgtggtgccgccatgggggagtctgctgcgtcgccgcaccggactggcgcgcgggacgcggccatggaccggcagctgcagcagctgttccatctgcacgactcgggcctcgatcaggccttcattgatgcgctgcctgtgttcgcgtaccgcgaaatcattggtggcaacaaggagccgttcgactgtgcagtgtgcttgtgcgagtttgatggggaggacaggctcaggctattgccggtgtgcggacacgccttccacctgcagtgcatagatacatggctactgtccaattcaacatgcccgctttgccgtggtacgctctttattccagggatgacgatagagaacctgctgtttgattttgatgagaggttggaggaggagcctctaccggaggagtgtgaggatggatcacaagtttgcaggcagaaatccattgatgaggagcagccagtgaccgagaagagggtctatccagtaaggcttgggaagttcaagaatgttggaaatcagggtgtggtcgatggtgttgttggcaatgtcaatgcagctagtattgtgagcaaggagccaggggaaagtagcagtagcagcttggatgcaaggagatgtttctccatgggcacataccagtatgttcttggggcttctgaacttcgagtagctcttcagtcaggtcgcagcagaaatggtgcaagcagcaggtttaaaggaagaggtgctgctggcttaagttctgccaatgctgacattatggagggcaagaggatttgtgcgaggagcaaaggcgagagtttctctgtgtccaagatttggcagtggtctagtgtgaagggcaagctgtcagctcctccagacacttgctcagatactgggagcctaccatggatgaaaagaaatgctgctggagataagttaaatatgtgactctgtctatagtcctacggtttttttttctgtctgatgtttgctgctcaattgcttagctctagctatttcatctgatttagggtgtctcacgctcatcaaatcgatcattctcatcaagggataatttttgacaggcttgctatattgcacataattgtttgtgattgttcgcaatggtgtgtctatatgctcatgttgttggtattccaaaaattccattcagaagcctaaacatatcaccacaaatgaagcatcagtttgtatactctatttgtgttcttgattctgcaatttccttgcattcaattatcaaacaggagactgtattactctaccaattatcaaacaggaggccgtatgaatct

SEQ ID NO: 29046 - protein, 305 aa, Panicum virgatum
  misc_feature: Ceres CLONE 1888751
  misc_feature (59)..(100): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1939 in the 11/479,226 US patent application
MGESAASPHRTGARDAAMDRQLQQLFHLHDSGLDQAFIDALPVFAYREIIGGNKEPFDCAVCLCEFDGEDRLRLLPVCGHAFHLQCIDTWLLSNSTCPLCRGTLFIPGMTIENLLFDFDERLEEEPLPEECEDGSQVCRQKSIDEEQPVTEKRVYPVRLGKFKNVGNQGVVDGVVGNVNAASIVSKEPGESSSSSLDARRCFSMGTYQYVLGASELRVALQSGRSRNGASSRFKGRGAAGLSSANADIMEGKRICARSKGESFSVSKIWQWSSVKGKLSAPPDTCSDTGSLPWMKRNAAGDKLNM

SEQ ID NO: 29047 - DNA, 1291 bp, Panicum virgatum
  misc_feature: Ceres CLONE 1888755
  misc_feature: Encodes the peptide sequence at SEQ ID NO. 29048
gctcgctctggtgagtttcgtctagaatccagccgtccccagccgccttcctcccatcacccatgatcccatctccctgtcgtcgagacgagcgaagccgccctgagacctccaagttggacgagaaccctttgaccgactaccacttctccgcggcgaaacgaattctccttccttgcattccaatttccaccgctcgaacaccaccacctgcgggcgcccccaactccccacgttccgaaagcctccgatccgattccccgcgcccgccagccttgtgccgctgcgtcgcacgtgcgccccaccccgccgccagcgcctcgccctccgccctcctcgagccgcgatcccatccgggccggggcgtcggatccggcgggtaccccgatgcggtcgccggggctcctggccgccgccctcgccgcggcggcgctgctgctgctcgcggccggcgccggggcggcgacggaggaggcctacgtcacgctgctgtacggcgacgagttcgtgctcggggtgcgcgtcctgggcaagtccctccgcgacaccggcacgcggcgcgacatggtcgtgctcgtctccgacggcgtctccgagtactcgagggagctcctccaggaagatggttggattgtgaatcgaataacattactggccaatcctaatcaagtgaggccaaagaggttttggggtgtctacaccaaactaaagatatttaacatgacaagctacaaaaaagttgtttaccttgatgcaaatactatcattgtaaaaagtatcgaggatcttttcaagtgtgggaagttctgtggaaacttgaagcattctgaaaaaatgaattctggagtaatggttgttgacccctctgaaactctattcaatgatatgatcgacaaagtgggacttttgccttcttacactggaggggaccaaggttttctaaattcatattatcctgactttcccaactcccgtgtctatgagccagactcacctttaactcctgaaccggagacacaacgcctttctaccttgtataatgctgatgtgggtctttacatgctagccaacaagtggatggttgatgaaaaagaattaagagtcattcattacacgctgggtcccctaaaaccctgggactggttcacagcttggcttgtaaaacctgttgaaacatggcaggacattagacaaaaacttgaagaatctctccctggaactggtggggggaggaacccacatgaccagctggttgtcaaaatattgttcattctcccattttgcctgcttt

SEQ ID NO: 29048 - protein, 301 aa, Panicum virgatum
  misc_feature: Ceres CLONE 1888755
  misc_feature (31)..(254): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Functional homolog of the protein sequence given in SEQ ID NO 50885
  misc_feature: Useful for making plants with altered cell wall content and/or composition
MRSPGLLAAALAAAALLLLAAGAGAATEEAYVTLLYGDEFVLGVRVLGKSLRDTGTRRDMVVLVSDGVSEYSRELLQEDGWIVNRITLLANPNQVRPKRFWGVYTKLKIFNMTSYKKVVYLDANTIIVKSIEDLFKCGKFCGNLKHSEKMNSGVMVVDPSETLFNDMIDKVGLLPSYTGGDQGFLNSYYPDFPNSRVYEPDSPLTPEPETQRLSTLYNADVGLYMLANKWMVDEKELRVIHYTLGPLKPWDWFTAWLVKPVETWQDIRQKLEESLPGTGGGRNPHDQLVVKILFILPFCLL

SEQ ID NO: 29049 - DNA, 614 bp, Panicum virgatum
  misc_feature: Ceres CLONE 1888755-R
  misc_feature: Encodes the peptide sequence at SEQ ID NO. 29050
tgccatggacaggtttgctgctgatgtttgagttgacctttgtggcattcttcttattatttgggagttatcttcgcattgtctatcaatggggaagtatgactgcaaatcatgtgggatttaacaattctgattcatcagagaatcatattggctcaggccatcagcgcagtatgtccgactgtgatatggatgcaacattttactggataggaatggcggccattgctactgttgctgtattgttaccaactatcttgggtataactgcattattcacaaagcttggattaatggttgctggcggtgttgtgctggcatcttttatgacatacgctgcagagcatcttgctatctcagccttcaacaagggtcagaaagacagaaatgcgtcgagaactagaagcttttgtttttaacgacaagtaaattctgtacctacaccattgatccatgttgtattgtagtaggtttgtacacacaaggaaagaatgatggctccttttttttaacacatggccgccaacccaggcccctttttgtagcactactgatgttacgctgtcaaccagtggtaaataggtccccagatgtttatttatggatttatgggc

SEQ ID NO: 29050 - protein, 138 aa, Panicum virgatum
  misc_feature: Ceres CLONE 1888755-R
  misc_feature: Functional homolog of the protein sequence given in SEQ ID NO 51301
  misc_feature: Useful for making plants with altered carbohydrate content
PWTGLLLMFELTFVAFFLLFGSYLRIVYQWGSMTANHVGFNNSDSSENHIGSGHQRSMSDCDMDATFYWIGMAAIATVAVLLPTILGITALFTKLGLMVAGGVVLASFMTYAAEHLAISAFNKGQKDRNASRTRSFCF

SEQ ID NO: 29051 - DNA, 720 bp, Panicum virgatum
  misc_feature: Ceres CLONE 1888760
  misc_feature: Encodes the peptide sequence at SEQ ID NO. 29052
acttccggctgctgagaaaggggccggccgggtacgcgcttgcattgtccgcaagagcggcagcagctcgcaatggcgacgaaccccggccccttcaccgagtggccatggaagaagctcggcaacttcaagtacttgctgctggcgccgtgggtagcgcacggcgggtacctggcggcgaccaaggggtggcgcgcggcggacccggggtacctggccatcctgccgtcgctgctcctccgggcgctccacaaccaggcgtggatcacggcgtcccgcgtgcagaacgcgcggagccggcggcaggtggtggccgaccggggcatcgagttcgagcaggtggaccgggagcgcaactgggacgaccagatcatcctcagcggcatcctgctctacctgggcgccctctacctgcccggcggccagcgcccgccgctctggcgcgccgacggcttcctcctcatcgcactgctccacgccggccccgtcgaattcctctactactggttccaccgcgcgctgcaccaccacttcctctacacgcgctaccactcccaccaccactcctccatcgtcaccgagccaatcacatccgtcatccatccatttgctgagctcgtggcttatgaagtgctgttcgcgatcccattgatcacatgcgccttgactggaactgcttcaatcgttgcatttgagatctatgtgctctacatcgacttc

SEQ ID NO: 29052 - protein, 215 aa, Panicum virgatum
  misc_feature: Ceres CLONE 1888760
  misc_feature (132)..(215): Pfam Name: FA_hydroxylase Pfam Description: Fatty acid hydroxylase
  misc_feature: SWISSPROT Homolog: EC 1.14.21.6 Lathosterol oxidase
MATNPGPFTEWPWKKLGNFKYLLLAPWVAHGGYLAATKGWRAADPGYLAILPSLLLRALHNQAWITASRVQNARSRRQVVADRGIEFEQVDRERNWDDQIILSGILLYLGALYLPGGQRPPLWRADGFLLIALLHAGPVEFLYYWFHRALHHHFLYTRYHSHHHSSIVTEPITSVIHPFAELVAYEVLFAIPLITCALTGTASIVAFEIYVLYID

SEQ ID NO: 29053 - DNA, 2239 bp, Panicum virgatum
  misc_feature: Ceres CLONE 1888761
  misc_feature: Encodes the peptide sequence at SEQ ID NO. 29054
gtccccgactccccgtcccccatcccgcgcccgcactccgcagatttctcacgccgccatgccccgcacgcccgcgccgccccggcccagcgcaggagcccccacgcggtcggcgtcggcggacggcggtactcccgtctcaccgccggcggcttagctagcgcctagagcttccgcacgcttcgcccgaagcgcctacgcggtctctatctctcacacactcgctcgctccccctactgcgtgcaccgtacggtgcggtcatggccggccgcctcttcctgctccggcggaccacaagtgcgttgcggcggcagacaccacgatctcgctcttttcgcccgtcgtctgacggtgggaacttggcgtcttcccgcgggatgctggaacttctcgcgcctccgccccgctcaccatcttatactttccgcaaggttttcaacagaaatgttgggttcttcagttggcttcaaagtcataatctccaagcctgccattgtatccatacaagtcgatcagttagtaatgaatatcaggctatggaggagcctcaacaaaatccaggagcggctgtatcagttggcgattctgctgaaccaaaaccgaagaagaaaaagctgaaagggaagagggcagtaacaagatttttgaaatccttgagatggaaaaagaaaaaggagattcagagaatgacagcagaggagaagattttgtacaaactgaagcttgctcgaaagaaggaagagcggcttgtcgcagcactgaaaaaaattgaaccagaagatccgtcagaacctacacatgatccggaagtgcttacacctgaagaacacttctatttcctcaagatgggccaaaaatgtaaaaactatgtgcctgttggaagacgtggaatttaccagggagtgatcttgaacatgcacttgcattggaaaaagcaccaaactctccaggtaattgtgaagacattcacaccagatgaagtcaaggaaattgccacagagctagccagattaagtggtgggattgtgcttgacattcaagatgggaacacaattattatgtacagagggaaaaactatgtgcagccaccaccagaaatcatgtctccaaaagttacactgcctagaaaaaaggcactggataaatccaaatacaaagaaaagctcagagctgttaggcggtacattcccaggcttgagcaggagcttgaagatcttcatgcgcagatgaagttagctggagggcataaaggtggtgtagggaaatatgttacttcagtttcaccaaatgcaaacagtatgacagcaagagaagaatcttctatctcagttcgcaataaaactgtatctgatctgctgtcagaaagcgcagagggatccaaggggttagaggatgaaagttctgaggttgaagacgtctcagcttcagagtctatgtcattttcagagtctgaggatctctctgacatttttgagacagaatcagaggagcaggaagaagacagcaaggaacgccccttatatctggataggctggataagtttccctcagaaaacaatgataatgaacaagatgattttgaggagcatctacggaagatcacttcgctttctgataagtctgattcaccttcgaaagaactaaaagtttcagagcttgacgagattgataaaatatttctgagagctagttcattgttgaagaaaaggtgaaaaattgggatttgtatacaatggtcctcatatttatatgcaccgtgaaaggtattttgtgcagttttaatggcatcttcagaaaggatttatgatcatccagcaagactggccattattgggagtttgtttatgctcacaatcattttacggtgaccatgacataattggaatttagtgaggtcatttgaatttgataccagcaatcaggttcatataggtacacgcttttgttgaaatgcaatggcatttatcaaaatggggggaaccctcggcaactgccaactgctgttagctgtagccatcctatgtaagtgctaatttttgtagatttgaagtcttgattctagaagatacatgagtatcccttcatgccgaactggtgtattgcttcatatggttcgcttgttggagataattaatgttgcctttagttgagctaggttctgtgcacgtgctagttgatctcccaactgtaattgttaacctaatattcaggtttttaaccagaaatgagctgatttat

SEQ ID NO: 29054 - protein, 444 aa, Panicum virgatum
  misc_feature: Ceres CLONE 1888761
  misc_feature (146)..(230): Pfam Name: CRS1_YhbY Pfam Description: CRS1 / YhbY domain
MLELLAPPPRSPSYTFRKVFNRNVGFFSWLQSHNLQACHCIHTSRSVSNEYQAMEEPQQNPGAAVSVGDSAEPKPKKKKLKGKRAVTRFLKSLRWKKKKEIQRMTAEEKILYKLKLARKKEERLVAALKKIEPEDPSEPTHDPEVLTPEEHFYFLKMGQKCKNYVPVGRRGIYQGVILNMHLHWKKHQTLQVIVKTFTPDEVKEIATELARLSGGIVLDIQDGNTIIMYRGKNYVQPPPEIMSPKVTLPRKKALDKSKYKEKLRAVRRYIPRLEQELEDLHAQMKLAGGHKGGVGKYVTSVSPNANSMTAREESSISVRNKTVSDLLSESAEGSKGLEDESSEVEDVSASESMSFSESEDLSDIFETESEEQEEDSKERPLYLDRLDKFPSENNDNEQDDFEEHLRKITSLSDKSDSPSKELKVSELDEIDKIFLRASSLLKKR

SEQ ID NO: 29055 - DNA, 1835 bp, Panicum virgatum
  misc_feature: Ceres CLONE 1888763
  misc_feature: Encodes the peptide sequence at SEQ ID NO. 29056
gcacgagccccgtgctcaccgctcaaaaccctcccccttcccctccgggctccggcggcggcggcggcggcggtgcctcttctccggcgaggtttcctcctctacaccacaggaaaacatggatgtacctgttgaggaccctgtggagaataacctggctggaacttctcctacccttggcaatgaggaacaagccaatccttatgctaatgtgcaagagaagatcgatgaagagccagaaaagccgtatgatggggaatccaaagacccaacacctcatgagttggggaactctgagcatgcggacgtgaacaatgaagttgcgggggatctaagcaaagagggccaagctacccccatgcagcaggagcctgcaaatgtctctgttggggaagctgggacaaagcagcagggtattgtggtgcctgatgaacagaaatggcctgggtggcctggagaaagcgtgttccgtatactggttcctgtcacaaaggtgggtgctgtcatcgggcgaaaaggagaattcatcaagaaaatgtgcgaggaatccaaagctcgcattaaggtccttgagggcccacaaggcgtgccagaaagagctgtaatgatttcagcaaaggatgaaccagatgcggagctacctccagctgttgatgggttgcttagagttcataaaaggatagctgatggtttagatgttgaaaccgatcagcctcaacgagtcaccgctgggcccacaaggctactggttccagcttcccaagctggaagcctgattggcaagcaaggaggaactattaaatccatacaagacgcttcaaagtgtgctctccgaattgttgagaatgttcctcctgtggcattaaatgatgatagagttgttgagatacagggtgaacctcttgatgttcacaaagccgtggagctgattgcaagtcatttgagaaaatttcttgttgaccgcagtgttctccctttgtttgaatcccagatgaaagcgtattatgtgcacagagagcaacctatgccacctccgcagccatggggtccccctccaccctcaccctggggtcatccaccaaaccttcctcctggtgtcccaggttatattgggaatccacaatacatgcctccacgaccacaagacaactattatcctcctcctgatatgccccctgtagaaaagcaaccacactatggaatttcttcatatggacgtgatgcacctccaagtgctccctcaggaaatcagcaccatgcacatgggtcttctcaggtgacacacagcatgcaagttcctctttcctatgcagatgctgtgattggagcagctggtgccagcatcagctacatccgcaggcatagtggcgcaaccataagtatccaagaaggtgctcctggggagatgacagtggagataacaggaagtgcctcacaagtacaaactgcacagcagctgatcaagaatttcatagctgaagcttctccccaggggccgccagctcctgctgcacccgctcaatcagttgacacaggctacagctcttcttacccaccataccgcggagcatcatacggatctcccccaggcagcgcggctccaggcccacacaatggaggaagctatggcgctgcaccgtatccgccgagctacggatactagtcggagggaaaacctggtttcctagttgcagatcttggggaaaggggggcattctggttttgtttgctagtcgcctagtctgttaatctgttgagaacttgagaggtcgttagggtttctgaactagcttgtggtgttgtaagctgctttctgttccaaagccgattgtgtt

SEQ ID NO: 29056 - protein, 514 aa, Panicum virgatum
  misc_feature: Ceres CLONE 1888763
  misc_feature (206)..(271): Pfam Name: KH_1 Pfam Description: KH domain
  misc_feature (388)..(448): Pfam Name: KH_1 Pfam Description: KH domain
  misc_feature (116)..(178): Pfam Name: KH_1 Pfam Description: KH domain
MDVPVEDPVENNLAGTSPTLGNEEQANPYANVQEKIDEEPEKPYDGESKDPTPHELGNSEHADVNNEVAGDLSKEGQATPMQQEPANVSVGEAGTKQQGIVVPDEQKWPGWPGESVFRILVPVTKVGAVIGRKGEFIKKMCEESKARIKVLEGPQGVPERAVMISAKDEPDAELPPAVDGLLRVHKRIADGLDVETDQPQRVTAGPTRLLVPASQAGSLIGKQGGTIKSIQDASKCALRIVENVPPVALNDDRVVEIQGEPLDVHKAVELIASHLRKFLVDRSVLPLFESQMKAYYVHREQPMPPPQPWGPPPPSPWGHPPNLPPGVPGYIGNPQYMPPRPQDNYYPPPDMPPVEKQPHYGISSYGRDAPPSAPSGNQHHAHGSSQVTHSMQVPLSYADAVIGAAGASISYIRRHSGATISIQEGAPGEMTVEITGSASQVQTAQQLIKNFIAEASPQGPPAPAAPAQSVDTGYSSSYPPYRGASYGSPPGSAAPGPHNGGSYGAAPYPPSYGY

SEQ ID NO: 29057 - DNA, 682 bp, Panicum virgatum
  misc_feature: Ceres CLONE 1888765
  misc_feature: Encodes the peptide sequence at SEQ ID NO. 29058
gtttgtttccctcagtcgtgaactactccgctacttcttcagtccagaattgtttccgtggagagagagagagcccgtcaatctcgtagcgcgccatggggtgtctccgcttgctcctcctcctgctgctcctcgccgcggcctgctccgaccgtgcggccgtgctcgccgccgaggagttcgcctacaacggcttcggcggcgccggcctcgcgctcggcggcatgtccgtggtggcgccgaacgggctgctggtgctcagcaacggcaccagccagatggccggccgcgcgttccacccggcgccggtgcgcctgcgcggcgcgcccggcggcgccgtccggtccttctcggcggccttcgtcttcgccatcgtctccaacttcaccgtgctgagcgacaacggcatggcgttcgtggtcgcgcccagcaccaggctctccaccttcaacgccggccagtacctcggcgtcctcaacgtcaccgacaacggccgcgacggcaaccgcgtgctcttcgtcgagctcgacaccatgctcaacccggagttccaggacatgaacagcaaccacgtcggcgtcaacgtcaacagcatgaggtcgctgcacaaccacagcgccggctactacgacgacgccaccggggcgttcagcaacctcagcctcatcagccggcggcccat

SEQ ID NO: 29058 - protein, 195 aa, Panicum virgatum
  misc_feature: Ceres CLONE 1888765
  misc_feature (25)..(194): Pfam Name: Lectin_legB Pfam Description: Legume lectin domain
MGCLRLLLLLLLLAAACSDRAAVLAAEEFAYNGFGGAGLALGGMSVVAPNGLLVLSNGTSQMAGRAFHPAPVRLRGAPGGAVRSFSAAFVFAIVSNFTVLSDNGMAFVVAPSTRLSTFNAGQYLGVLNVTDNGRDGNRVLFVELDTMLNPEFQDMNSNHVGVNVNSMRSLHNHSAGYYDDATGAFSNLSLISRRP

SEQ ID NO: 29059 - DNA, 2146 bp, Panicum virgatum
  misc_feature: Ceres CLONE 1888775
  misc_feature: Encodes the peptide sequence at SEQ ID NO. 29060
gcaagttgcaaaccgatcgaagaggagccaagaacaaagacgacagttagtgtccatggccgacgacgacacgcccaccgcccccctcctgaccagccacaaggccaagccggcggaggtgccgtctatcgatgacatcatcgagacgtgcatcggcggcaccggcgccatgcagctgctcaaggctttcctggtggtgttcgccagggccttcgacggccagctgctcttcgtctccgtgttcacggaggccgagccgcggtggcactgcgtcgtcgccggcggcgactcatcgtcctgctcgcggcctgccgccgccgcctcgccgtgcgcgctcccgcccggcacgtgggcgtgggaccggccggccggggcgtcggtggtctccgagtggggcctcaactgcgccggcccggcgctcgtctccctgccgtcgtcggcgttcttcgccggctgcctggccggcggcttcctgctcacgatgctcgcggactcgctcctcgggcgcaagaagatgctcgtcgcggccctggcgtccatgtccgtcgccggcgcgctcaccgccctcgcgcccaacgtctgggcgtacgccgcgctgcggttcgcctccgggtttgccaggtcgatggtgggcacgtgcgcgctggtcctctccaccgagctcgtcgggaagcggtggcgcaacgcggtgagcttcgtggccttctcctgcttcaccctcggcttcctgtccctcccggcggtggcctacgcgctccgcgaggcctcgtggcggagcgtctacttctggacgtccctgccctgcctcctctacgccgttctgctctacttcctcgcccaggagtcgccgcggtggctgctggtgcgcggccggacgcaggaggccgtcgagacgctgcggcagatcacctcgcgcaacggcggcggcggcggcgcgaccgccggcagcagcagcagcttgtccatgctgcagaacgcatgcgcactcgccatgtatgaggactccgggaccagagctggcggcgtgttcgtcacgctgcaggcgattctggagcgccggtgggcgatccggcggctggccgcgatcatggcggccggcttcggcgtgggcgtcgtctacttcggcatgccgctcagcgtcggcagcctggggcccgacctctacctgagcgtcgcgtacaacgcggcgtccgagctgccgtcggccgtgctctcgtggttcgtgatcgccagggcgaaccggcgcggcgcgctcgcggcgctcgccgcggcggcgggggcgtgcagcctcgcgtgcgtcgccatcccgcggggcgcggcgccggcgcggctggccgccgagctgctgtccttctccgcgacgagcacggcgtacaacgtcatcctgatctacgccatcgagctgttcccgacgtccctgcgcaactcggcgctggggctggtgcggcaggcgatggtgctgggcggcgtggtggcgcccgtgctcgtcgcgctcggccgcgagcggagcttctggtcgttcggcgtgttcggcctcgccatcgggtgctccgggctcttcgctgcctgcctgccggagacgagagggaggagcctgtccgataccatggaggaggaggagcgcaagcaggccgccgttgataagaacagtgatgatagtcacctcgtgtaagtacgtaattaagttcaggtaattaatggtattttgtttgtgatgaagcaagcattgtacctatcgctcatgtggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcgg

SEQ ID NO: 29060 - protein, 538 aa, Panicum virgatum
  misc_feature: Ceres CLONE 1888775
  misc_feature (44)..(475): Pfam Name: MFS_1 Pfam Description: Major Facilitator Superfamily
MADDDTPTAPLLTSHKAKPAEVPSIDDIIETCIGGTGAMQLLKAFLVVFARAFDGQLLFVSVFTEAEPRWHCVVAGGDSSSCSRPAAAASPCALPPGTWAWDRPAGASVVSEWGLNCAGPALVSLPSSAFFAGCLAGGFLLTMLADSLLGRKKMLVAALASMSVAGALTALAPNVWAYAALRFASGFARSMVGTCALVLSTELVGKRWRNAVSFVAFSCFTLGFLSLPAVAYALREASWRSVYFWTSLPCLLYAVLLYFLAQESPRWLLVRGRTQEAVETLRQITSRNGGGGGATAGSSSSLSMLQNACALAMYEDSGTRAGGVFVTLQAILERRWAIRRLAAIMAAGFGVGVVYFGMPLSVGSLGPDLYLSVAYNAASELPSAVLSWFVIARANRRGALAALAAAAGACSLACVAIPRGAAPARLAAELLSFSATSTAYNVILIYAIELFPTSLRNSALGLVRQAMVLGGVVAPVLVALGRERSFWSFGVFGLAIGCSGLFAACLPETRGRSLSDTMEEEERKQAAVDKNSDDSHLV

SEQ ID NO: 29061 - DNA, 680 bp, Panicum virgatum
  misc_feature: Ceres CLONE 1888794
  misc_feature: Encodes the peptide sequence at SEQ ID NO. 29062
gtctctccctctctcctcccttggtcttcctttcctggcggcgacgactgggcgaggggcggtgccattcgtcacgacttcgcactgccctttgccggcgacgagcatccatcagttcctaggcaagggagagcttcctagatagagctgttgccctgcacgagtagcagatggcaaggataaagcccaagcaattgctcattcaaagcaaaacgaagaaggctccttctcgaatcagttactcaactatcatcacatggaacctgattgtcgtcttggttgtgctatccctctatgccacttacaggcattggcatcaaaggtcggcccaagatattgaaatggaccttcatcaagctgagcttgctgtgagaccagatgattcaaaaatgacaagtagaccaggatatgcagtaatgaacacgggcaaaggtccaattactatagaaatatacaaagatgcttctgctgatgttgttgatagatttagcaacttgtggtaagcaacagaagtttgtgatgaacctttgatgtatctaataatttcacgaaaccgacttatataattgcttgtttttttactgtgtcagtcttgtaacatagttgtccattgttggttaaaaacgacttagctgtgatatattcaccatatatatgattaatccacagaagtttgagag

SEQ ID NO: 29062 - protein, 110 aa, Panicum virgatum
  misc_feature: Ceres CLONE 1888794
  misc_feature: SWISSPROT Homolog: EC 5.2.1.8 Peptidylprolyl isomerase
MARIKPKQLLIQSKTKKAPSRISYSTIITWNLIVVLVVLSLYATYRHWHQRSAQDIEMDLHQAELAVRPDDSKMTSRPGYAVMNTGKGPITIEIYKDASADVVDRFSNLW

SEQ ID NO: 29063 - DNA, 1940 bp, Panicum virgatum
  misc_feature: Ceres CLONE 1888802
  misc_feature: Encodes the peptide sequence at SEQ ID NO. 29064
gccttcacagtccccacccacccccgccagtagaccaccaaccccagtccccggcggtggccattgccgattgcccgcatccgcatccacgaacaccgcgagcgggagccagccggtagcagggcccaggatcggaaatgacgctggtgtgcgtgccgctggtagcgcggacggtggaggagatggtggccgacgcggcggccgccgcggccgcgggcagcgacctcgtcgagatccgactcgatttcatccaggggttccgcccgcgcgagcaccttccgcaactgctccgcggctgcccactcccggtcctcgtcacctaccgacctacctgggaaggaggccaatatgaaggtgatgaaactacaagattcgacacactacgtttagcaatggaactaggtgtagactatgttgatattgaattgaaggtcgctgacaaattcatgagctttatttctggcaataagccagagaaatgtaaacttattgtttcttcacataattatgaatatactccatcttgtgaggagcttgcaaatcttgtggcaagaatacaagcagttggagctgacatagtgaaagttgcaacagctgctaaggatattgtcgatgtatcacgaatgttccaagtgatggttcactgccaagtgcctatgattggactcgtaatgagtgaaagaggtttaatgtcacgggtgttagcaccaaagtttggtggatatcttacatttggcatactaaattctgcaaaaacatcagcgcctggacaaccaacagttgaagaattactggatgtttacaatataaggtgcataggacctgatacaaaggttcttggtcttatagccaacccagtaaagcagagcaagagcccaattctgcacaataaatgtcttcaatatgttggatataatgctgtttatcttccacttcttggagataatcttgctagttttcttgagacatattcatctccagacttttcaggatttagttgctctcttcctttcaaagtggatgctgtacagtgctgcaatgaacatgatccagttgctaagtcaataggagcaattaacactatagttagaagacctgatggcaaattagtggggtacaatacagactacattggagcaatatctgctattgaggatggcattggaggtccagggtccaaggatgctgtcatctcaccgttggctggtaggcttattgttgttgtaggtgcgggaggtgctggtaaggcaattgcttatggggcaaaggagaagggtgcaagggtggttgtagcaaatcgtacgtatgaaaaggcagtaagtcttgccaatgcaattggcggtcaggccctgaggttagcagacctggaaactttcaggcctgaagatgggatgatccttgccaatgcaacatcattggggatgcagccaaatattgatgggactcctattccaaagaaagcattgagtttctacgatgtggtatttgatgctgtatatgccccaaaggttactcggcttctacgtgaagcagaagaatgtggagttaaagttgttagtggtgtggaaatgtttattagacaagccatgggtcagtttgaacatttcactggtggtatagaagctcctgaaagcctaatgcgcaaaatagcagcgaaatacacctagaaggttaatggcaaaaaacagctgtgataaatatttgcccaaagattttttcagggctgagtgataaaatgttttgagataactgcccggttttgcactcatggaagactttgctgttgtattgttaaatttcacagacttgtctgcacatggaagattacattgacatgatgtatagtgttcattcttgtttgcagaggaattgcgagaataaagcgtcattttagaacctacattatgatgaccaaggaataaaatatgcatcaagcaatg

SEQ ID NO: 29064 - protein, 509 aa, Panicum virgatum
  misc_feature: Ceres CLONE 1888802
  misc_feature (4)..(221): Pfam Name: DHquinase_I Pfam Description: Type I 3-dehydroquinase
  misc_feature (236)..(316): Pfam Name: Shikimate_dh_N Pfam Description: Shikimate dehydrogenase substrate binding domain
  misc_feature (344)..(462): Pfam Name: Shikimate_DH Pfam Description: Shikimate / quinate 5-dehydrogenase
  misc_feature (227)..(509): SWISSPROT Homolog: EC 1.1.1.25 Shikimate dehydrogenase
  misc_feature (4)..(222): SWISSPROT Homolog: EC 4.2.1.10 3-dehydroquinate dehydratase
MTLVCVPLVARTVEEMVADAAAAAAAGSDLVEIRLDFIQGFRPREHLPQLLRGCPLPVLVTYRPTWEGGQYEGDETTRFDTLRLAMELGVDYVDIELKVADKFMSFISGNKPEKCKLIVSSHNYEYTPSCEELANLVARIQAVGADIVKVATAAKDIVDVSRMFQVMVHCQVPMIGLVMSERGLMSRVLAPKFGGYLTFGILNSAKTSAPGQPTVEELLDVYNIRCIGPDTKVLGLIANPVKQSKSPILHNKCLQYVGYNAVYLPLLGDNLASFLETYSSPDFSGFSCSLPFKVDAVQCCNEHDPVAKSIGAINTIVRRPDGKLVGYNTDYIGAISAIEDGIGGPGSKDAVISPLAGRLIVVVGAGGAGKAIAYGAKEKGARVVVANRTYEKAVSLANAIGGQALRLADLETFRPEDGMILANATSLGMQPNIDGTPIPKKALSFYDVVFDAVYAPKVTRLLREAEECGVKVVSGVEMFIRQAMGQFEHFTGGIEAPESLMRKIAAKYT

SEQ ID NO: 29065 - DNA, 1967 bp, Panicum virgatum
  misc_feature: Ceres CLONE 1888803
  misc_feature: Encodes the peptide sequence at SEQ ID NO. 29066
aatctcacgcagatatttcccatttttccgttcccacttcgacagtgtggaagtggccgcgcgacaagccatggccgccgtcccggtcccgccgccgcctcgtctcgcctcccacgcggccgtacgggccgcggcctccgccgtatcccgctcccgccgcgcccgcctctctggcgaccaaccgccgcaggtcgcggccctccggcgcggcgactgggtcaagctcatctgcggcgccagcttcgaggatgctgctgatgtcaggaacctctcccttgtctacacgcttgctggagtggataccgatcacagcaccccacgccgtcgccgtcgccgcccccgctgcttcccaagccatctcatggcggcgtcggcctcttccctcctcgccgccgcagcatcctcgtcctgcgcggccatctctccccggattccccgcggagctccggctgccgcctccgttccttcgccgtcgcatcactcctgcccttccctccgcgcttcccccgcgaggcgccatcagagccgcttcgtagccagcgtcgctcccacgatgcagcctccggcggagtccagggtctctacggtggtcgacgtcgacctcggcgaccgtagctacccgatctacatcggcgcaggcctcctcgacgagccagacttgctgcagaggcatgttcacgggaagagggttctggtggtgaccaacacgaccgtcgcgccgctttacctggagaaggtgacctgggcactcacccacaacaacccgaacgtgtcagtggagagcgtgatcctgcctgacggcgagaagtacaaagatatggacacgctgatgaaggtgtttgacaaggcagtcgagtcccggcttgaccggcgttgcacatttgtagcattgggtggtggtgtcattggggacatgtgcgggtttgcagctgctgcgttccttcgtggtgtcaacttcatacagataccaactactctgatggctcaggtggattcatctgttggtggaaagaccgggattaaccacccacttgggaagaacttaattggggcattctaccagcctcaatgtgtactgatagacacggacacactgaataccttgcctgacagggtgctagcttcaggcattgctgaggtagtcaagtatgggctcataagggatgcaccattctttgagtggcaagagaagaacatgtcagcattgttagcaagagaaccaagtgctttggcatatgctattaagagatcatgtgaaaacaaagctgaagtggttgcacaggatgagaaggaaagtggtcttcgagcaacactaaacctgggtcacacatttggccatgctattgaaactgggcttggatacggagcatggctccatggggaggcaattgcagctggaacagttatggcagctgatatgtctcaccgcctggggtggatggacgagtcaatcaaaaaacgtgtagtggatatattagaggaagccaagcttcccattacacctccagagactatgacagtggagaagttcaaaagtattatggctgttgacaagaaggttgctaatggtttgttgaggctcatccttctgaaagggcctctggggagctgtgtttttactggggaatacgacaggaaagcacttgatgaaacccttcatgcattctgcatcaactgatccttcttgattttggattttgcctcttgtatactaataggctcccttcatgcactctgcaacagctgatccttcttggttttggatttcgcctcttgtaaggctatattgatcatcagggaggagagtgcattgtgtattgagagtgcattgtgtatttatacccattgattttttttgttgggaataatgggattgctagggattggtttgagtttgtagggaaccatatctgatcaactgtgatcagtcatcttctagagttctagtaataaagaagttttactgc

SEQ ID NO: 29066 - protein, 438 aa, Panicum virgatum
  misc_feature: Ceres CLONE 1888803
  misc_feature (90)..(401): Pfam Name: DHQ_synthase Pfam Description: 3-dehydroquinate synthase
  misc_feature: SWISSPROT Homolog: EC 4.2.3.4 3-dehydroquinate synthase
MAASASSLLAAAASSSCAAISPRIPRGAPAAASVPSPSHHSCPSLRASPARRHQSRFVASVAPTMQPPAESRVSTVVDVDLGDRSYPIYIGAGLLDEPDLLQRHVHGKRVLVVTNTTVAPLYLEKVTWALTHNNPNVSVESVILPDGEKYKDMDTLMKVFDKAVESRLDRRCTFVALGGGVIGDMCGFAAAAFLRGVNFIQIPTTLMAQVDSSVGGKTGINHPLGKNLIGAFYQPQCVLIDTDTLNTLPDRVLASGIAEVVKYGLIRDAPFFEWQEKNMSALLAREPSALAYAIKRSCENKAEVVAQDEKESGLRATLNLGHTFGHAIETGLGYGAWLHGEAIAAGTVMAADMSHRLGWMDESIKKRVVDILEEAKLPITPPETMTVEKFKSIMAVDKKVANGLLRLILLKGPLGSCVFTGEYDRKALDETLHAFCIN

SEQ ID NO: 29067 - DNA, 3286 bp, Panicum virgatum
  misc_feature: Ceres CLONE 1888813
  misc_feature: Encodes the peptide sequence at SEQ ID NO. 29068
agggaggaatctgccgggcactttaccccctttcctgcgccggctcacgtgttcatcgttggttcttgctctgcccccggtcactctccccgtcaatcggtcgcgggacgaacaataagtttgcgcgtcgcgggaactaatcgctggcaggcggcactgccactcggcgactgcgacttgacgaacaagcgaggaggcgccacaggtttccgaaccgccgcgagttcttgttagattcgctgggggcgggggcgggggcgcggactcgtcgggccagcgcgcgatgcagcagcaaggcttggacatacacaagctacaacaggtagtgaagacccgctggctgaagcctcaagaagttctgcagatactacggaatcatgagctgttcacggtctcacataatcccccacagaaaccaccgagtggttcttggtttcttttcaaccgaagagtacttcggtacttccgaaacgatggtttcgaatggcaaaagaagaagaatgggaagaccattagtgaagcccatgagcgcctcaaggttgataacatggatgcgctgaattgctactatgcccgtggagacaaaaatcccacatttcagaggcggatatattggatgcttgatccggcttatgaacacattgttcttgtccactatagagatgttctagagggcagcatttcagtatcagcacgaaatgattcttcaacgtcgaatcagaatggcagtgctagcagagctgaagtacacagttcacccggttggacaagccagttagttttaccatgtcccaattcatccagtccaggatctgcagaagaagttagttcccgaactgtgaccataaacaatgaatccaatggtagaagtggatctgattggattcaacataaagcagccttgcggaaacttgaaatgcagctgagtctggaagacaaagaagattcatatgttatagctgaagaagttccaacaaataatgagcatgttattttccctgggattcagactggggagccagacagttctgcaaattttgaggacatctttaatgtactgggctttagtggagatcataccaaagaaactcgaacagacccatgtcccagtgctatcgatgtgttaaaaaattcagacacatggttggaggaggatcaacttgaggcaattctgcatccagcttctatggcactaaccgaaaaccaatggttcgatatccatgaggtttctccagaatcggcattttcttctgaaattacaaaggttattgttttaggagacttcctttgcaatccttctcatagctcattggcaatgctgtttggtgatgttaaggtacctgtggaaattatccagcaaggtgccatccgttgccacactccatgccttaatgctggaaaagtgaccatgtgcttgattgatgggaacgggaaaccctgcagtgaagcatgggaatttgaattccacgagaagcctaccaagagcatgattgatggaaatgagaaaccgtgcaatgaagcacaagatatcaaagtccataagacacctgccaatagtaatgatgagctattgttgctgatcaattatgtgcagatcctttttgatggtcatgattgtgacgtattttcacaatttagcccacaactcccaaatcctggctgtggatccctagttaaccaaatggatattatgaggaagacatatgagcagctagaccctgagaagacattacatagtgtcatggaaatattgcttaatgacaagtttaagcagtggctgtcatccagatgtgaacagaatagtgatggagatcatttgcttcctaagcaatatcacggtgttatacatacaattgcagccttgggatatgacttagctttgaagccactgcttagttctggagtgcctataaactaccgtgatccaaatggatggactgctctacattgggctgcaagatttggcagggaggatatggttgtggctcttcttactgctggggctgcagctggtgcactttcacatccgacgtcagaagatcccgctgccaaaacacctgcttcaatagctttggcttttggtttcaagggcctttccgcattcctttcagaagcacaattaacaactcatcttgattctattgaatctaaagaaaatggaaagtgcgaaggcaaagctagtggaggtggaatacgtagtgctgtggacagaatatcagataaaagcacccatgtgcatggtggaactgatgatcagcttgcgcttaaggattccctaggagctgtccgaaatgctgttcaagctgcagcgcggatacaagctgcgtacagagtgttttcctttaagaaaaagaaagagacggctcttcagaacagctgcttgtccgttcatgagacagttgcagtttcacatggtatgctggagaaagctgccttatcgatacagaagaacttcaggtgctataaaaaacgtaaagaattcctgaagttgcggaaaaatgtcatcaagatacaggcacgggtgagagctcatcaagaaagaaagaagtacaaggaactaattcgaagtgttggtgtccttgagaagttgatgcttcgctggtaccgaaaaggggttggtttgcggggcttcaattctggagcaatgccagttgacgaagaggtggaagaagacgttgccaaagttttccggaagctaagagtggaaacagccgttgatgaagctgtttcaagggtatcatgcatcatcgggagtcctaaagcaatgcagcagtaccgaaggatgcttcagaggtaccaacaagcaaaggtgaatataccaaaggatgcttcagaggttccaacaagtaaagggtgaccatgaaaagtggtgcttgtgttaagcctacagtgatggagcaagcacaagccacccactattctctatctccagtgctgaaggatctgaataacagtttgcgttggtgaagagtaaagctgtggtgactggaaggacagtggatcctgagtaccgtctccaattcatgctgaacgctgtgtgtgtacatagcaacgtcatgtgcaacagctgactttcggctgaaagtcgagaaaggtgaagggctttgtacatgaagaagcctcaaaggctaggcctagacagaggtgagatgaagctcacctcgttcgatgtatcgtgtatataccgtgtgttcacgagtactaggttttcagtaacttcgtactagtagtaaatatgggcaaagctgctgtagcacaatgaatcatgtatggaatctcagttgcc

SEQ ID NO: 29068 - protein, 857 aa, Panicum virgatum
  misc_feature: Ceres CLONE 1888813
  misc_feature (11)..(129): Pfam Name: CG-1 Pfam Description: CG-1 domain
  misc_feature (737)..(757): Pfam Name: IQ Pfam Description: IQ calmodulin-binding motif
  misc_feature (549)..(581): Pfam Name: Ank Pfam Description: Ankyrin repeat
MQQQGLDIHKLQQVVKTRWLKPQEVLQILRNHELFTVSHNPPQKPPSGSWFLFNRRVLRYFRNDGFEWQKKKNGKTISEAHERLKVDNMDALNCYYARGDKNPTFQRRIYWMLDPAYEHIVLVHYRDVLEGSISVSARNDSSTSNQNGSASRAEVHSSPGWTSQLVLPCPNSSSPGSAEEVSSRTVTINNESNGRSGSDWIQHKAALRKLEMQLSLEDKEDSYVIAEEVPTNNEHVIFPGIQTGEPDSSANFEDIFNVLGFSGDHTKETRTDPCPSAIDVLKNSDTWLEEDQLEAILHPASMALTENQWFDIHEVSPESAFSSEITKVIVLGDFLCNPSHSSLAMLFGDVKVPVEIIQQGAIRCHTPCLNAGKVTMCLIDGNGKPCSEAWEFEFHEKPTKSMIDGNEKPCNEAQDIKVHKTPANSNDELLLLINYVQILFDGHDCDVFSQFSPQLPNPGCGSLVNQMDIMRKTYEQLDPEKTLHSVMEILLNDKFKQWLSSRCEQNSDGDHLLPKQYHGVIHTIAALGYDLALKPLLSSGVPINYRDPNGWTALHWAARFGREDMVVALLTAGAAAGALSHPTSEDPAAKTPASIALAFGFKGLSAFLSEAQLTTHLDSIESKENGKCEGKASGGGIRSAVDRISDKSTHVHGGTDDQLALKDSLGAVRNAVQAAARIQAAYRVFSFKKKKETALQNSCLSVHETVAVSHGMLEKAALSIQKNFRCYKKRKEFLKLRKNVIKIQARVRAHQERKKYKELIRSVGVLEKLMLRWYRKGVGLRGFNSGAMPVDEEVEEDVAKVFRKLRVETAVDEAVSRVSCIIGSPKAMQQYRRMLQRYQQAKVNIPKDASEVPTSKG

SEQ ID NO: 29069 - DNA, 680 bp, Panicum virgatum
  misc_feature: Ceres CLONE 1888833
  misc_feature: Encodes the peptide sequence at SEQ ID NO. 29070
agaacaccctcacttctccttcctcaacggttcggccagccagatccagatcccgcggcgaggggaagaagaggctgccggtgtaactcacgagttacttggatagtttaagaaagatggtgaagatatgctgcctcggtgctggatatgttggcggcccaaccatggctgtcattgcgctgaaatgccctgctattgaagtttgtgtcgtcgacatttccgttccacgcattgcagcatggaacagcgatcagctccctatttatgaaccgggccttgatgaagtggtcaagcagtgccgtggcaggaacctcttcttcagcaatgacattgagaagcatgttgctgaggctgatatcatctttgtctctgtgaacacaccaaccaagacccgtggtcttggggctggcaaagctgcggatttaacctactgggagagtgcagcccgcatgatcgcagatgtggccaagtctgacaagattgtggttgagaagtccactgtccctgtcaagaccgccgaagccattgagaagatcttgaggcacaatagcaagggaatcaacttccagatcctctcaaaccctgaattccttgcagagggcacagcaattgaggaccttttcaagcctgaccgtgtgctcattggtggtcgggagactccagaaggcctgaaggctgtt

SEQ ID NO: 29070 - protein, 187 aa, Panicum virgatum
  misc_feature: Ceres CLONE 1888833
  misc_feature (2)..(187): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 51302
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVKICCLGAGYVGGPTMAVIALKCPAIEVCVVDISVPRIAAWNSDQLPIYEPGLDEVVKQCRGRNLFFSNDIEKHVAEADIIFVSVNTPTKTRGLGAGKAADLTYWESAARMIADVAKSDKIVVEKSTVPVKTAEAIEKILRHNSKGINFQILSNPEFLAEGTAIEDLFKPDRVLIGGRETPEGLKA

SEQ ID NO: 29071 - DNA, 663 bp, Panicum virgatum
  misc_feature: Ceres CLONE 1888841
  misc_feature: Encodes the peptide sequence at SEQ ID NO. 29072
gatgggtggcagaatgatggctggccgtggctttggacgtgggctggaacgcaagacacctcctccaggttatgtttgtcatagatgtaaagtacctggccatttcattcaacattgcccaacaaatggtgatgctagatatgatgtgagaaggatgaaacccccaactggcattccaaaatcaatgttgttgcaaactccggatggttcatatgcactgccaagtggggctggtgctgttttgaagcccaatgaagctgcttttgagaaggagatagagggcctacccaccacccgctctgttggcgatcttccaccggagctacgctgcccattgtgcaaagaagtaatgaaggatgctgttctaactagtaaatgctgctttaggagtttttgtgataaatgtatcagggactacataattaacaagtcagtgtgtgtctgtggtgccacaagcatattagctgatgatcttctccccaataaaactctaagagaaaccatcagccgcatattagaggcaccaccatctagcagcacggaaaatgtgggaagcatggtccaagtacaggacatggagtcagctctacctgtacaacctaaggttagatctcctgctgtttctgctgcttcgaaggaggagaccaaagcacccacacttgt

SEQ ID NO: 29072 - protein, 220 aa, Panicum virgatum
  misc_feature: Ceres CLONE 1888841
  misc_feature: The sequence is a functional homolog of SEQ ID NO 526 in the 10/666,642 US patent application
MGGRMMAGRGFGRGLERKTPPPGYVCHRCKVPGHFIQHCPTNGDARYDVRRMKPPTGIPKSMLLQTPDGSYALPSGAGAVLKPNEAAFEKEIEGLPTTRSVGDLPPELRCPLCKEVMKDAVLTSKCCFRSFCDKCIRDYIINKSVCVCGATSILADDLLPNKTLRETISRILEAPPSSSTENVGSMVQVQDMESALPVQPKVRSPAVSAASKEETKAPTL

SEQ ID NO: 29073 - DNA, 2006 bp, Panicum virgatum
  misc_feature: Ceres CLONE 1888867
  misc_feature: Encodes the peptide sequence at SEQ ID NO. 29074
aaccaaccaaccaaccccacgcgcacacaccagcagcggaaagggaggggaccaagcccggaccgcgagcccgcacgcctttcacacttgatgggttgctgccgctcctcgctccggccgggggcgggggcgggggcggggacccacgcggcggggaagccgccccggcaccgcccgccgccgccaccgacgacgatccgcccgtccacgaacgcgcaccggaccgcgccctcggcccgcgcgagcggcggcggcggcggcagggatgtcccggcgttcgcggagttctccctggcggacctccgcgcggccacgggcgggttcgcggccgagaacatcgtctccgagagcggcgagaaggcgcccaacctcgtctacaggggccagctcgagggcagcggcggcgcgccgccgcgcgcgattgccgtgaagaagttcgccaagctcgcgtggcccgaccccaagcagttcgcggaggaggccaagggggtggggggcctgcgccaccggaggatggcgaacctgatcggctactgctgcgacggcgacgagcgcctgctcgtcgccgagttcatgcccaacgacaccctcgccaagcacctgtttcactgggaaaaccagactatagaatgggctatgcgtctgagagttgcatactacatctcccaagcattggaatattgtagtatcaagggaaggcctttatatcatgacttaaatgcatacagggtcctctttgatgagaatggtgaccctcgtctgtcatgctttggtctgatgaaaaacagcagggatggcaaaagctatagcacgaacctagcatatacacctccagaatatctcagaaatggaagggttactccagaaagtgtcatattcagttttggcactgtacttctcgaccttctcagtggaaaacgtatacctccttcacatgcactagatatcatgagaggcagaaacatcgaagcaataatggattcacatttggaggggaactactcgacagaggtggctactacactggtgaaccttgcttctcaatgtctacagtatgagccaagagatcgtcctgacataaaaaagttggtttccatactggagcctttgcagacaaaattggaggtaccatcctatgtgatgcttggaattccaaagcctgtggaagaaccacaggcacctcctactccacagcaccctctttctgccatgggagaagcctgttccaggatggacctaactgccatccatcagatcctattcacgacacattacagagatgatgaagggtccaatgagctatcttttcaagaatggacgcagcagatgagggatatgttggatgcaaggaaacgtggcgactttgcctttaaagacaaagattttaagacagcaatcgattgttatagtcagtttgttgatgtggggacaatggtgtcaccaactgtgtttgccagacgaagcttgtgctaccttatgtgtgaccaacctgatgctgccctccgtgatgccatgcaagcacagatcgtctcccctgattggccaacagcattctacatgcagtctgtcgcactatccaagctgaacatgcagagtgatgctgtggacatgctgaacgaggcttcagagctagaagagaaaaggcaaaagagcacaaagggtccttgagaagtggcatcccttatataagtatataacatagattcacgctatgtagtaaattccccaaccctttcccttgtagaaagtgattagcatattgcgtggttaaatcttagatggttaaaatttagatgttaggaaacctctgtagagaagaggctctctacagaagagccttgtggtcagaataacttatttggtttgacgacatttccgtgataggttctgcatttttttgggcccatgtatataagatctgttgcctgagtttgaaacttgatataggtactggttgtcaggtgggcccctgtagccgaagctaataaacatgccttcgtttgtgc

SEQ ID NO: 29074 - protein, 525 aa, Panicum virgatum
  misc_feature: Ceres CLONE 1888867
  misc_feature (95)..(337): Pfam Name: Pkinase_Tyr Pfam Description: Protein tyrosine kinase
  misc_feature: SWISSPROT Homolog: EC 2.7.11.1 Non-specific serine/threonine protein kinase
MGCCRSSLRPGAGAGAGTHAAGKPPRHRPPPPPTTIRPSTNAHRTAPSARASGGGGGRDVPAFAEFSLADLRAATGGFAAENIVSESGEKAPNLVYRGQLEGSGGAPPRAIAVKKFAKLAWPDPKQFAEEAKGVGGLRHRRMANLIGYCCDGDERLLVAEFMPNDTLAKHLFHWENQTIEWAMRLRVAYYISQALEYCSIKGRPLYHDLNAYRVLFDENGDPRLSCFGLMKNSRDGKSYSTNLAYTPPEYLRNGRVTPESVIFSFGTVLLDLLSGKRIPPSHALDIMRGRNIEAIMDSHLEGNYSTEVATTLVNLASQCLQYEPRDRPDIKKLVSILEPLQTKLEVPSYVMLGIPKPVEEPQAPPTPQHPLSAMGEACSRMDLTAIHQILFTTHYRDDEGSNELSFQEWTQQMRDMLDARKRGDFAFKDKDFKTAIDCYSQFVDVGTMVSPTVFARRSLCYLMCDQPDAALRDAMQAQIVSPDWPTAFYMQSVALSKLNMQSDAVDMLNEASELEEKRQKSTKGP

SEQ ID NO: 29075 - DNA, 663 bp, Panicum virgatum
  misc_feature: Ceres CLONE 1888878
  misc_feature: Encodes the peptide sequence at SEQ ID NO. 29076
aagtagaaaatccacttcttccctgagagaccacaaatcatgacccctcctatcaaggttggaccatggggtgggagcaatgggagtccatttgacatcacaaggccattcgagcgtctcgaaagcgtggcaattcagtttggcagagtcatcaattcatttggtttcacctatgttgatgcaataagccagaagcacactgttggtccagttgacggtgacggccgtggagaacttactacaatcgagtttgcaccaacagagtatgtaacggaattcgccggatcaattggtgacaccaaaggaacatttgttgtgacgtatctcaggattcggacaaacttagaaacatacgagatacatggcacagggctgaacgcccaagcgaacactagcgcagtagagactgcatttcctttcagcgtccctctgccggagaacaccagcattgtgggattctttggacgtcaaggggacaatcttaatgccattggcgtttatgtgaaaccatccagttccctcgacacagacacaacacaggaaagccatggcacttcttccccagatgatcatgctcatgatcatactcgcccacttatttgctcttgtgttcctttaatctaaacctcataccctgcctatgcatccatctctactttgcag

SEQ ID NO: 29076 - protein, 194 aa, Panicum virgatum
  misc_feature: Ceres CLONE 1888878
  misc_feature (15)..(157): Pfam Name: Jacalin Pfam Description: Jacalin-like lectin domain
MTPPIKVGPWGGSNGSPFDITRPFERLESVAIQFGRVINSFGFTYVDAISQKHTVGPVDGDGRGELTTIEFAPTEYVTEFAGSIGDTKGTFVVTYLRIRTNLETYEIHGTGLNAQANTSAVETAFPFSVPLPENTSIVGFFGRQGDNLNAIGVYVKPSSSLDTDTTQESHGTSSPDDHAHDHTRPLICSCVPLI

SEQ ID NO: 29077 - DNA, 645 bp, Panicum virgatum
  misc_feature: Ceres CLONE 1888880
  misc_feature: Encodes the peptide sequence at SEQ ID NO. 29078
catctccacagatgagtctccactccatggccaccgccgaagccgcgcgtcctgccgccccggccggtttcggccgcgaccacgtcgtcgtgttcccgttcatggccaagggccacacgatcccgctcctccacctcgcctcggcgctcgccgcgcgccacgggggcggcggcctccgcgtcacggtacttaccacgccgggcaacctcgccttcgcgcgccaccgcgtccccgcgcacgtcagcctcgtcaagctcccgttccccgcgcacccggagctgccgccgggcgtcgagtccaccgacgcgctcccctcgccctcgctctttccggcgttcctccgcgccacggcgatgctccgggagcccttcgcggggtacctggcctccctgcccgcgccgccgctggcgctcgtctccgacttcttcctagggttcacgcagcgcgtcgccaccgacgccggcgcccgccgcatcaccttccacggcatgtcggccttctcgctggcgctctgcttctccctcgccacgcgctcgcccgcggcggccgggagcatcgccgaggacgacggcggcccgttccccgtgccggggttcccggagggcttcacgattaccaaggacgaggtcccgcacgccgtggcgc

SEQ ID NO: 29078 - protein, 206 aa, Panicum virgatum
  misc_feature: Ceres CLONE 1888880
  misc_feature: SWISSPROT Homolog: EC 2.4.1.238 Anthocyanin 3'-O-beta-glucosyltransferase
MATAEAARPAAPAGFGRDHVVVFPFMAKGHTIPLLHLASALAARHGGGGLRVTVLTTPGNLAFARHRVPAHVSLVKLPFPAHPELPPGVESTDALPSPSLFPAFLRATAMLREPFAGYLASLPAPPLALVSDFFLGFTQRVATDAGARRITFHGMSAFSLALCFSLATRSPAAAGSIAEDDGGPFPVPGFPEGFTITKDEVPHAVA

SEQ ID NO: 29079 - DNA, 567 bp, Panicum virgatum
  misc_feature: Ceres CLONE 1888880-R
acgtcctcggcgccggcgtgcgcgcgggggtgaaggccggcgccaacgcgccgccggagctggtcggcagggcgcaggtggccgggaaggtccgggagctgatggacggcggcggcgaggccgggcgcgggatgcgcgccagggccgagcgcgtcggggaggcggccgtgggcgacggcggcacgtcgcggctggcgctgcggcggctggtggacgagctgcagcgaagctacgagcctacgacgacggcggacagcgcgaagcggcggcaggaagcgccaaaccaaacgtgtgacagcggccccactgcacggagtgactgataaagaagagtcaaagtcatttagtgtgagcttttggtgcaagcgagttgttgtcctgatgtcatgtcgtttatttcttcgatgatatgcttgtgttagcgcaggagcatctcccggcgagagatggaggtgtggaaaagtagtatttgggcttgtttagttggtgaaaattattagttttggtattgtattatattttgatgttacttgataaataatatttaattatagattaattagattc

SEQ ID NO: 29080 - DNA, 623 bp, Panicum virgatum
  misc_feature: Ceres CLONE 1888883
  misc_feature: Encodes the peptide sequence at SEQ ID NO. 29081
ctatccaaaatccgcaggccacgaactcacgaagcggcagcgagagccgagagaagccatggcgctgtccctctccctcgcgcgcgccgcgcccctcgccgtctccgcgggcgccggggccaggaggctccccgcagccagcctcgccttcccgcccaagtccttcttcggcgcgcctctggccgccaccaccgcctccgtcgcgtcgccgctcccgcgcaagccggccacctccccctcgctcgcggtcgtcgcggcgggcaagaaggggtacaagatgaagacccacaaggcgtcggcgaagcggttcagggttacggggaggggcaagatcgtgcgccggtgcgccgggaagcagcacctgctcggcaagaagaacaccaagcgcaagaagaggctctccaagatggtccaagtaaacaagagtgactacgacaatgtgacaggcgcactgccctacctcaaagtgaataggaaagcagactgagttcttggtcttcaaaagtcattctgtttcattccaccaacctgtaattttgtgtaccttccgctgtatttcctttcgaatatggaggccgactcaggccgtaattcatttcaagaaagcataaaatactcttcgc

SEQ ID NO: 29081 - protein, 142 aa, Panicum virgatum
  misc_feature: Ceres CLONE 1888883
  misc_feature (74)..(132): Pfam Name: Ribosomal_L35p Pfam Description: Ribosomal protein L35
MALSLSLARAAPLAVSAGAGARRLPAASLAFPPKSFFGAPLAATTASVASPLPRKPATSPSLAVVAAGKKGYKMKTHKASAKRFRVTGRGKIVRRCAGKQHLLGKKNTKRKKRLSKMVQVNKSDYDNVTGALPYLKVNRKAD

SEQ ID NO: 29082 - DNA, 725 bp, Panicum virgatum
  misc_feature: Ceres CLONE 1888890
  misc_feature: Encodes the peptide sequence at SEQ ID NO. 29083
aacttttgggattgaccttcaagaaatacggctcatgggtattctgcagagaattgcaatagcttatctattgactgccctatgtgaaatttggctcaaaggagatgaagatgtagattatggattcgatttgctcaagagataccgctaccaactgttcgtaggcgcaattgtggcaatcacatacatggccctgttgtatggtacctatgttcctgattgggagtatcagacatcaggtcctggatctgcagagaagtctttcttggtgaaatgcggagtaagaggtgacaccagcccagcttgtaatgcggttggcatgatcgaccggaaaatcttaggcatccaacatctctatggtcgaccggtctacgcgcggtcaaagcaatgcagcatcaattcaccggaaaatgggccccttcctccggacgccccctcttggtgccaggctccttttgaccctgaaggccttctcagttccgtgatggccattgttacatgcttgattgggctccagtacggacacgtcattgtacatttccagaaacacaaggataggatcatgaactggttaatcccttccctcagcatgctagtcctagccttctccatggacttctttggaatgcacatgaacaagccactgtacaccctgagctacaccttggccaccgccggcgcggcgggcctcctcttcgctggaatttatgcgctggtcgacctgt

SEQ ID NO: 29083 - protein, 241 aa, Panicum virgatum
  misc_feature: Ceres CLONE 1888890
  misc_feature: SWISSPROT Homolog: EC 2.3.1.78 Heparan-alpha-glucosaminide N-acetyltransferase
TFGIDLQEIRLMGILQRIAIAYLLTALCEIWLKGDEDVDYGFDLLKRYRYQLFVGAIVAITYMALLYGTYVPDWEYQTSGPGSAEKSFLVKCGVRGDTSPACNAVGMIDRKILGIQHLYGRPVYARSKQCSINSPENGPLPPDAPSWCQAPFDPEGLLSSVMAIVTCLIGLQYGHVIVHFQKHKDRIMNWLIPSLSMLVLAFSMDFFGMHMNKPLYTLSYTLATAGAAGLLFAGIYALVDL

SEQ ID NO: 29084 - DNA, 1305 bp, Panicum virgatum
  misc_feature: Ceres CLONE 1888895
  misc_feature: Encodes the peptide sequence at SEQ ID NO. 29085
catggcgatgtctgcttcatctcattgccctactactttcctgcgagccttaaccttgttatctgtgtttgcagttcttgttgcagatgtaggagggcgacatcatgttgtttgccctcctttctcctgtggtggttttagcaatgtatcatatcccttccgtcggcaaggtgatccacatgggtgtggtgttcaatcgtacgagctggtttgcacggagatcagcgctacgatccgcatcggcagtggagtatacaacgtgcttagcatcaactatactggttcttacttctgggttgttgacgccaacttgggcatgcaaaacagttgcccccttccgcggtgggattacagagatgatgattattattattattatcactacgatggcatctcacatggtagctttgagctggacccttactggggtgattggtgggctatctttataaattgttcgcaggaaataaagtacaatggttcatggccggtcgaatgcctgagcacagcagattctttcatctatgtgtcaatatggcctgactattcctttgtcgaagctgagtattttgcgccctcatgtggtttcctggctatgactcctttgggtggtccaggcacgacgttggcatcagatgtttttgagggaagctatctagatgttattaagctcatgaggaaaggatttgctcttcaatttccttttacgtatggggagaccatcagagagtgcctcgcatggtcaaagcgtggatttcgttatgatttccgtaaggggggcagcaccaagcttcaaacttgggacattcttaagattgacatgtatttctgggactgcgttactgagcaatttaggtcatctaatcatgtgacatcttttctcctcgacatcatcagtataacattaccagctgctctgttggttctcaagtttattcatcttcttatcaggtacatattggtgccgctggcattgtttaccttccttgcccacagatactggaaaacaagaataacactcgacgcagtagagaagtttctacgaatgcagcaaatgcttgtaacaacgagatacgcctacacagatatcattgcgatcacgggccatttcagagagaagctcggccaaggaggctatggctccgtatacaagggcgtgctgctgccaggcggtgttcccattgctgtcaagatgttgggcagctctagctgcaatggagaagagttcatcagcgaggtcgccaccattggcaagatccaccatgtcaatgtggtgcgcctcgtcgggttctgctctgaggaaac

SEQ ID NO: 29085 - protein, 434 aa, Panicum virgatum
  misc_feature: Ceres CLONE 1888895
  misc_feature: SWISSPROT Homolog: EC 2.7.11.1 Non-specific serine/threonine protein kinase
MAMSASSHCPTTFLRALTLLSVFAVLVADVGGRHHVVCPPFSCGGFSNVSYPFRRQGDPHGCGVQSYELVCTEISATIRIGSGVYNVLSINYTGSYFWVVDANLGMQNSCPLPRWDYRDDDYYYYYHYDGISHGSFELDPYWGDWWAIFINCSQEIKYNGSWPVECLSTADSFIYVSIWPDYSFVEAEYFAPSCGFLAMTPLGGPGTTLASDVFEGSYLDVIKLMRKGFALQFPFTYGETIRECLAWSKRGFRYDFRKGGSTKLQTWDILKIDMYFWDCVTEQFRSSNHVTSFLLDIISITLPAALLVLKFIHLLIRYILVPLALFTFLAHRYWKTRITLDAVEKFLRMQQMLVTTRYAYTDIIAITGHFREKLGQGGYGSVYKGVLLPGGVPIAVKMLGSSSCNGEEFISEVATIGKIHHVNVVRLVGFCSEE

SEQ ID NO: 29086 - DNA, 599 bp, Panicum virgatum
  misc_feature: Ceres CLONE 1888895-R
  misc_feature: Encodes the peptide sequence at SEQ ID NO. 29087
caagctattcccaagggataacagcttcgtgccgctgagcgctatgcggggaacgatcggctacatagctccggagatggtgtcacggagcttcggtgccatatccagcaagtccgacgtgtacagcttcgggatgttgctgctggagatggccggagggcgcaggaatgctgacccgcacgccgggagctccagccagacgtactacccatcgctggtgtacggccagctgaccggggagcaggttggggagatcagtgaagatgtcgacatgcacgagctggagaagaagctgtgcgtcgttgggctctggtgcatccagatgaaacctcgtgatcggccgacgatgagcgaggtcatagagatgcttgaaggggatgcgggcgctctgcaaatgcccccgaggccgttcttctgtgacgaggagatgcttcctgaagtggcttcgtactctctgtcctccgaactgaatgtgatagaggaggaagatgagtgaaatactttgtttctatgtgtcttaaatgtacaaggacatatgtttgtccgtttgtagcttgtcatatactcatactaagctcagggttgccagtgtgtgatac

SEQ ID NO: 29087 - protein, 164 aa, Panicum virgatum
  misc_feature: Ceres CLONE 1888895-R
  misc_feature: SWISSPROT Homolog: EC 2.7.11.1 Non-specific serine/threonine protein kinase
KLFPRDNSFVPLSAMRGTIGYIAPEMVSRSFGAISSKSDVYSFGMLLLEMAGGRRNADPHAGSSSQTYYPSLVYGQLTGEQVGEISEDVDMHELEKKLCVVGLWCIQMKPRDRPTMSEVIEMLEGDAGALQMPPRPFFCDEEMLPEVASYSLSSELNVIEEEDE

SEQ ID NO: 29088 - DNA, 1230 bp, Panicum virgatum
  misc_feature: Ceres CLONE 1888899
  misc_feature: Encodes the peptide sequence at SEQ ID NO. 29089
attccccgcaacaaaacaacccccgcaacctctcctctctctctccacttgttttcttgatctccgccgcttcctctcctctcctctcccccgcgtctctagggtttccacgccgccggattcgaaacccgcgctcccgagcaagtgaccagcggggcaactccatcaagtgacctgtgctaattatgcgatcttcatgggctgattcagttgcgaacgccgaggaatcggcgcccgcgactggtgctgctaacggatccgttgctaatcacggcaacccgcgccccacgcgcagctcctacgtgcctcctcacctccgtggccgtccagctggtgctggtgttgacgcccaagcaggctcagcagcgccggcgcaaggtggcccactgccctcggctgacgcacagccatctggtccggctgctgctgttggtggccctcgctgggctggcattgttaacagtggtggaagtggcagtgtgggtgctcctcgtcagggttatggcggtgggggccgtggtggtgggggccgtggtggtgggggcggtggcggtgcctggaactcccgtcctggcggttgggaccgcagagaccgtgagccggatccctttgctaaagctgaggcagaagaagttgacttcgagggtgctgagaacactggcatcaattttgatgcctatgaagacatccctgttgagaccagtggccacgatgtacccgcaccagtcaacacattcgcagagattgatttgggtgatgcgctgaatgagaatatccggaggtgcaagtatgtgaaaccaacaccagtgcagcgttatgctatcccaatctccatcgctggacgggatcttatggcctgcgcacagacggggtctggaaaaaccgcagccttctgtttcccaatcatcagtggcatcttgaagtctaggccaccccagaggcagcgtagttcaaggactgcatgtcctctggctctgatcttatctcccactcgtgagctttcagtccaaatccatgaagaagcaaggaaatttgcatatcagactggtgtcagagttgtggttgcatatggaggtgcaccgataacaaatcagctgagggagttagaaagaggtgttgaaatcctggtggcaactcctggacgcttaatggatctgttggagagggctagagtctcactacaaaacattatgtatttagctctcgatgaagctgatcgaatgcttgata

SEQ ID NO: 29089 - protein, 348 aa, Panicum virgatum
  misc_feature: Ceres CLONE 1888899
  misc_feature (206)..(348): Pfam Name: DEAD Pfam Description: DEAD/DEAH box helicase
MRSSWADSVANAEESAPATGAANGSVANHGNPRPTRSSYVPPHLRGRPAGAGVDAQAGSAAPAQGGPLPSADAQPSGPAAAVGGPRWAGIVNSGGSGSVGAPRQGYGGGGRGGGGRGGGGGGGAWNSRPGGWDRRDREPDPFAKAEAEEVDFEGAENTGINFDAYEDIPVETSGHDVPAPVNTFAEIDLGDALNENIRRCKYVKPTPVQRYAIPISIAGRDLMACAQTGSGKTAAFCFPIISGILKSRPPQRQRSSRTACPLALILSPTRELSVQIHEEARKFAYQTGVRVVVAYGGAPITNQLRELERGVEILVATPGRLMDLLERARVSLQNIMYLALDEADRMLD

SEQ ID NO: 29090 - DNA, 651 bp, Panicum virgatum
  misc_feature: Ceres CLONE 1888899-R
atgagagcaacacgtcgctggcaaggcagttgagtgagctcatgcaagagcccaaccaggaggttccacagtggcttgagcggtacgctgcccgttcaacctacggaggtggtggcggtagaaaccgcagatcaggtggcggtgccaggtttggtggccgtgacttcaggcgagacaggggcagtggtgggtatggcggcggcggcggtggtgcttatggtggcggcggtggtggcggatatggggggtcatcgggatatggtggtgggtatggaggcggcggcagcggctacggtggtggtcagagcgcttgggactgatcttgatccgtactaagtgtgaagctgaaaatgaaccgacagtgatcaattggttcccttgggttaaatggatgcgtggaaatgaaatttgtatcttcactggatgagtatggtgttgggaaacgtccccttcgctagtgttctggttttaatccttttgtttatgttgtactaggaattggcttgtatgatcttttattatctggattggtggtctgctgtctgtttcttcccgatgctattttttgttttgccatttcagtcgtattcacggggtgattctgctttgattgttaattgttaatttgttctttgatctttcgaagagttg

SEQ ID NO: 29091 - DNA, 584 bp, Panicum virgatum
  misc_feature: Ceres CLONE 1888902
  misc_feature: Encodes the peptide sequence at SEQ ID NO. 29092
aagccgtgggcgacacccctcaaggcccgacgcgtacttgcacggcgcggcagagaggtcccagctcctagctgcgtaggcccggtgccatggctgcagccaccgagtcctccccggccgccagcgccgccgccgccgctagtagggcgtgggagtgggaggggaaggtggtgtcgccggtggccgtggcgacggcggacgaggcgtgggcgctgctgtcggacttcctggcgttccaccggtggcacccgcgcgtggcggcgtgccggctggcgtcgggcaccccgcgcctgcacgggtgcgagcgctacggcaagggcaccatccccttccccgagttcctcggcctcatggcccgcaagatgacggacaccgactctgaggaggagctcacggaggcgttctgggtgttctacaaggacaaaaacggcttcatctccgctgcgaagctccgccacgcgatgaccaacctcggcgataagctgaccgacgaggaggtagacaagatgatccgcgaggccgacgttgatggggatggccagatcaactatgacgagttcgtcaaggtgatgatggccaaatga

SEQ ID NO: 29092 - protein, 164 aa, Panicum virgatum
  misc_feature: Ceres CLONE 1888902
  misc_feature (136)..(164): Pfam Name: efhand Pfam Description: EF hand
  misc_feature: SWISSPROT Homolog: EC 2.7.11.1 Non-specific serine/threonine protein kinase
MAAATESSPAASAAAAASRAWEWEGKVVSPVAVATADEAWALLSDFLAFHRWHPRVAACRLASGTPRLHGCERYGKGTIPFPEFLGLMARKMTDTDSEEELTEAFWVFYKDKNGFISAAKLRHAMTNLGDKLTDEEVDKMIREADVDGDGQINYDEFVKVMMAK

SEQ ID NO: 29093 - DNA, 663 bp, Panicum virgatum
  misc_feature: Ceres CLONE 1888903
  misc_feature: Encodes the peptide sequence at SEQ ID NO. 29094
atcaatcaatcccacatcgactgagtacaggaaggccacagcacagaggccggccgggagcagcagcagcgagatggcggcggcggagtcctctggcacggcgatagggtcctcgggaagatgggccctccacggcaagacggccctcgtcaccggcggcacgcgcggcatcgggcgtgcggtagtggaggagctggcggcgctaggggcggctgtgcacacctgctcccggaaggaggaggagctcggcgagcgcatcaaggagtgggaggccaggggcttccgcgtcaccggctccgtctgcgacctctccgcgcgtgaccagcgggagcgcctgcttcgcgaggtcgccgaccacttcggcggcaagctcgacatcctcgtgaatcagaataaactgtgactactgttttttagaaacaaaggcaacctgcctgtcccatttttactaaaacaaagccactaaatgctcttacagtttaagcatagtatgtagctcatcctatccggcgctcctgcataacaaaggttgcagagcctgacttctcatacagtttaacttctctacacaacattccgtaatctgcccttttcaaaaaaaaaaaccgtaatctgtccttaaaaaaaaaatgggacaggcgtgcggtagagcctggtgcaccg

SEQ ID NO: 29094 - protein, 109 aa, Panicum virgatum
  misc_feature: Ceres CLONE 1888903
  misc_feature: SWISSPROT Homolog: EC 1.1.1.236 Tropinone reductase
MAAAESSGTAIGSSGRWALHGKTALVTGGTRGIGRAVVEELAALGAAVHTCSRKEEELGERIKEWEARGFRVTGSVCDLSARDQRERLLREVADHFGGKLDILVNQNKL

SEQ ID NO: 29095 - DNA, 652 bp, Panicum virgatum
  misc_feature: Ceres CLONE 1888905
  misc_feature: Encodes the peptide sequence at SEQ ID NO. 29096
cgcgccgtcggacagccattgttgatctcttaccatgcgggtttcaaccttttctttgtattcgcggacacgggcccccctgcgatggaagccgtcggcgtcgctcctgcgcccgtggcggcgccggtgaacaacaatctccttgacctgcagaaacctttccccgccgccgcgaacggcgcgaaggcgtccccggcggggaagtgggcgatgaagaagaagctggtgggcggcgacgcggactacgtcctcgaggacgtcccacacctcacggattacctgcccgagctcccgactttcccgaatcccctccaagacaattctgcgtattcggtcgtcaagcagtatttcgtcaacctagacgacacagtctcgcaaaagattgttgttcataagaccagtgcgaggggaactcacttccggcgtgccgggccgcggcagagggtgtatttccagtccgatgaggtgaacgcggccattgtcacctgcggaggcctctgccccgggctgaacacggtcgtccgcgagcttgtttgcgggttatacgatatgtatggtgtcaccagcgttgttggcatagagggtggatacaaggcgttttattctaaaaatactattccattgacaccgaaatcggtgaacgacatccaca

SEQ ID NO: 29096 - protein, 189 aa, Panicum virgatum
  misc_feature: Ceres CLONE 1888905
  misc_feature: SWISSPROT Homolog: EC 2.7.1.90 Diphosphate--fructose-6-phosphate 1-phosphotransferase
MEAVGVAPAPVAAPVNNNLLDLQKPFPAAANGAKASPAGKWAMKKKLVGGDADYVLEDVPHLTDYLPELPTFPNPLQDNSAYSVVKQYFVNLDDTVSQKIVVHKTSARGTHFRRAGPRQRVYFQSDEVNAAIVTCGGLCPGLNTVVRELVCGLYDMYGVTSVVGIEGGYKAFYSKNTIPLTPKSVNDIH

SEQ ID NO: 29097 - DNA, 589 bp, Panicum virgatum
  misc_feature: Ceres CLONE 1888943
  misc_feature: Encodes the peptide sequence at SEQ ID NO. 29098
acacaggccacagcaccaccaccggagcacagagagagcagagcgccacaggccgtccgatcctccgcgcgaagcagatcagatggctctcgctctctccggctcctccgcgctccgcgccgcgctggcctcgctggcccccgcctggggctacgcggcgtcagcggcgccccgggccctgcggcgcgcggcggcggcggcggacggggccgccccgggggaggccgtggaggcggggcgcggcgccccctcctagaccgcctgcggcggcggcggcgccccccttcgccctgtccgcggccgctgtgggtcgcgcgcgcccatctccgcgagctcacgtgcaccccgccgttaccgtcggcgccttcgtccccggccacctccacctgttccacggcctcctgtactgggtcgcccagcgcctgggatccaccgcggcgtgcctcctcctccgcttctcgaccggcggcctcgccaccggcacctgccgcctgaccggcatctccgtgtgggaggccctggtcctggagatcgtgatgaccttctggctggtgtacacggcgtacgcgacagccgtggacccgaagaa

SEQ ID NO: 29098 - protein, 195 aa, Panicum virgatum
  misc_feature: Ceres CLONE 1888943
  misc_feature (3)..(195): Pfam Name: MIP Pfam Description: Major intrinsic protein
TGHSTTTGAQREQSATGRPILRAKQIRWLSLSPAPPRSAPRWPRWPPPGATRRQRRPGPCGARRRRRTGPPRGRPWRRGAAPPPRPPAAAAAPPFALSAAAVGRARPSPRAHVHPAVTVGAFVPGHLHLFHGLLYWVAQRLGSTAACLLLRFSTGGLATGTCRLTGISVWEALVLEIVMTFWLVYTAYATAVDPK

SEQ ID NO: 29099 - DNA, 560 bp, Panicum virgatum
  misc_feature: Ceres CLONE 1888961
  misc_feature: Encodes the peptide sequence at SEQ ID NO. 29100
accaacagtacaagaagcacaagaaagtcacttctatagccatcaccaacgacttcttcgccatcatcgtcacctaactcagaccctagctagcgactgaagaagaagatgagctcctccccagcggaaccagctgtgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccaccccaaccgtgtccggatcttcgtcaacaccgtcgccgagacgccccatgtgggctagcttagctgctcatagctgttgctcagagcatcatgctgtgtgccaaataaagccatcttcagtatgaataatggatgtgtgttttttccctataaatcaaataaataagcaagggatgtgcccccagcatgtccctttcgtctaaataatgccatattatgtgtaaagcatcgatcgtatcctgtcctggcatgaaaaagatgaatcagctatatcagcggacc

SEQ ID NO: 29100 - protein, 75 aa, Panicum virgatum
  misc_feature: Ceres CLONE 1888961
  misc_feature (16)..(75): Pfam Name: potato_inhibit Pfam Description: Potato inhibitor I family
MSSSPAEPAVCGGGGKTSWPEVVGMSIEEAKKVILKDKPDADIQVLPVGTPVTKDFHPNRVRIFVNTVAETPHVG

SEQ ID NO: 29101 - DNA, 2760 bp, Panicum virgatum
  misc_feature: Ceres CLONE 1888967
  misc_feature: Encodes the peptide sequence at SEQ ID NO. 29102
gagacaagacgagaggaggagggcggagtcttcttcttcctccccaaattttcaaatcaaaagaaataaaatatcggggggcgaaaccctaaccctagcggagaggagagaagtggagaggagccgccgcgatggcggaggaggcggaggggatggaccggttcgacatggaaggggacttcgagggcgggcggttcggccgcgacggggagttctactaccggagccggagggagcgggcgccgcagacccgcgatgacgcgatatacggggtgttcgcggagggcgactccgactacgactcggaggacgacgaggggtcccgccgccgcggccgccggaagcgccgcagggacggcggcggggagccggacctcaccaagcccgtccagttcgtctccaccggcaagttcatgcccacccaggagccggagcccgagcccgaccagaggccggggctcgggcgcgcccccgcggctgctgctgccaaggaggaggaggcggaggaggagcaggatgacgagggggacaccgagatgctgccgacgatgttcggcaggatcagggatggcgcccgcgcgaggcgggaggagaaggagcgggagcgcgagaaggcagcgcgccgccgccaggcagccggggtgggggcggtggagccggcagcggcccttgggagcctggaggctaattccaaggtggccaagatgatggccatgatggggtacaagaaaggaatgggccttggaaagaatgagcaggggaggacagcgccggtggagaccactttgcgacccaagaacgctggcctggggagtgtggagggtttcaaggaacccaagcccatgactgctaaggagaacttgccggccccggctcctccgccaacatcagggaagaaggagaagcgttggtccaagaaggctagcacaaagaaagctccagtcttgacgaagaatgagctcctggccatgcatgccgagcagcaacaggaggaggagcctgcagttgtccagaaggtgattgacatgcgagggccccaggcacgggtgctgacggacttgaagggtctcaatgaagaacaagagatggaggcgaatgatgtgccaatgccggagctgcagtataatgtgcgcctgcttgttgatgaggctagggctgatgttctgaggttggatgggcagctgcaaagggagcgggagaaggtagctagcttggtgcgggagaaggaaaaggtggccaagcaggaggcattgcagaaacgccagctgcaggtgatggagagaattgcagagacactggagcaggtccgggtggatgatacagctggcatgctcactctggatgggttgcttcagacattccatggcttgaaggtgcagtttgaggaggagtttaagatgtgcagcattgcatggattgcttgcagatatgctcatccgctgctaatccggatcttccagggatggcagcccctgcaggatccgaagtttgggttagatgtcatgaaaaagtggaaggacctgctgcagggggaccaaccatatgacttatcagatggttctgcatcaatgacaccatatgtgcagcttgttagtgaagtcatcctgccggctgtgaggatatcaggaaccaattcatgggaggctagggaaccggaaccaatgctcaactttcttgagttatgggataataagaagttgcttcctcctgttttgcttcaatcaatactagagcatgtgataatgccaaagctctcaactgctgtggattcatgggaccctcgcagggagagtgtaccgatccatgtctgggtacacccatggttgccaatgctaagggaaaggatagagaccttgtgccattctattcgatacaagctgagcactgtcctccacgtgtggcaagcacatgatgcttcggcgtatgctgtgttgtccccgtggaaggatgtgtttgattcggcaagctgggaagacctgattgtgcggtatatcattcctaaactgagattggcactgcaagagtttcagatcaacccagcaaaccagaaacttgatcagttcaactgggtgatgttgtgggcatctgcaatcccagtacacatcatggtccatatgttggaggttgatttcttcagtaagtggcagcaggtcctataccattggttgtgctcgccaaatcctgatttcaatgagataatgaactggtataagggctggaagagccttttcccaccagagttacttgccaatgagcgcatacggatgcttctaaccgctggtcttgacatgatgaaccaagctgctgaaggactagaggtggtgcaacctggggctagggagaatgtgggctacttgagagcaactgagaagcgacaatttgatgcagcacagcaggcttaccatgctgcaccaggggcagccatggcggatttgagctttaaggaatctatccaggcctatgcaatggagcaagggctgctgtttatgcctagagttggcaagttctacaatggcatgccggtgtatgagtttggcaccgttagcatttgcatagactctgtgaagcgactattgtatgcgcaacttcaagagggaattgagagatggagtgctgtaactcttacacaattgatggaaatgaaccgaatgggaagatcacgctaatagatcacctaggcttggagttccagttcaatttttgttacctgttgtataaaactcataaatgatgtcaatgcattagcttttttgagctttc

SEQ ID NO: 29102 - protein, 844 aa, Panicum virgatum
  misc_feature: Ceres CLONE 1888967
  misc_feature (398)..(635): Pfam Name: TFP11 Pfam Description: Tuftelin interacting protein 11
  misc_feature (185)..(229): Pfam Name: G-patch Pfam Description: G-patch domain
MAEEAEGMDRFDMEGDFEGGRFGRDGEFYYRSRRERAPQTRDDAIYGVFAEGDSDYDSEDDEGSRRRGRRKRRRDGGGEPDLTKPVQFVSTGKFMPTQEPEPEPDQRPGLGRAPAAAAAKEEEAEEEQDDEGDTEMLPTMFGRIRDGARARREEKEREREKAARRRQAAGVGAVEPAAALGSLEANSKVAKMMAMMGYKKGMGLGKNEQGRTAPVETTLRPKNAGLGSVEGFKEPKPMTAKENLPAPAPPPTSGKKEKRWSKKASTKKAPVLTKNELLAMHAEQQQEEEPAVVQKVIDMRGPQARVLTDLKGLNEEQEMEANDVPMPELQYNVRLLVDEARADVLRLDGQLQREREKVASLVREKEKVAKQEALQKRQLQVMERIAETLEQVRVDDTAGMLTLDGLLQTFHGLKVQFEEEFKMCSIAWIACRYAHPLLIRIFQGWQPLQDPKFGLDVMKKWKDLLQGDQPYDLSDGSASMTPYVQLVSEVILPAVRISGTNSWEAREPEPMLNFLELWDNKKLLPPVLLQSILEHVIMPKLSTAVDSWDPRRESVPIHVWVHPWLPMLRERIETLCHSIRYKLSTVLHVWQAHDASAYAVLSPWKDVFDSASWEDLIVRYIIPKLRLALQEFQINPANQKLDQFNWVMLWASAIPVHIMVHMLEVDFFSKWQQVLYHWLCSPNPDFNEIMNWYKGWKSLFPPELLANERIRMLLTAGLDMMNQAAEGLEVVQPGARENVGYLRATEKRQFDAAQQAYHAAPGAAMADLSFKESIQAYAMEQGLLFMPRVGKFYNGMPVYEFGTVSICIDSVKRLLYAQLQEGIERWSAVTLTQLMEMNRMGRSR

SEQ ID NO: 29103 - DNA, 1487 bp, Panicum virgatum
  misc_feature: Ceres CLONE 1888972
  misc_feature: Encodes the peptide sequence at SEQ ID NO. 29104
attcatcaatgccacttcgcaccgccgcctcccgcgttcaaaattcgaaccgccctcccggtccccggcccataacggttcgccgtcctccccaacccccaccgctcgtctcgtcggcgtcggcgtcgtcgcaccacgcccacgccacgccccgactccgaacacctaattcgggctccagccgcctcgccgctcgcgcaacccccgctgtgttcctctctccgatggcggccgccgccacacccgctcgatccgccgcaacttcttcgcagccggtgcgcgtcgtgctgcgcgtgcgtccgttcctccagtccgagggcacccctgcggaggcgccctgcgtctgcctcctcggcagccaccccggcggtgaggtcaccgtccagctcaaggaccagcacacaagccggagcgagcattacaagctggatgcatttttcggtcaagaggacagcatcagccagctatttgatcgggaggtcagcacagtgatcccgggcatcttcaatggggtcaacgccacagtcttcgcctacggagcaacaggcagcggcaagacatacacgatgcagggcactgaggattttcccgggctcatacccttggcagcatcgacagtactgtcactttgcacaggcacgtggtgctctgtggagatatcttactatgaggtgtacatggagcggtgctatgacctgctggagcccaaagcaaaggagatcatggccttggatgacaaagatggtaacatgcggctgaagggcttgagctgggtccctgtgcgatctatggaggaattccaggagctctattccataggcgtgcagaggagaaaagttgcccacactggaatgaatgatgtttccagtcggagccatgctgtgctctctatcagggtcagcgctgatgttgtgaaagggaggattaacctgattgacttggcaggtagcgaggacaatagaaggactttcaatgaggggatccgccttcaagaaagtgctaagatcaaccagtcattgtttgcactgtccaatgtaatttcagctctaaacaagaatgagctccgcataccctatagagagagcaaattgacccgcatactacaagattctctaggaggcagtagtcgtgctgtgatgatagcctgcctgaatcctgcagaatatcaggagtcagtcaatacagtaagtctagccgctcgttcacgccacatggggaattttacaagttcagcaagcaaacaagaaacccccaaggtcaaggttgacatggaagcaaaattacgagcatggttggaatcaaaggggaaaacaaagagcatccaaagaatggatggtcttttctccccaattgctggcaagactccattttcggtgagccatatgaagcaaccagcatcttccagagtctcttgtagatctaaggcaatggatcaagatggtggtaaaatcaagaagattcttttcgatccagaagtccatgtaccc

SEQ ID NO: 29104 - protein, 420 aa, Panicum virgatum
  misc_feature: Ceres CLONE 1888972
  misc_feature (23)..(331): Pfam Name: Kinesin Pfam Description: Kinesin motor domain
MAAAATPARSAATSSQPVRVVLRVRPFLQSEGTPAEAPCVCLLGSHPGGEVTVQLKDQHTSRSEHYKLDAFFGQEDSISQLFDREVSTVIPGIFNGVNATVFAYGATGSGKTYTMQGTEDFPGLIPLAASTVLSLCTGTWCSVEISYYEVYMERCYDLLEPKAKEIMALDDKDGNMRLKGLSWVPVRSMEEFQELYSIGVQRRKVAHTGMNDVSSRSHAVLSIRVSADVVKGRINLIDLAGSEDNRRTFNEGIRLQESAKINQSLFALSNVISALNKNELRIPYRESKLTRILQDSLGGSSRAVMIACLNPAEYQESVNTVSLAARSRHMGNFTSSASKQETPKVKVDMEAKLRAWLESKGKTKSIQRMDGLFSPIAGKTPFSVSHMKQPASSRVSCRSKAMDQDGGKIKKILFDPEVHV

SEQ ID NO: 29105 - DNA, 657 bp, Panicum virgatum
  misc_feature: Ceres CLONE 1888972-R
cctgcgacccagcaaatatctgataatgtcatctgtgccatttcattggagccccaaactccaatagaaacatctaaaatcgagaagattcctagtgcaacaccactagataaattcaatgtgctagggtctaacataaaggaagcttttatccagcagtaccttgacttcttaaatgttgcaaacaaggaagagttacagcagttgaaaggaattggcatgaggagagcagaatatattcttgaattacgggaggaatcaccaacaccattcaaaactcttgcagatttggaaaacataggcctctcatcaaaacagatccaagacatccttagaaagacagcctctggaatcttcaaatgatggctaaaattgatgtcccaaagtaatggagtaacaacatggagtttttccttaaaaatgatcaccaaaatggatgttgtactgtaacttgtgctgccagtcaagttagttcagtcttgcgtttggtgactaggcgatgtcctgctgcttctctcatctagatcatgtaccttgcctttcagcgtgtatgtagaattgtagttgaacagctaatgataggagttgtggtgccactttacatggagcaatgagttgctcctctttgttgccgaatactatgagaacatgtctctc

SEQ ID NO: 29106 - DNA, 1429 bp, Panicum virgatum
  misc_feature: Ceres CLONE 1888995
  misc_feature: Encodes the peptide sequence at SEQ ID NO. 29107
atttgtcccagctccttgcaccagccaccagcatgcatagatagcatctcaagcccccaatcccaagaggctccccaagatgaatgctactacataggtagagagtgttcttgtggtgatcagctgacctagatagagtgccgatatgggagaggctgaggaagcaccagaaggcagcagccatggtgaggcattggagctcatcatgtccatggcatcctcttcactggcctgctctgtctcacagttcccagcgaagtggcaatccatcaaggacaagcttcaacagctctgctgcagcctaaattcattgtgctgcagcgtcggcgtcgtcgacggcaatggcgatgacgaggagcatcctgtgttgctcgagcttctgcagtcggcgtcagcaaccgtgaggagcatccaggctgttgcttctcaatgcagcgatgggtcatacaagggtggaaggctccgtctgaggagtgacctggacaacctgtgctgcaagcttgatgcacacatgaagcagctcaaggagatggcttcctccggggtgccgtcgccgtcgaaggccattgttaccgtaaggcccggcgccgatgccagcgcaggtgagaagacgttctacctcaaggatctcttctccaggatcaggattggtggcaccgtccagaggagccaggcattgggcaccattagagagctcttggcagaagatgaattgtgtgcaaaggttgtcgctctccacatcgacgacggcatcaccttcctcaccgggtttctcgagtcgacggacgcgtgcatccaagaagaggctgcaggtgctgtcgccattgttgcgagctccgagcgttacagaggaatgctggttaaggcaggggtgatcgcccccctcgtccagctgctggagaacacagacatggccagtgagctgggcaaggagagagctgctcaggcgctgagggagctgacggagaactcggacaacgtgtgggccgtctgcgcgcacggcggcctcaccactctgttgcacgcctgcgcagcagacgccggcggcagcagcaagctgatcagctcatcttttgcagtgctgaggaatctgagccgggtggaggaagtgaagatgttcatggtggagcaaggggtggtcacggagctggtgaagctctcccagaagaaggaagaggtccgcaagctcggcgccgtcgaattgctccatgccatggctctggatgatgccgatgtcagagaggaagccgtcagcatgggggtgatccagtcactccttcagttgatataccctgaccttccatactcatacaaggccagggaggtcgctcttgcagccatttggttcttctgcttttcttctgcaaactccatagatgacctcatcagctcagatgttcttggttggctgctcctccattctcaacaa

SEQ ID NO: 29107 - protein, 427 aa, Panicum virgatum
  misc_feature: Ceres CLONE 1888995
  misc_feature (231)..(274): Pfam Name: Arm Pfam Description: Armadillo/beta-catenin-like repeat
MGEAEEAPEGSSHGEALELIMSMASSSLACSVSQFPAKWQSIKDKLQQLCCSLNSLCCSVGVVDGNGDDEEHPVLLELLQSASATVRSIQAVASQCSDGSYKGGRLRLRSDLDNLCCKLDAHMKQLKEMASSGVPSPSKAIVTVRPGADASAGEKTFYLKDLFSRIRIGGTVQRSQALGTIRELLAEDELCAKVVALHIDDGITFLTGFLESTDACIQEEAAGAVAIVASSERYRGMLVKAGVIAPLVQLLENTDMASELGKERAAQALRELTENSDNVWAVCAHGGLTTLLHACAADAGGSSKLISSSFAVLRNLSRVEEVKMFMVEQGVVTELVKLSQKKEEVRKLGAVELLHAMALDDADVREEAVSMGVIQSLLQLIYPDLPYSYKAREVALAAIWFFCFSSANSIDDLISSDVLGWLLLHSQ

SEQ ID NO: 29108 - DNA, 357 bp, Panicum virgatum
  misc_feature: Ceres CLONE 1888995-R
agggtaagttgatagcaaaggacttgatcctctctgctattatgtccttgactgagaccaacagtggaaagaagaaaattgtgacatcagagcacttctgcagcctgaaagaactagcagattctggtgacttcaatgccaagaagatcgtcaggaaactatctactaacagactgcaaaccattttcagtaaaatatggagtgtttaagttatttctaacccttacttttcactaagatttagctatagtttgtcttgtccatagtttttgctttgcttgtaatctcaacatatccatcagtatgattcgtgtgtgatgtatattgcaacttcagttaaattcaagctttttttcc

SEQ ID NO: 29109 - DNA, 1940 bp, Panicum virgatum
  misc_feature: Ceres CLONE 1889028
  misc_feature: Encodes the peptide sequence at SEQ ID NO. 29110
taagaagtacatatcactgcgcggccatgaattatcgtattgacccacagcatgatgttttcatctggcctcgcatacatcgtcatcaagctgcttctacatgctcctcaccagtctgtacggaggtaaccatttgatgatcatgccttgatgggtgatagtcgattggccggctgtaacatagcacaaagcggaagagagggagaatcactcgttgaagcaggcttctacagtggtgaggtccgcgactcgtgtctctattctgtggcagttcaagctgtccggggtaatctgaatccgaacgcgagcaagcggaccaaatcgtcctctgttttctatcgcccgcaccgcatctggccgcctcgacgctcggcggcggcggcggcggcggcggcgatggggccggagatggaggcgatggcggcgtcgattggcgtgtcggtgcccgtgctccgcttcctgctctgcttcgcggccaccatcccgacgggcctcctgtggcgcgcggtgcccggcgccacggggcggcacctctacgcggggctcaccggcgccgcgctctcctacctctccttcggggccacgtccaacctcctcttcgtctcgcccatggcgctcggctacctcgccatgctcctctgccgccgccgcgcagggctcatcaccttcctcggcgccttcggcttcctcatcgcatgtcatgtgtactacatgagcggagatgcatggaaggaaggaggcattgacgcaactggtgctttaatggttttgacgctgaaagtcatttcgtgcgcaataaactacagtgatggcatcttgaaggaagagggtttacgtgagtctcagaaaaagtaccgattgattaagcttccttctcttattgaatattttggttactgcctctgctgtgggagtcactttgctggaccggtgtatgagatgaaagattatcttgattggactgaaaggaaaggaatatgggctagctcaactccttcaccattgttacctactttgcgtgctatagttcaggctggtatatgcatggggttatatttatacctgtcgcctaaatttccactctcgcggtttagtgagcccctttattatgaatggggtttctggcaccggctcttctaccagtacatgtcaggctttaccgctcgttggaaatattattttatatggtcaatttcagaagctgcaattattatatctggtctgggatttactggttggtcagcgtcttctcccccaaaagccaagtgggatcgttcaaaaaatgttgatgtattaggtgtcgaactagctggaagtgcagttcagttgccccttgtgtggaatattcaagtgagcagatggctacgatactacgtctatgaaaggctaattcagaaaggaaagaaacctggtttccttcagttgttgggtacacagacagtcagtgccatctggcatggactgtaccctgggtatatcatattctttgtccaatcagcattgatgataaatggttcacgagttatatacagatggcagcaagcagcgagcaattcagtcctccgcagtatcctggcttttctaaattttgcttatacattgttggtgcttaactactcgtgcattgggttccaggtactgagcttcaaggaaaccttggcatcctaccagagtgtatattatgttggcacgattgttcccattgtatgcctcctgctgggcaacgttatcaagccagcaaggaagccgaaggctcagaaggccgagtgagtaacatatactggaatgatcgttacacagaaagatggagaagcttcaacgacgataacgacagcctagttttcagtttatttattctctctttttgaacctaccaaatttagcacaaggatagtgtggtgaccgcagctcgcatatatttcagaactccgtcgcaattg

SEQ ID NO: 29110 - protein, 539 aa, Panicum virgatum
  misc_feature: Ceres CLONE 1889028
  misc_feature (185)..(499): Pfam Name: MBOAT Pfam Description: MBOAT family
MGDSRLAGCNIAQSGREGESLVEAGFYSGEVRDSCLYSVAVQAVRGNLNPNASKRTKSSSVFYRPHRIWPPRRSAAAAAAAAMGPEMEAMAASIGVSVPVLRFLLCFAATIPTGLLWRAVPGATGRHLYAGLTGAALSYLSFGATSNLLFVSPMALGYLAMLLCRRRAGLITFLGAFGFLIACHVYYMSGDAWKEGGIDATGALMVLTLKVISCAINYSDGILKEEGLRESQKKYRLIKLPSLIEYFGYCLCCGSHFAGPVYEMKDYLDWTERKGIWASSTPSPLLPTLRAIVQAGICMGLYLYLSPKFPLSRFSEPLYYEWGFWHRLFYQYMSGFTARWKYYFIWSISEAAIIISGLGFTGWSASSPPKAKWDRSKNVDVLGVELAGSAVQLPLVWNIQVSRWLRYYVYERLIQKGKKPGFLQLLGTQTVSAIWHGLYPGYIIFFVQSALMINGSRVIYRWQQAASNSVLRSILAFLNFAYTLLVLNYSCIGFQVLSFKETLASYQSVYYVGTIVPIVCLLLGNVIKPARKPKAQKAE

SEQ ID NO: 29111 - DNA, 423 bp, Panicum virgatum
  misc_feature: Ceres CLONE 1889033
  misc_feature: Encodes the peptide sequence at SEQ ID NO. 29112
gagttgtcacttctatagccatccccagcgacttctgcacccacatcgacacctatctcaaagcctaggtcgcgaccgagcacgaagatgagctcctcccccggggacccggctgggtccgacgtccgcagctacacctcctggtacggacggggtgcgcatgagcctggaggaggcccgagggtgatcctcgaacacaaccccgactcctacatccgggtggtgccggccggcaccccggtgaccatcgatttccaccccaaccgtgtccggatcttccgccccgccgccgcccagacgccgcgtgtgggctaccttacctgctcatacctgttgctcccaccctcctgctgcgagccctataccggcatctgcaggatgaataatggatgtgggttttttccctattgatcatctacataa

SEQ ID NO: 29112 - protein, 107 aa, Panicum virgatum
  misc_feature: Ceres CLONE 1889033
  misc_feature (16)..(75): Pfam Name: potato_inhibit Pfam Description: Potato inhibitor I family
MSSSPGDPAGSDVRSYTSWYGRGAHEPGGGPRVILEHNPDSYIRVVPAGTPVTIDFHPNRVRIFRPAAAQTPRVGYLTCSYLLLPPSCCEPYTGICRMNNGCGFFPY

SEQ ID NO: 29113 - DNA, 745 bp, Panicum virgatum
  misc_feature: Ceres CLONE 1889036
  misc_feature: Encodes the peptide sequence at SEQ ID NO. 29114
acttcctccattcgcgcttctcctctctctctctctctctctctctctctctctctcgctgcccgtctccactccctccgtcagatccctcgcccgggctaccatggcggaccagctcaccgacgaccagatcgccgagttcaaggaggccttcagcctcttcgacaaggacggcgacggctgcatcaccaccaaggaacttggaactgtgatgcgctcattggggcagaaccctaccgaggctgaactccaggacatgatcaatgaggttgatgcagatggcaacggaaccattgacttccctgagttcctcaacctgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagatgaggaggtggacgagatgatccgcgaagctgatgtggatggtgatggccagatcaactacgaggagttcgtgaaggtgatgatggccaagtgagatgtgctcttttgaagctagtttttctcctgatggtagtaactagtttagtgttgaaaactgactgcatttggttatcccttattccgatccgtgcgccaatgaacagatatgttgtttgttttcttccctgggatttcactgtatctgtaatttcttttggattcgtttgcgattgtattacatttatgt

SEQ ID NO: 29114 - protein, 149 aa, Panicum virgatum; identical to SEQ ID NO: 12456
  misc_feature: Ceres CLONE 1889036
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 29115 - DNA, 490 bp, Panicum virgatum
  misc_feature: Ceres CLONE 1889038
  misc_feature: Encodes the peptide sequence at SEQ ID NO. 29116
gtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggttgcggaggctacggtcgatgagggggcggaggaggttaccgcggaggctgatg

SEQ ID NO: 29116 - protein, 118 aa, Panicum virgatum
  misc_feature: Ceres CLONE 1889038
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGGCGGYGR

SEQ ID NO: 29117 - DNA, 1416 bp, Panicum virgatum
  misc_feature: Ceres CLONE 1889050
  misc_feature: Encodes the peptide sequence at SEQ ID NO. 29118
gatcgatacttccaagttccaaccacctccgtccctctcggcttcattgctgcttgtgcctagccgccttggacaacaaagaagcgtgggtgaattcctctgtgtttcgcagcttcctgaatcctgttcatcttggactagctggcgtcaaacaattctgcaccaatcttttgacgtcttcttccccggcctcgtgctgacacccgacgcagacgcagttcttcactcgctgcgccgtcaggccgtgaaccgggaaagctttgtgtctcaaaagcttgtttgcctctgatcggctttgatttcaggagtttgtgttgctttgcttgttcccgtctcgattttgagctctgtcgaggcgatggggaagacgaggcgagaagtcaccgtgagctgagccccgccgcctccttttgctccaagcgatggcctgcttccgcttccgctgctgcttaagcagcgaggtcaagaagggcaagggcgggaagaggcgggagcggcccgcggcgccggcgtccccggcgcccgcctcgttcccctccacgggagcgcgctccaacttgtccttctccacggcgtcgtcagccgtcggcacgagcagtcgtcgggctcggtgtcggtctcgtcggcgcggagcatcccggagctgtacgaggagaggggcgccaacagcctcctcgagttcaggttccgggagctccgggccgccaccagcgacttcagccggttgctgaagctcggcgagggcggcttcgggagcgtctacaagggcgtcatccggctccctggcgggcctgcgggtggcatggtggtcgccatcaagaagctcaatcccaaaggccatcagggccacaagcaatggttggcagaagttcattttctgggggttgttgagcacccaaatctcgtcaagctcatcgggtactgcgccgcgcaaagtgaaagaggccctcagaggctgctggtctatgagttcatggcgaacaagaccttggacgatcatctgttcaataaagcataccctgtcctcccttgggacatcaggttggaaatagcactcgatgcagctgagggactgatgtacctccacgagggattggaagttcaggtcatatatcgtgacttcaaagcttccaatgtcctgcttgatgaggagttcagaggaaaactttcagatttcggattggcaagggaagggccatctgctgatcatactcacgtctcgacagcggttatggggacgttgggctatgcagctccagattatattgagaccggccatctcactacaaagagtgacgtttggagctttggggtagttctatatgagatcctcactggacggcgctcaatggagaggaatcgtccctagaatgagcagaaacttcttgaatgggtgaggcagtatcctgtcgaaag

SEQ ID NO: 29118 - protein, 188 aa, Panicum virgatum
  misc_feature: Ceres CLONE 1889050
  misc_feature (1)..(188): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
  misc_feature: Functional homolog of the protein sequence given in SEQ ID NO 50776
  misc_feature: Useful for making plants with altered carbohydrate content
MVVAIKKLNPKGHQGHKQWLAEVHFLGVVEHPNLVKLIGYCAAQSERGPQRLLVYEFMANKTLDDHLFNKAYPVLPWDIRLEIALDAAEGLMYLHEGLEVQVIYRDFKASNVLLDEEFRGKLSDFGLAREGPSADHTHVSTAVMGTLGYAAPDYIETGHLTTKSDVWSFGVVLYEILTGRRSMERNRP

SEQ ID NO: 29119 - DNA, 591 bp, Panicum virgatum
  misc_feature: Ceres CLONE 1889050-R
aggctggaaggccattcctctaagcaggccgctagaaaggtcgccaagtgggccaatagtggtcttgcaaagcacagaagggaccgtccaacaatgagagaagtggtcaagagcctgaagcaagcaatgcagcacaaggagttagatggcgatgcaggggcttcaggtgagacttcaccacctgatgaggtatcggggaaaccaacaacagaggatgttgccgtggcatcagcaaggcggcggatgcttcatctggctgccctaggtgagaatgcaaacagcattgcgaaggcgagattcatgctcatgagggccgccgctcctccaactactacataatcttcagttgtgatcttttcttttgactctgtactttcttatgtggttatgaagataggctcgttggtgacgttttccctttgtcagtgtacatctattaaatgatcaaacattcttttttttttcttccgatcagtactttctataggttttctattgtaaagctttcttccccttagggattctctatgtttgactgcaactttttgttcctgtttctgttcatactcgacttcactttttgttcctgtc

SEQ ID NO: 29120 - DNA, 677 bp, Panicum virgatum
  misc_feature: Ceres CLONE 1889057
  misc_feature: Encodes the peptide sequence at SEQ ID NO. 29121
atccgccctctccagctccgagcctccagcagcaaggaagcgagcgagaatctcgagctctcgctcgcgacgaagccagccagacagcggcgagtcgggtagaagcgatcccatggcgcccaagaggtcaccgtcgccggccgggagcagcggcggcagcgccgtgtgcgcgccggcgccggcggaagagcagccgaggctccgcggggtgcggaggcggccgtggggccggtacgcggcggagatccgggaccccgcgcgcaaggcgcgcgtctggctcggcaccttcgacacgcccgaggaggcggcgcgcgcctacgacgccgccgcgcgcaggctccgcgggccgcgcgccgccaccaacttcccctccgcccaggaggccaaggcggtcgccgcagctgccccggcggcgagcgcgagcgggagcgccgtgctgtcggaggacgcgtcgtcgtcgtcatcgtgctcccgggactcgccgctggcggtgacgttggcggccgcggcgcccgcgtcgctggacctaggcctggcgctcccggccgtggccgccgcgcagccgtaccacatgtttctggacccggccgcgacgatggtggccgtggcgccggcgctgctgcagttcctgccgcccaagagtgaggaagaacagagctgctcagggtcgagctcct

SEQ ID NO: 29121 - protein, 188 aa, Panicum virgatum
  misc_feature: Ceres CLONE 1889057
  misc_feature (28)..(79): Pfam Name: AP2 Pfam Description: AP2 domain
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
MAPKRSPSPAGSSGGSAVCAPAPAEEQPRLRGVRRRPWGRYAAEIRDPARKARVWLGTFDTPEEAARAYDAAARRLRGPRAATNFPSAQEAKAVAAAAPAASASGSAVLSEDASSSSSCSRDSPLAVTLAAAAPASLDLGLALPAVAAAQPYHMFLDPAATMVAVAPALLQFLPPKSEEEQSCSGSSS

SEQ ID NO: 29122 - DNA, 716 bp, Panicum virgatum
  misc_feature: Ceres CLONE 1889096
  misc_feature: Encodes the peptide sequence at SEQ ID NO. 29123
atcctcgtccccgtttccttccctgcaaagcatcaggctttaatttttccgtctccaaaaatccatccctacctagctcgacccggccggccagggcggcccggctgcccctggcaatcctgaggctggccctggccgtcgccgggcgcgcggcggcccaggactacaacttcttctacctcgggctgcaggggcccgggtcctacggcaacaccaaccaaagctgctgctacccctcgtccggcaagccggcggccaacttcggcatccacggcctctggcccaaccgcaacaacggctcctacccgcaaaactgcaaccccaacccccccttcaacccctccaaggtgagcaacctgctaaccacccggcgcgccaagtggccaaccctggcgtgcccaaccaacaacgggctccgcttctggggccacaagtggaaaaaccacggcacctgccccgccaacttcttcaacaagcacggttacttccaggcggcgctccgcctccgcaaccagctcggcgttctcggcccgctcaccgccggcggcgttaaccccgacggcggctactacacgctggcccaaatcaagggcgccatccgcaagggcaccggcttcaagccctacgtcaagtgcaaccgcgacaaggccggcaacagccagctctaccagttctacttctgcgtcagcgccgccggcaacagcctcgtcaactgc

SEQ ID NO: 29123 - protein, 237 aa, Panicum virgatum
  misc_feature: Ceres CLONE 1889096
  misc_feature (55)..(237): Pfam Name: Ribonuclease_T2 Pfam Description: Ribonuclease T2 family
  misc_feature: SWISSPROT Homolog: EC 3.1.27.1 Ribonuclease T(2)
PRPRFLPCKASGFNFSVSKNPSLPSSTRPARAARLPLAILRLALAVAGRAAAQDYNFFYLGLQGPGSYGNTNQSCCYPSSGKPAANFGIHGLWPNRNNGSYPQNCNPNPPFNPSKVSNLLTTRRAKWPTLACPTNNGLRFWGHKWKNHGTCPANFFNKHGYFQAALRLRNQLGVLGPLTAGGVNPDGGYYTLAQIKGAIRKGTGFKPYVKCNRDKAGNSQLYQFYFCVSAAGNSLVN

SEQ ID NO: 29124 - DNA, 1313 bp, Panicum virgatum
  misc_feature: Ceres CLONE 1889114
  misc_feature: Encodes the peptide sequence at SEQ ID NO. 29125
aatctctctacagactactcactccatctccattccccatacacattcctcctccagtcctgactacaactcccccacctcttatctccctgcaccttgagctgagctccggctcccctccgcattgaccatcacccttcgtcgggtcggttcttgccgcgtccgatcctgatctgcaagcttcgcgtgctgtgatctgagagcgtccggggccatggggaccggggcggtggcggtggtggcgccggaccgggccaagcagcgccggggcggccacctatggaagaaggcgctgctccacttctcgctctgcttcgtcatgggcttcttcacggggttcgcgccctcctcctcctcgacctggaaggctgccacccaacacccgccgcaccgggccggggaccacctcgccgcctcccgcgtcgccgtcgacgcgcgcgtcaacctggtgccgtcgccgcccgacacggctggcgaggtggggctcggcggggccggcggcggggcgacggttgacgtgggcgacgacgacgacgaggccggcccgcggcggcttctgattgtggtcaccaccacgcggtcgggcgccggcgagcggcggcggcgcagggccgagctgctgcgcctggcgcacaccctgcggctcgtgcgcccgcccgtcgtgtgggtggtcgtggagccggtcgccgacgcccccgccacggccgaggtgctgcggggtaccggcgtgatgtacaggcacatcgcgttcaagcccgaggagaacttcaccacggccgccgccgaggcgcacgcgcagcggaacgccgcgctcgcccacgtcgagaagcaccgcctcgccggcgtcctccacttcgccgacgccgccggcgtctacgacaccggcttcttcgaccagatccgccagatcgagtgacacacttcaaatgcggtggcgtggcgatcggcgtgggcatgcagcatcacgtcgccgatggcttctccggcctgcacttcatcaactcgtgggcggacctctgccgcggcatcccgatcgccgtcatgccctacattgaccgctccctcctccgcgcgcgcgacccgccgaccccagtgtacccacacatcgagtaccagccggcgcccgccatgctgtccgagccgccgcaggcgcccctcacggccaagccggcgacgccgcccaccgctgtggccatcttcaggctcagccgcgccgaccttggccgcctccgctcgcagatccccgcgcgcgagggcgcgccgcggttcagcacgtacgcggtcctggcggcgcacgtgtggtggtgcgcgtc

SEQ ID NO: 29125 - protein, 233 aa, Panicum virgatum
  misc_feature: Ceres CLONE 1889114
  misc_feature: Functional homolog of the protein sequence given in SEQ ID NO 50949
  misc_feature: Useful for making plants with altered carbohydrate content
MGTGAVAVVAPDRAKQRRGGHLWKKALLHFSLCFVMGFFTGFAPSSSSTWKAATQHPPHRAGDHLAASRVAVDARVNLVPSPPDTAGEVGLGGAGGGATVDVGDDDDEAGPRRLLIVVTTTRSGAGERRRRRAELLRLAHTLRLVRPPVVWVVVEPVADAPATAEVLRGTGVMYRHIAFKPEENFTTAAAEAHAQRNAALAHVEKHRLAGVLHFADAAGVYDTGFFDQIRQIE

SEQ ID NO: 29126 - DNA, 687 bp, Panicum virgatum
  misc_feature: Ceres CLONE 1889114-R
  misc_feature: Encodes the peptide sequence at SEQ ID NO. 29127
tcactgctacaccgctgccggacgccggcacggtgacggccggggtggcggagggcgcggccgtgatccaggcggcgctggaccggatggacgacgggtactgccggtcggcgctggactacctggagctgcagccggacctgtcggcgctggtccgcggcgcgcacacgttccggtgccccaacctggggctcactagctgggtgcggctgcccatccacgacgcggacttcgggtgggggcggcccgtgttcatgggccccggcggcatcgcgtacgaggggcttgcgttcgtgctccccagctccaaccgcgacggcagcctgtccgtggccatctcgctgcaggccgagcacatggagaagttccggaagttcatctacgacttctgatcgcctcgacacccaagtcatcggcgagcgcaggcgcggtagaagcaagcagagaagtgctaggctgatgcacagcacaggacagggagggtgatcttactaggttgcagcaagattctttgattgcacacatagttcctgcacacttaatttttttccccgttcctgcctgccccctttcgggcgggatatatacttgtgcgtatgattcacgggcctgaacggcctgaacaaattgtaatatgaacaatttaatccgttctgagtgatacaggttaataaggtcaattgattt

SEQ ID NO: 29127 - protein, 129 aa, Panicum virgatum
  misc_feature: Ceres CLONE 1889114-R
  misc_feature: SWISSPROT Homolog: EC 2.3.1.144 Anthranilate N-benzoyltransferase
  misc_feature: Functional homolog of the protein sequence given in SEQ ID NO 50937
  misc_feature: Useful for making plants with altered cell wall content and/or composition
  misc_feature: Useful for making plants with altered lignin content
TATPLPDAGTVTAGVAEGAAVIQAALDRMDDGYCRSALDYLELQPDLSALVRGAHTFRCPNLGLTSWVRLPIHDADFGWGRPVFMGPGGIAYEGLAFVLPSSNRDGSLSVAISLQAEHMEKFRKFIYDF

SEQ ID NO: 29128 - DNA, 681 bp, Panicum virgatum
  misc_feature: Ceres CLONE 1889115
  misc_feature: Encodes the peptide sequence at SEQ ID NO. 29129
acgctcgctcgaacacgagcactgcaccctctcatctgccggtgctagctcctcctagctttctcccccacttcagccggtagcctcttcttgagagaagctagcaggaagagggatcgagcaagatgatgagcggcaaggctctccttgtcgccgtgctcttggtgggcgtcgcctcccggtgctccggcagcaggggcctgcagggggatcacatcgctgagcagaagtacggtggcggtggctacggtggcggaggcggcggatacggcggtggcggcggcggcgaatacggaggcggaggtggtggcggtgggtacggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctaccagaagtacgcctacaccacgcagcaggtcaaggactgcatcgccgtcgcgctcacctccgaggccgccgccgccgcgcaggctgccatgttcaagaaggccaactacgcct

SEQ ID NO: 29129 - protein, 185 aa, Panicum virgatum
  misc_feature: Ceres CLONE 1889115
  misc_feature (1)..(78): Pfam Name: GRP Pfam Description: Glycine rich protein family
MMSGKALLVAVLLVGVASRCSGSRGLQGDHIAEQKYGGGGYGGGGGGYGGGGGGEYGGGGGGGGYGGGGYTPGYSGTGTCDYWKSHPDAIISCIGSLGSILGSFGDVCSAFFGSKLQTLQDALCNTRTDCYGDLLREGAAAYLNSVAYQKYAYTTQQVKDCIAVALTSEAAAAAQAAMFKKANYA

SEQ ID NO: 29130 - DNA, 354 bp, Panicum virgatum
  misc_feature: Ceres CLONE 1889118
  misc_feature: Encodes the peptide sequence at SEQ ID NO. 29131
gattcacaactcgcatctggagccatcggagttcatcagcactctctagtcacacagcacaacttcttctcctcctgctacagagctcaggcaaaagcttcgccgccacaacatcccaatggctcgcttcgccgtggtcgccgccatcgtcgccctcctcgccgtcaccgcggccgcgcaggccccggccgcgacgcccaccccggcgcccaggatggccccgctgccgcgctccccggccaccgcccgccgccgagggccccgccgcggccgcgccctccgcgctgacaccgaccagctccgtctccgcccccgccggcgcccccaccgccacacccaccggaaactccgccg

SEQ ID NO: 29131 - protein, 78 aa, Panicum virgatum
  misc_feature: Ceres CLONE 1889118
  misc_feature: Functional homolog of the protein sequence given in SEQ ID NO 51303
  misc_feature: Useful for making plants with altered carbohydrate content
MARFAVVAAIVALLAVTAAAQAPAATPTPAPRMAPLPRSPATARRRGPRRGRALRADTDQLRLRPRRRPHRHTHRKLR

SEQ ID NO: 29132 - DNA, 722 bp, Panicum virgatum
  misc_feature: Ceres CLONE 1889121
  misc_feature: Encodes the peptide sequence at SEQ ID NO. 29133
gcctcgtgcctcgcaggaccagaagagagagagggagaaggaggatcgaatcagccgctgaattgacctcgcgattcgagcgcagaaagcgaaagcatcgtctgatcagccagcggcgccgccggaggaggaatcaatcaagaaaggaggagatgagcggcggcggtggagtgctggcggcgcagtcgcaggagctgcagctgccgccggggttccggttccacccgacggacgaggagctggtgacgcactacctctgccggcggtgcgccgggctgcccatctccgcgcccatcatcgccgagatcgacctctacaagttcgacccctggcagcttccaaggatggcgctgtacggcgagaaggagtggtacttcttctccccgcgggaccgcaagtacccgaacgggtcgcggccgaaccgcgccgccggcacggggtactggaaggccaccggcgccgacaagccggtgggcacgcccaagcccctggccatcaagaaggcgctcgtcttctacgccggcaaggcccccaagggcgacaagaccaactggatcatgcacgagtaccgcctcgccgacgtcgaccgctccgcccgcaagaagagccacagcctcaggaggaagacccagacttcgatccagaggacgttgtgtagggtaccgtcctgcacccagccttgcctgtagattagggtcacccgcaggagataccgcatggcg

SEQ ID NO: 29133 - protein, 178 aa, Panicum virgatum
  misc_feature: Ceres CLONE 1889121
  misc_feature (17)..(142): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 853 in the 10/374,780 US patent application
  misc_feature: Functional homolog of the protein sequence given in SEQ ID NO 50324
  misc_feature: Useful for making plants with altered terpenoid content
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50838
  misc_feature: Useful for making plants with modulated water use efficiency
  misc_feature: Functional homolog of the protein sequence given in SEQ ID NO 50326
  misc_feature: Useful for making plants with modulated light quality response
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 854 in the 10/374,780 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 891 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 1012 in the 11/435,388 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 852 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Functional homolog of the protein sequence given in SEQ ID NO 50641
  misc_feature: Useful for making plants with altered carbohydrate content
  misc_feature: The sequence is a functional homolog of SEQ ID NO 344 in the 10/666,642 US patent application
  misc_feature: The sequence is a functional homolog of SEQ ID NO 1729 in the 11/479,226 US patent application
  misc_feature: Functional homolog of the protein sequence given in SEQ ID NO 51018
  misc_feature: Useful for biocontainment applications
  misc_feature: The sequence is a functional homolog of SEQ ID NO 310 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 854 in the 11/435,388 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 582 in the 10/666,642 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
MSGGGGVLAAQSQELQLPPGFRFHPTDEELVTHYLCRRCAGLPISAPIIAEIDLYKFDPWQLPRMALYGEKEWYFFSPRDRKYPNGSRPNRAAGTGYWKATGADKPVGTPKPLAIKKALVFYAGKAPKGDKTNWIMHEYRLADVDRSARKKSHSLRRKTQTSIQRTLCRVPSCTQPCL

SEQ ID NO: 29134 - DNA, 2568 bp, Panicum virgatum
  misc_feature: Ceres CLONE 1889138
  misc_feature: Encodes the peptide sequence at SEQ ID NO. 29135
caagtttgctttcgagatggtaaaaggtcgtgatgatcgagttggtcaggtcaagtcttcggtcgtgtagcaaatcagcggttagcgtgtgtgcttatctgtcgatgatacagagtagtagtaattcataaggagtattaatccatggactgaccaggtgtaagagtcagtcaaccagtcagtcagtcagtcagtcaacatattaatttctgtgtgtaaaaaaaacatattgatttttgtctctcgtgctggacggcgatcgacgcagacgtacctgccgagccagatgccggcggcgctcaagccctaccgcgacgacgagctccgcaacctccgcggcgacgaccagcagggcccctacgaggagcacgaccgcgtctaccgctacgacgtctacaacgacctcggcgagcccgaccgcggcaacccgcgccccgtcctcggcggctccgccgaccacccctacccgcgccgctgccgcaccggccgcaagcccaccagcaccgaccccaactcggagagccggctgtcgctggtggagcagatctacgtgccgcgcgacgagcgcttcggccacctcaagatgtcggacttcctggggtactcgatcaaggccatctcgcaggggatcgtgccggcggtgcgcacgtacgtggacaccacccctggcgagttcgactccttccaggacatcctcaacctctacgagggcggcatcaagctgcccaggatccaggcgctcgaggacatgcgcaggctcttcccgctccagctcgtcaaggacctcctccccgccggcggcgactacctcctcaagctccccatcccgcagatcatcaaagaggacaagaatgcgtggaggaccgacgaggagttcgcgcgggaggtgctcgccggcgtcaacccgatgatgatcacgcgcctcacggagttcccgcccaagagcgcgctcgatcccagcaagtacggcgaccagacgagcaccatcacggcggagcacatcgagaagggcctggagggcctcacggtgcagcaggcgctggacggcaaccggctcttcatcctggaccaccacgaccggttcatgccgttcctgatcgacgtcaacaacctggagggcaacttcatctacgccagccggacgctcttcttcctgcgcggcgacggcaggctggcgccgctcgccatcgagctcagcgagccatacattgacggcgccctgaccaaggccaagagcaaggtctacacgccggcgtccagcggcgtcgacgcctgggtgtggcagctcgccaaggcctacgtcgccgtcaacgactccggctggcaccagctcatcagccactggctgaacacgcacgcggtgatggagccgttcgtgatcgcgacgaaccggcagctgagcgtgacgcacccggtgcacaagctcctgcacccgcactaccgcgacacgatgaccatcaacgcgctggcgcggcagacgctcatcaacggcggcggcatcttcgagatgaccgtgttcccgggcaagtacgcgttggccatgtcctccgcggtgtacaggggctggaacttcaccgagcagggcctccccgccgacctcgtcaagcggggcgtggcggtggcggacccgtcgagccccaccaaggtgcggctgctgatcgaggactacccgtacgcgagcgacgggctggccgtctggcacgccatcgagcagtgggtgggcgagtacctggccatctactaccccgacgacgccacgctgcagggcgacgaggagctgcaggcgtggtggaaggaggtgcgcgaggtcgggcacggcgacctcaaggacgcgccctggtggccccggatgcgggccgtgccggagctcgccggcgcctgcaccaccatcatctggatcgcgtcggcgctgcacgcggccgtcaacttcgggcagtacccgtacgcggggtacctgccgaaccggccgacggtgagccggcggcggatgccggagcccggcaccgaggcgtacgcggagctggagcgcgacccggagctgggcttcatccgcaccatcacgagccagatccagaccatcatcggcatctcgctcatcgaggtgctctccaagcactcctccgacgaggtgtacctgggccagcgcgacaccccggcgtggacctccgacgcccgggcgctcgcggcgttccagcggttcagcgacgcgctggtggagatcgagggcaaggtggcgggcgccaaccgcgacccgcagttcaagaaccggaccgggcccgccgcgttcccctacacgctgctgtaccccaacacctccgaccgcacgggcgccgccgccgggatcaccgccaagggcatccccaacagcatctccatctgagcaccggcgtgcctgcagtctgctactagccgttgagcgttctcgaggccatgagagcgaggttggtgcttgaacaaggcacgccgctttcgtgtgtgactgtgtgtgacagtgtgagcgtcgtcgtgtcaatgccgcatgagagcttgtagagagatcggttaataatagtttttgtgtcggccggt

SEQ ID NO: 29135 - protein, 697 aa, Panicum virgatum
  misc_feature: Ceres CLONE 1889138
  misc_feature (2)..(675): Pfam Name: Lipoxygenase Pfam Description: Lipoxygenase
  misc_feature: SWISSPROT Homolog: EC 1.13.11.12 Lipoxygenase
  misc_feature: Functional homolog of the protein sequence given in SEQ ID NO 50887
  misc_feature: Useful for making plants with altered lignin content
MPAALKPYRDDELRNLRGDDQQGPYEEHDRVYRYDVYNDLGEPDRGNPRPVLGGSADHPYPRRCRTGRKPTSTDPNSESRLSLVEQIYVPRDERFGHLKMSDFLGYSIKAISQGIVPAVRTYVDTTPGEFDSFQDILNLYEGGIKLPRIQALEDMRRLFPLQLVKDLLPAGGDYLLKLPIPQIIKEDKNAWRTDEEFAREVLAGVNPMMITRLTEFPPKSALDPSKYGDQTSTITAEHIEKGLEGLTVQQALDGNRLFILDHHDRFMPFLIDVNNLEGNFIYASRTLFFLRGDGRLAPLAIELSEPYIDGALTKAKSKVYTPASSGVDAWVWQLAKAYVAVNDSGWHQLISHWLNTHAVMEPFVIATNRQLSVTHPVHKLLHPHYRDTMTINALARQTLINGGGIFEMTVFPGKYALAMSSAVYRGWNFTEQGLPADLVKRGVAVADPSSPTKVRLLIEDYPYASDGLAVWHAIEQWVGEYLAIYYPDDATLQGDEELQAWWKEVREVGHGDLKDAPWWPRMRAVPELAGACTTIIWIASALHAAVNFGQYPYAGYLPNRPTVSRRRMPEPGTEAYAELERDPELGFIRTITSQIQTIIGISLIEVLSKHSSDEVYLGQRDTPAWTSDARALAAFQRFSDALVEIEGKVAGANRDPQFKNRTGPAAFPYTLLYPNTSDRTGAAAGITAKGIPNSISI

SEQ ID NO: 29136 - DNA, 685 bp, Panicum virgatum
  misc_feature: Ceres CLONE 1889143
  misc_feature: Encodes the peptide sequence at SEQ ID NO. 29137
acaacaaacccaggtgtgcttcggcagtaaacattcggttcttggttagcctccattgccattgctctctgctcgatctctagcagactcggatccattggcaagcatggagcagctccctctcctgcttctcaagctcatcgcgaggcgcgacggcaatggcatgaggctgccgccgggcccgtggcagctgccggtcatcggcagcctccaccacctgctcggcagcccgctgccgcaccgcgccatggcccgcatcgcgcgccgcctcggcgcgccgccgttcatctacctccggctcggggaggtccccgtggtcgtggcgtcgtccccggccgccgcccgcgaggtcatgaagacgcacgacgcccgccgcctcgtggccgccgtcgccgccgccgcggccggcgagggcggcggcgccgtcaacgtcagcaagcggatcgccgtggtcgtcacggacacggccgtgcgcgccataatcggcgaccggttcgagaggcgggaggagttcctggcgaacctcgcggagggggtcaagatcacctccgggttcaacctctgcgacctgttcccgtcgtcgatgctcgtcaggcttgtcagcggcacggaacgccgagcgcgggaaactcaccgccggcacttcgagctcatggacctcgccatcaagcagcacgagcagcgg

SEQ ID NO: 29137 - protein, 192 aa, Panicum virgatum
  misc_feature: Ceres CLONE 1889143
  misc_feature: SWISSPROT Homolog: EC 1.14.13.68 4-hydroxyphenylacetaldehyde oxime monooxygenase
MEQLPLLLLKLIARRDGNGMRLPPGPWQLPVIGSLHHLLGSPLPHRAMARIARRLGAPPFIYLRLGEVPVVVASSPAAAREVMKTHDARRLVAAVAAAAAGEGGGAVNVSKRIAVVVTDTAVRAIIGDRFERREEFLANLAEGVKITSGFNLCDLFPSSMLVRLVSGTERRARETHRRHFELMDLAIKQHEQ

SEQ ID NO: 29138 - DNA, 1969 bp, Panicum virgatum
  misc_feature: Ceres CLONE 1889148
  misc_feature: Encodes the peptide sequence at SEQ ID NO. 29139
attctgctcacgccccgccccagcatcgccgattcgccgcggcagcgacatctcgccgggcgccggccatgggcgcgtcctcctccactgccgacacctccccagaggcgcacgagcggcgggagcaggagaccctcgcctccgccgcgctcgccctcccgctcctccgcgccgccttctcccgctccgccgccggcgcgctgccggacgcgctcgccccgccgcgcgcctccttccgcctgcccggatccctgccgccgcacttccacgacctcctcgcggcgctcggccccgccgtcgcctccctcttcttcgccggcggagccgcagcgggggcggaggggggcgccgggtgggtcccgttcctcaaggggttcaaccgctgctgcgcgcgcgtgtcggcctctcgctccctcgcgctgctcctccgggtgtacgccgccgcctgcgccgccgcgggggcaccctgcagcgtgcatttccagccggacgagggcggcggcgaggaggggaaggtcgcgggggagatcgcggtgttcctctggatgtgctgggtcatgacgtggagcggttcggcgccgaaggctgcggcgggtgacggaggggagaagtcggagcccgtcgctttgctcctccccgacgtcacgcacttggtggtgtcggctctcgtctccgcgggcgccgtcgctgatgacgagagtgtttggggatgggagatttccagtggcggcaagggggtgaaggtccaggagttcacgtcatgggtgctgtccacggcttcagggcttgggaactgcctctcgcggtatgtgcaggagaggttgcggtctttggcggctgattcgacggagcaggataactctgtttcaactgataacacgacatttgacacttctgatgtgtatctactaacacgtggaagggcatgggcaatcgctctcagcctaagaaacaaattgagcgaaaagttcttgtcaggttctgtaattggaatggacgcagaagaccttctttataggtcatcagttcatggaaaaggactaagccggttttggtctggtgttgagggctacaatggaccaatgctgattctactatcagcattctctaaaggtggtgtccagaatgttgattctgatcgaagatgggtgattggtgtattaaccgaggaggggtttgagagcaaagacacgttttacggtagctctgggttcctttgtgctgcacatccaatattccgcatgcttccgccatctggtaaggagaagaactttgtgtacagccatctacatcctcagataagggtttatgaggcaaatccaaagcctgttggcttagcatttggtggaacagttggaaacgagaggatctttctagatgaagacttctctaaagttgtagttcgccatcatgctgttgacaaaacttaccaacatggttcgctcatccccaatcagggttacttacctgttgaggcttcaatccttgatgttgaggtatggggacttggtggagaagcaacaagacggcaacaggatgtgtacaagaaaagggagaatattttctcagagcagcgaagaaaggttgatctcaaaacctttggcaactgggaagactctccagagaaaatgatgatggatatgatctctgatccaaacagggttcgccgggaagatcgttgaatttgatattgcggcaaaaatatcgtctgttaatgttcagtggctgcccgtacagatacggacatgagaacggagaatattggttgccctgtggaaatgtagagaagtcggtgcgcatatttgcttgcccatttgtgggccacacgtgacacgtcattgaggttgtgtagtagaaagaggcttgtacagaacatcatttccataaataaaagtctaagttccctctgttcccgtaaaagtaatttcgttttatgggaagcgagagaaatacatcatgattttgttcc

SEQ ID NO: 29139 - protein, 537 aa, Panicum virgatum
  misc_feature: Ceres CLONE 1889148
  misc_feature (314)..(481): Pfam Name: TLD Pfam Description: TLD
MGASSSTADTSPEAHERREQETLASAALALPLLRAAFSRSAAGALPDALAPPRASFRLPGSLPPHFHDLLAALGPAVASLFFAGGAAAGAEGGAGWVPFLKGFNRCCARVSASRSLALLLRVYAAACAAAGAPCSVHFQPDEGGGEEGKVAGEIAVFLWMCWVMTWSGSAPKAAAGDGGEKSEPVALLLPDVTHLVVSALVSAGAVADDESVWGWEISSGGKGVKVQEFTSWVLSTASGLGNCLSRYVQERLRSLAADSTEQDNSVSTDNTTFDTSDVYLLTRGRAWAIALSLRNKLSEKFLSGSVIGMDAEDLLYRSSVHGKGLSRFWSGVEGYNGPMLILLSAFSKGGVQNVDSDRRWVIGVLTEEGFESKDTFYGSSGFLCAAHPIFRMLPPSGKEKNFVYSHLHPQIRVYEANPKPVGLAFGGTVGNERIFLDEDFSKVVVRHHAVDKTYQHGSLIPNQGYLPVEASILDVEVWGLGGEATRRQQDVYKKRENIFSEQRRKVDLKTFGNWEDSPEKMMMDMISDPNRVRREDR

SEQ ID NO: 29140 - DNA, 662 bp, Panicum virgatum
  misc_feature: Ceres CLONE 1889150
  misc_feature: Encodes the peptide sequence at SEQ ID NO. 29141
aaatccaaagcaaagccaagacacgtttcatttcatcatttggctcactcgctcactcacctgtctgtccatcgctctagctcagctcccagtgatagctgcaagcgacagcacagccagcgccaccaagagctgggagaggaaggttgtagacgatggggaagctctggacgatcctcactcacctccactccctcgcagggccaacggtcatgctcctgtaccccctgtacgcgtcggtgcaggcgatggagagcccgtcgaagcttgacgacgagcagtggctagcctactggatcctctactccttcatcacgctcatggagatggtgctcgagtccctcatctactggatcccaatttggtacgagctgaagctgctgttcatcgcgtggctggtgctccccaacttcaggggcgcggccttcatctacgacaagttcgtcagggagcagctccggaagcacggcctcaccgccggcggcggcaaggtcaagaaggacgacaagtcgccctcgtcttctcccaaggacaaggagaagcccaagagcaagttccttgccttcgtcacccccaagaaggatcacgaagcttactgaggcatgccggacggtgcggtgacctcatcccggcggcttgtcgatgcagagcctcctgtagtg

SEQ ID NO: 29141 - protein, 147 aa, Panicum virgatum; identical to SEQ ID NO: 13037
  misc_feature: Ceres CLONE 1889150
  misc_feature (4)..(101): Pfam Name: TB2_DP1_HVA22 Pfam Description: TB2/DP1, HVA22 family

SEQ ID NO: 29142 - DNA, 914 bp, Panicum virgatum
  misc_feature: Ceres CLONE 1889162
  misc_feature: Encodes the peptide sequence at SEQ ID NO. 29143
atccagtggacacgacacgaacagcgcgcctcctctcccgctctccctccgcgctctcggcttccccttccctccctccaatgccgccatccatggcgctgcctctccccacctcctcctccgcctccgcctccaccacgctcccgccgttccgcccctgccctcccgcgccgctgcgcctcccctccgtccgcgctcgcgcccgcgcggtctccgccgggtacgcggcgtccttctacggcggctcggcggccgcgaccggcggcgccgaggacgaggaggtcggcgacgaggagggctccgcctcggggttcggctccgggctggggctcggcggcggcgggctcgggatgtcggccgcggaggcggcgctggcgctggargagcgggagatgccgccctgcccgccgggcctgcgccagtacgagaccatggtcgtgctgcggcccgacatgtccgaggaggagcgactcgcgctcatccagcgctacgaggagctgctcgtcgccggcggcgccatgtacgtggaggtcttcaaccggggcgtcatcccactggcatacagcatcaggaagaggaacagccggaccgggctgccgtccacctactacgacggcatttacctcctcgtcacctacttcaccaagcccgactccctgtccaccctgcagcagaggctcaacgccgacgatgacgtcatccggtcgaccagcttcaaggtccgcccgcggaaagccttctagacggcagacaggcctggcctcatggggctctagatttggtttcttctggaatgaaaagtttcaggttttgttcatatcatacaagaattctgcagtattgcgagtagatgtatgcctcatttgccatggttgagagggagatggttatcctttacagcgcctatgttctag

SEQ ID NO: 29143 - protein, 216 aa, Panicum virgatum
  misc_feature: Ceres CLONE 1889162
  misc_feature (109)..(210): Pfam Name: Ribosomal_S6 Pfam Description: Ribosomal protein S6
MALPLPTSSSASASTTLPPFRPCPPAPLRLPSVRARARAVSAGYAASFYGGSAAATGGAEDEEVGDEEGSASGFGSGLGLGGGGLGMSAAEAALALEEREMPPCPPGLRQYETMVVLRPDMSEEERLALIQRYEELLVAGGAMYVEVFNRGVIPLAYSIRKRNSRTGLPSTYYDGIYLLVTYFTKPDSLSTLQQRLNADDDVIRSTSFKVRPRKAF

SEQ ID NO: 29144 - DNA, 621 bp, Panicum virgatum
  misc_feature: Ceres CLONE 1889169
  misc_feature: Encodes the peptide sequence at SEQ ID NO. 29145
gcagcccaggctactacgctttgcatgcgtcgagagggcacccagagaagctgccactgccagcactcgagcagcgagcgagagcgagagctatcggcgatggggagcgtgccggaggaggtcgccctgggcttcggcggcctggtgggggacctgagggaggtgtacgagagcgacaggacccggggtctggagtggcgccgctcgcagctccggggcctcgtcaggctgctcgaggacaaggaggagaacatcttcgacgcgctccgcgaggacctcggcaagcaccgcgccgagtccttccgagacgaggttggggttctgaaggagtcggtcgtcgacaagctgcggaacctcaagaactgggcggcacccgagaaggctcacacgccgctggttgccttcccggcgaccgcgctgctggtgccggagccgctcggggtcgtgctcatcttctcctgctggaacctcccaataggtgagaacgagaccgatagatctttgctccactctattaggcagaggcgtttgcgatgaacataggaccgacccaacggtccttaaacttacgagggtgtgtcatttaccccgtcaactctgaaaatgcatttctagatccgc

SEQ ID NO: 29145 - protein, 145 aa, Panicum virgatum
  misc_feature: Ceres CLONE 1889169
  misc_feature: SWISSPROT Homolog: EC 1.2.1.3 Aldehyde dehydrogenase (NAD(+))
MGSVPEEVALGFGGLVGDLREVYESDRTRGLEWRRSQLRGLVRLLEDKEENIFDALREDLGKHRAESFRDEVGVLKESVVDKLRNLKNWAAPEKAHTPLVAFPATALLVPEPLGVVLIFSCWNLPIGENETDRSLLHSIRQRRLR

SEQ ID NO: 29146 - DNA, 651 bp, Panicum virgatum
  misc_feature: Ceres CLONE 1889199
  misc_feature: Encodes the peptide sequence at SEQ ID NO. 29147
aactagtctccacctgacaggctccctccctctccctccccgagcgaccccgggaggcggagatccctaggtccggtggccaagatggcggccactctggccctcgcggttgttcttgccgtcgcttcgctccaggctgaggcggtgaggctggacgtgccgcagtcggggaccaagtgcgtgtcggaggagatccaatccaacgtcgtcgtgctctccgactactccatcatgtacgagtcccactcctactcccaccccaccatcgccgtcaaggttacttcaccattcgggaacgccttacatcacaatgagaatgctacagttggtcaatttgcattcacaactgctgaagctggaaactaccttgcatgcttctggatagatagtgcagagaaaggatcaggcgtttctgtgaatcttgactggaagattgggtttgcaacaaaggactgggatgctattgctaagaaagaaaaaattgagggtgtagagctagagcttcggaaacttgaagtcgcagtacaagctattcatcagaatttgatctacctcaaagcaagggaggcagatatgcgaactgtgagtgagaaaacaaacgcaagggttgcctggttcagtattctgtcactaggtgtctgcattgcagta

SEQ ID NO: 29147 - protein, 188 aa, Panicum virgatum
  misc_feature: Ceres CLONE 1889199
  misc_feature (54)..(117): Pfam Name: EMP24_GP25L Pfam Description: emp24/gp25L/p24 family/GOLD
  misc_feature: Functional homolog of the protein sequence given in SEQ ID NO 51304
  misc_feature: Useful for making plants with altered carbohydrate content
  misc_feature: Functional homolog of the protein sequence given in SEQ ID NO 50963
  misc_feature: Useful for making plants with altered cell wall content and/or composition
MAATLALAVVLAVASLQAEAVRLDVPQSGTKCVSEEIQSNVVVLSDYSIMYESHSYSHPTIAVKVTSPFGNALHHNENATVGQFAFTTAEAGNYLACFWIDSAEKGSGVSVNLDWKIGFATKDWDAIAKKEKIEGVELELRKLEVAVQAIHQNLIYLKAREADMRTVSEKTNARVAWFSILSLGVCIA

SEQ ID NO: 29148 - DNA, 687 bp, Panicum virgatum
  misc_feature: Ceres CLONE 1889230
  misc_feature: Encodes the peptide sequence at SEQ ID NO. 29149
acaagcccatagatatcagcaaccaagcaatcagcagttctcaccaccaaatccacgagctcgagaggcatctgtctcctctgctctcgcgttagcgaagccagcacccagcagcagagaagcataatggcggcggcaagagccggagcgttggccgtggcgtgcctcgtggccgccatggcggcggcggcgctgctgctggcctcgccggcgtcggcgcagtccgggtgcacgaccacgctgatcagcctgtacccgtgcctgaactacatcagcggcaacgtgtcgacgccgccgtcgtcgtgctgctcgcagctcgccagcgtcgtgcagtccaacccgcagtgcctctgcgccgcgctcagcggcgactcctcgtccctcggcggcgtcaccatcgacaagacgcgcgcgctcgcgctcccacaggcctgcaacgtcaagaccccgccggcgagcaagtgcaaccctgccagcggtggcaacgctccgggcgcggcgaccacgccgtcgaccggcgtgccagcgaccgcagggaccagcggcggcggatcgaaggcgacgccgacggcgccgaacctgacatccggcggcgcgtcgatccggggggcggtgagcctggcgctcgcattcgcggctgtcgccgtctacgcggccgcctcggccgtgtgagcatcatctcggctc

SEQ ID NO: 29149 - protein, 181 aa, Panicum virgatum
  misc_feature: Ceres CLONE 1889230
  misc_feature (35)..(113): Pfam Name: Tryp_alpha_amyl Pfam Description: Protease inhibitor/seed storage/LTP family
MAAARAGALAVACLVAAMAAAALLLASPASAQSGCTTTLISLYPCLNYISGNVSTPPSSCCSQLASVVQSNPQCLCAALSGDSSSLGGVTIDKTRALALPQACNVKTPPASKCNPASGGNAPGAATTPSTGVPATAGTSGGGSKATPTAPNLTSGGASIRGAVSLALAFAAVAVYAAASAV

SEQ ID NO: 29150 - DNA, 725 bp, Panicum virgatum
  misc_feature: Ceres CLONE 1889251
  misc_feature: Encodes the peptide sequence at SEQ ID NO. 29151
agctccagaaacaactaaccgcgaagcaacaagtcgaaggcggcggcggcggcggcggcaatggggagcgacacggagacggagaagaagaagaccccgctggcgctagcacccatcgcgaagcccctcgcaggcaagaagctctgcaagcggaccctaaagctcgtgcgccgagcctccgaggccaaatgcctgaagcggggagtcaaggaggtggtcaagagcatccgccgtgggaacaaagggctttgtgtgatcgctggaaatatttctcctattgatgtgattacacatgttccaatactttgtgaggaagctaatgctccttacatatatgttccgtcgaaagaggaccttgcgaccgcaggaaccactaagaggccaacttgttgcgtcttggttctgaccaaaccaaccaagggggagctcagtgaagaggtgaaggagaagctgaagtcagactatgaccaggttgtgacggaagtcgctgaggctacatctgcaatgttctgagaacaattccaggaccacagtatctgagaatcaggcaacatatttgcatagtatgtaacatcctgacaagcctgcctttcttgtgaactgcaccggtgtgttatcaagggtacagctggagagttgatcatctatgttatggactacccttgtggatagtacaattattatataaattagccaattataatgatttggtgagcagattgttt

SEQ ID NO: 29151 - protein, 150 aa, Panicum virgatum
  misc_feature: Ceres CLONE 1889251
  misc_feature (30)..(124): Pfam Name: Ribosomal_L7Ae Pfam Description: Ribosomal protein L7Ae/L30e/S12e/Gadd45 family
MGSDTETEKKKTPLALAPIAKPLAGKKLCKRTLKLVRRASEAKCLKRGVKEVVKSIRRGNKGLCVIAGNISPIDVITHVPILCEEANAPYIYVPSKEDLATAGTTKRPTCCVLVLTKPTKGELSEEVKEKLKSDYDQVVTEVAEATSAMF

SEQ ID NO: 29152 - DNA, 691 bp, Panicum virgatum
  misc_feature: Ceres CLONE 1889258
  misc_feature: Encodes the peptide sequence at SEQ ID NO. 29153
gagtcccatccgatctgggtctggccgtcttggcgagcagactcgacaggtggaagaacccccacgcccggagcggaggggaggagaaggaaaggacgagatgacgatccggttcgtgctgttcgtgaacaagcagggccagacgcgggtggcgcagtactacgagcacctctccctcgacgagcgccgcgccctcgagggcgagatcgtccgcaagtgcctcgcccgcacagaccagcagtgctcgttcgtggagcaccggaactacaaggtcgtgtacaggcgctacgcctctctcttcttcctcgtcggcgtcgacaacaatgagaatgagttagctatccttgaattcatacatcttttggtggagactatggatcgccactttggcaatgtgtgcgagcttgacatcatgttccacctggagaaggtgcactttatgctggaagagatggtgatgaatggttgcattgtggagacaagtaaacagaacatcttggcaccgatccagcttatggagaaatcttcttaaagtattcagtctgtctggttttccatcctctggttagcactttgcacatccccttccctagattttccctttgtatctggaagtgtcaacaatctctgtaagcatggattgtgaattgaactgattgcaaactatcagattttttatgatcctctttgc

SEQ ID NO: 29153 - protein, 143 aa, Panicum virgatum
  misc_feature: Ceres CLONE 1889258
  misc_feature (2)..(143): Pfam Name: Clat_adaptor_s Pfam Description: Clathrin adaptor complex small chain
  misc_feature: Functional homolog of the protein sequence given in SEQ ID NO 51305
  misc_feature: Useful for making plants with modulated oxidative stress sensitivity
MTIRFVLFVNKQGQTRVAQYYEHLSLDERRALEGEIVRKCLARTDQQCSFVEHRNYKVVYRRYASLFFLVGVDNNENELAILEFIHLLVETMDRHFGNVCELDIMFHLEKVHFMLEEMVMNGCIVETSKQNILAPIQLMEKSS

SEQ ID NO: 29154 - DNA, 652 bp, Panicum virgatum
  misc_feature: Ceres CLONE 1889298
  misc_feature: Encodes the peptide sequence at SEQ ID NO. 29155
gaaagcaaaccagtgctccaaccaaccacgaccgaaccgacagaagagtaggaggggcgtcaccagagaactgcgaggaagcatggcggccggcggcggcgtggtgaaacacatcctgctggtgcgcttcaaggaggaggtgacgccggagcgcctggaccagctcatccggggctacgcggcgctcgtcgacgccgtcccctccatgaaggccttccactggggaactgatgtgagcatcgaaaacatgcatcaagggttcacccatgtgtttgagtccacatttgaaagcacagaaggagtgaaggagtacatcgagcacccagcgcatgttgaattcgcaaatgtattcttgcctctattagaaaaggtcgtcataatcgactacaaaccgacttctgtcaattgaatacgaagaacctggggcacttttcctcagttctcacggccaataattgttcctactgtttgtaggagaatttcattttcagttatattatgtaagctttgggctgaataaattctgatgctaggtttcctttttgagttctctgtaactgcagttcaagtaactctgcaccttttttgttgctatcagaattgtgttcccaaagtctgctgttctgcttttcaaaaaaaaagtctgctctcc

SEQ ID NO: 29155 - protein, 108 aa, Panicum virgatum
  misc_feature: Ceres CLONE 1889298
  misc_feature (8)..(104): Pfam Name: Dabb Pfam Description: Stress responsive A/B Barrel Domain
  misc_feature: The sequence is a functional homolog of SEQ ID NO 2 in US patent 7253341
MAAGGGVVKHILLVRFKEEVTPERLDQLIRGYAALVDAVPSMKAFHWGTDVSIENMHQGFTHVFESTFESTEGVKEYIEHPAHVEFANVFLPLLEKVVIIDYKPTSVN

SEQ ID NO: 29156 - DNA, 685 bp, Panicum virgatum
  misc_feature: Ceres CLONE 1889309
  misc_feature: Encodes the peptide sequence at SEQ ID NO. 29157
atagcatcgctgctgttcccgcttatctccgtgtcggcccttcttgcagctgcagccatggctgctcccgtcgccgcagccgccggaagatcggccgtcctcgcctactcccctgcgctacggttacaggtcccaacttactggtgcacaacttggatcttgattcggagaagctgtaggcctgcctgtagctttgcttttctgtcactgtagggaatggatgcagtgtcgtttcgagcatcagcatctttccccaggcaaagagcaagctttccatcaattcgggtgcagcggattccaaagcgctttcaagtgtcatgctcggctaaacaagaaactattgagaaggtttgtgaaatagtgaagggtcagttagctctacccgaagacagcacagtaacaggagagacaaagtttgtggacattggagctgattcacttgatactgtcgaaattgtgatggggcttgaggaggcattccaaatcagcgtggatgaatcaagcgctcaggagatccagacggtgggtgatgctgcggctctcatcgacaagcttatcgcagagaaggatgcttgaaaggactggagtcatggagtttcctcaatcaatagttttgcaggcacctccgctgctctctgtatggtggcggccatgcttccttgcattgcaattagttagaactctc

SEQ ID NO: 29157 - protein, 119 aa, Panicum virgatum
  misc_feature: Ceres CLONE 1889309
  misc_feature (43)..(110): Pfam Name: PP-binding Pfam Description: Phosphopantetheine attachment site
MDAVSFRASASFPRQRASFPSIRVQRIPKRFQVSCSAKQETIEKVCEIVKGQLALPEDSTVTGETKFVDIGADSLDTVEIVMGLEEAFQISVDESSAQEIQTVGDAAALIDKLIAEKDA

SEQ ID NO: 29158 - DNA, 673 bp, Panicum virgatum
  misc_feature: Ceres CLONE 1889353
  misc_feature: Encodes the peptide sequence at SEQ ID NO. 29159
agcaacgaagtactcgagatagattcagagagtgcagggcagttgattccaggccaagaatcattccactttgcttgctgacagcctactacctagtaggatccgtggatccatggaggtggccggaggagctgtcggcgcgccgtccccgccgcggcgcgtggtggtggcggtggacgagagcgaggagagcatgcacgcgctctcctggtgcctctccaacgtcgtctccgccgccagggccgccgcggcgccgcccccggccgtggtgctcgtccacgcccgttcgccgcgccccttctactaccccgccgacatggtggtgatgggcagccacggctacggcttcctgcagagggcgctgcgggggagcgtcagcagccactgcgtgcagaactgcaagtgccccgtcgtcgtcgtcaagaggggcccgccggcgagcaccaggcggcgccgcggatcgatctaggcggctctagaggccgtagccgtaagcgcacacgagcacgactcgcctcgcctcggcgaaacgtgacggtgggcgcccgtgtacatacttcgcttttgttcggtgcctgtatctccctgagtataatgttttcagttcacacaaaatattgtaacgtgtcatgtaatggacgtgtgtacattctatatatatatagtcgtttcg

SEQ ID NO: 29159 - protein, 118 aa, Panicum virgatum
  misc_feature: Ceres CLONE 1889353
  misc_feature (14)..(104): Pfam Name: Usp Pfam Description: Universal stress protein family
MEVAGGAVGAPSPPRRVVVAVDESEESMHALSWCLSNVVSAARAAAAPPPAVVLVHARSPRPFYYPADMVVMGSHGYGFLQRALRGSVSSHCVQNCKCPVVVVKRGPPASTRRRRGSI

SEQ ID NO: 29160 - DNA, 655 bp, Panicum virgatum
  misc_feature: Ceres CLONE 1889359
  misc_feature: Encodes the peptide sequence at SEQ ID NO. 29161
atccaaacaaacacaaggcaggctgctgctgctgcttcttcctctgactcttgcttgcttgcctctcaactaatggaggcttccttgcttgtggctcccaaaccttccatggcctcgatcgtctctgcaagtgcaaggggtcccgccaggaggtgcctcgtcgtcgctgccgccaccaccaaggaacccggcacccgctcatcagaaactgtaatgatgcgagcacgcggcggcctgttggccaccgccgtcgccgtcgccgcagcgagcagcacgccagtgctcccgtgccatgcttgggtgctggcaggcgacctggacccggcgacggccaagacggtggccggcgtggcggggccggcgctgtcggcgctgggcttcctcttcatcctgcggatcgtcatgtcctggtacccgaggctccccgtgacggagttcccctacgtgctggcgtacgcgcccacggagcccttcctcgccgtcacccgaaagctcatcccgccgctcggcggcgtcgacgtcacacccgtcgtctggttcggcctcgtcagcttcctcaacgagatcctcgtcggcccgcagggcctgctcgtcctgctctcgcagcaacagcagctttgatccacatttttgtatatctaataaataaccaacg

SEQ ID NO: 29161 - protein, 182 aa, Panicum virgatum
  misc_feature: Ceres CLONE 1889359
  misc_feature (87)..(169): Pfam Name: YGGT Pfam Description: YGGT family
MEASLLVAPKPSMASIVSASARGPARRCLVVAAATTKEPGTRSSETVMMRARGGLLATAVAVAAASSTPVLPCHAWVLAGDLDPATAKTVAGVAGPALSALGFLFILRIVMSWYPRLPVTEFPYVLAYAPTEPFLAVTRKLIPPLGGVDVTPVVWFGLVSFLNEILVGPQGLLVLLSQQQQL

SEQ ID NO: 29162 - DNA, 610 bp, Panicum virgatum
  misc_feature: Ceres CLONE 1889368
  misc_feature: Encodes the peptide sequence at SEQ ID NO. 29163
ctctgttttttgttgttattagatagattcatttggccagtctgatctctgcagtgcgcggttaaccccccccccccccccctttttttttgaggattttttttccgcgtgtttgaataggattgggaaggagagcctcaaggcgggggatcacatctactcgtggaggtccgcctgggtctacgcgcatcacggaatatatgtgggtgatgataaggtgattcattttacaagaggaagggaccaggaggttggaacaggaactgtcattgatattcttcttgtgagttctgcacctaaacgaagcgacacgccatgtccggtatgcaccaacgaagacaatgacaccagcatggagacaaatgacgtggtatcctcttgcctcaactgcttcctggctgggggtgccctttaccgttttgattacgcagtcaacccagctctcttccttgccaaagcgcgaggaggaacgtgcacactcgctacctctgaccccgacgaagcagtggtccgccgtgccaaatacttgctgagtaatggtttcaggtgctacaacctattcaagagcaactgtgaggacttcgcaatatactgcaagactggcctcctt

SEQ ID NO: 29163 - protein, 85 aa, Panicum virgatum
  misc_feature: Ceres CLONE 1889368
  misc_feature (24)..(85): Pfam Name: NC Pfam Description: NC domain
  misc_feature: SWISSPROT Homolog: EC 2.3.1.135 Phosphatidylcholine--retinol O-acyltransferase
METNDVVSSCLNCFLAGGALYRFDYAVNPALFLAKARGGTCTLATSDPDEAVVRRAKYLLSNGFRCYNLFKSNCEDFAIYCKTGL

SEQ ID NO: 29164 - DNA, 660 bp, Panicum virgatum
  misc_feature: Ceres CLONE 1889397
  misc_feature: Encodes the peptide sequence at SEQ ID NO. 29165
aacaataggcgtcgcgagaggcacgtccaccgcccgagctcacctcaccggtgcaacattttccacacgcgccgtgcactttgtatatatataaaaggcggggagggaggcgggcgccatggagaggagcagcagcagcgggtggttcaagtggaggaggaggaaggcgcgggaggggcagcggggcgccggcggggaggaggaccatcaccacaaggtggtggtggacgggtcggagatccgggagctggtggaggaccgggaggctttcgggatgctcgtggacaccgcgttccggcagctcgacgccgacggggacggcaggctctccgtgcgggagctccgccccgccgtggccgacatcggcgccgcgctcggggtgcccgcggagggggcgtcgccaaacaccgaccacatctgctcggaggtacgtgctcgccggccgtgaattatgctttgcagccgtagcttgcttgctgtacttccggcgaccaagctaccatggtacgtagctgacaaagcgagatgatcattggcgtcttgaagcatcatgtggttaggcttagatcgggattaatgaatcacagcctcacagtcacaggcatgtgtattttcgtctcagacaatatatttgcatttaattttcacagctgcgacctt

SEQ ID NO: 29165 - protein, 109 aa, Panicum virgatum
  misc_feature: Ceres CLONE 1889397
  misc_feature (54)..(82): Pfam Name: efhand Pfam Description: EF hand
MERSSSSGWFKWRRRKAREGQRGAGGEEDHHHKVVVDGSEIRELVEDREAFGMLVDTAFRQLDADGDGRLSVRELRPAVADIGAALGVPAEGASPNTDHICSEVRARRP

SEQ ID NO: 29166 - DNA, 735 bp, Panicum virgatum
  misc_feature: Ceres CLONE 1889406
  misc_feature: Encodes the peptide sequence at SEQ ID NO. 29167
gcgttgcgtcagagaaagagattgaagaagaagccatagcaatggcggccgccgcagcagctgcagcgattcccgctgccgccatcagccgccccaagcaccaccgcgtctcgctgtcgctggctcccagtcccaggctgccttgcccttccctccgctcgggcttcctggggcgtgcgctggccaccgacgtgcagccggcggccgttgttgcgtccccgcgccgcggcgtgtcggtgcggatggcgtgggacgggccgctctcctcggtgcgcctcatcgtgcagggcaggaacgtcaaggtgtcgaagcactgccacctggtccgcgaggtggacgtccggctgtcggcccgcggcggcgacctgggcaggggccccaagacctcccgctgcgagatcacgctcttcagcaagcgccacggcgtcctccgcgccgaggaggacgccgactccacctacgccagcatcgacatggccgcctccatcatcaagcgcaagctccgcaagatcaaggagaaggagacggaggtgcagcgccacagcgctttcaaggacgccgacgactggggccttgccattattgccgacgacgagcaccaccaacaagaacaagacctgacccaggccgtgggcgccgaggacgaggacacggtgctcgccaaggtggtgcgcaccaaggtgttcgagatgccgccgctgggcgtggacgaggcgctgcagcagctccagaacg

SEQ ID NO: 29167 - protein, 231 aa, Panicum virgatum
  misc_feature: Ceres CLONE 1889406
  misc_feature (78)..(167): Pfam Name: Ribosomal_S30AE Pfam Description: Sigma 54 modulation protein / S30EA ribosomal protein
MAAAAAAAAIPAAAISRPKHHRVSLSLAPSPRLPCPSLRSGFLGRALATDVQPAAVVASPRRGVSVRMAWDGPLSSVRLIVQGRNVKVSKHCHLVREVDVRLSARGGDLGRGPKTSRCEITLFSKRHGVLRAEEDADSTYASIDMAASIIKRKLRKIKEKETEVQRHSAFKDADDWGLAIIADDEHHQQEQDLTQAVGAEDEDTVLAKVVRTKVFEMPPLGVDEALQQLQN

SEQ ID NO: 29168 - DNA, 710 bp, Panicum virgatum
  misc_feature: Ceres CLONE 1889425
  misc_feature: Encodes the peptide sequence at SEQ ID NO. 29169
atgctagaaaaaggttacacgagaaaaatcaaatcaggagacggagattcgagagagctccgcccggtagggaagggaagaggaggcgaaggggaggagcgaggaggtgccgaggcgggatgggggcggtcgagtccgtgccggagacctccatacacgaattcaccatcaaggtgcggcgacccccccccccctcccgaaatcaagttcctctttcggtgatcctgtttgcgttttaaaattttatgtcgctggttctggacgaacaaaaaaaattggggattttttttttgtcggagcaggattgcaacggcaaggaagtgagcctggagacctacaaggggaaggtcctcctcgttgtcaacgtcgcctccaaatgtgggttcacggagaccaattacacgcagctgacggagctttatcagaagtacagggacaaagactttgagatattagcattcccctgcaatcagttcttgcggcaagagccagggactgctgagcaggcaaaagactttgcttgcaccagatttaaagcagaatacccagtttttcagaaggtgcgtgtaaatggtccagatgctgcgccggtctacaagtttctgaaagcgagcaagcctggtttgtttgggtcaagaatcaaatggaattttactaagtttctcgtcgacaagaatgggaaggtcattgaaagatatgcaacttcgact

SEQ ID NO: 29169 - protein, 154 aa, Panicum virgatum
  misc_feature: Ceres CLONE 1889425
  misc_feature (13)..(121): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
  misc_feature: Functional homolog of the protein sequence given in SEQ ID NO 50171
  misc_feature: Useful for making plants with modulated nitrogen use efficiency
MSLVLDEQKKLGIFFLSEQDCNGKEVSLETYKGKVLLVVNVASKCGFTETNYTQLTELYQKYRDKDFEILAFPCNQFLRQEPGTAEQAKDFACTRFKAEYPVFQKVRVNGPDAAPVYKFLKASKPGLFGSRIKWNFTKFLVDKNGKVIERYATS

SEQ ID NO: 29170 - DNA, 563 bp, Panicum virgatum
  misc_feature: Ceres CLONE 1889429
  misc_feature: Encodes the peptide sequence at SEQ ID NO. 29171
aaagccaggccaggccagccagccaagccgcactccctccccgagtccaccactgccaccgcacgctccgcgacgcgatggccgcgctacgcctcgcctccttcaccctccgcccggccgccgccgcggcatccccctcctccggcgcggcgccgcggtccgcctccttcgcccgcgccgcgcgggggctcccctcgctccgcctggccccgccccgccgccgcggggacctcgccaggccccgcgccgcggccgacgccgcggaggagggctacgcgaccgcgctgaccgaggtggccgccgagaacggcaccctcgagcagaccgtgtccgacttggagaagctggacaagatcttcgccgacgaggccgtcgccgagttcttcgacaaccccaccgtgccgcgcgatgtgaagtcccagctcatcgacaagatcgccaagtcgtccgagctgcatccgcacgtcgacaacttcctcaacgtctgcgtcaacgacttccgcgcggggatcgtgcggcatatcgacacctacatcgagatcgactacaacgctctcaacggc

SEQ ID NO: 29171 - protein, 161 aa, Panicum virgatum
  misc_feature: Ceres CLONE 1889429
  misc_feature (62)..(160): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAAAASPSSGAAPRSASFARAARGLPSLRLAPPRRRGDLARPRAAADAAEEGYATALTEVAAENGTLEQTVSDLEKLDKIFADEAVAEFFDNPTVPRDVKSQLIDKIAKSSELHPHVDNFLNVCVNDFRAGIVRHIDTYIEIDYNALN

SEQ ID NO: 29172 - DNA, 463 bp, Panicum virgatum
  misc_feature: Ceres CLONE 1889466
  misc_feature: Encodes the peptide sequence at SEQ ID NO. 29173
gtttctgcctcctctctccagtctccattcgacttgctcccgccgccgccaacctacctccctcttgttacttctccaaagaaaaacaaccggacaaactctggatgcccgttcttaagcttggtgttgcggtgaaggctgatgggtcttcctcgcgctcccggaggtcaagtgacccgggtcagggtgaagttggtggacgaccaaagccgtctcatcgtgaggaatgtcaaggggcctgtccgtgacggtgacctcctcaccctcctcgagtctgagagggaagccaggaggctgcgctgacccaaatggtggttgcgccagttgttggccattcgtgttttaaacaatttatcatgatgacttgcatctccctttgcttagtgtactgctttcgtatcccgttattgaacaatgcttcgttgtcctttgagtatgctatggagaatgggcttaatcaatg

SEQ ID NO: 29173 - protein, 53 aa, Panicum virgatum
  misc_feature: Ceres CLONE 1889466
  misc_feature (1)..(53): Pfam Name: Ribosomal_S28e Pfam Description: Ribosomal protein S28e
MGLPRAPGGQVTRVRVKLVDDQSRLIVRNVKGPVRDGDLLTLLESEREARRLR

SEQ ID NO: 29174 - DNA, 856 bp, Panicum virgatum
  misc_feature: Ceres CLONE 1889482
  misc_feature: Encodes the peptide sequence at SEQ ID NO. 29175
agccagcaccaatccatgcatatccaagcagcaagaagaatagcaggacacgaccacttgatctgaggcacatcgtcagacatctatctctgctagctagctacctcaataagctcaccgccggccggcgatcatattcatatctatcgattagcaaccgcgaagaagcaggccgtaccgatcgaggatggttgtcgcgtcgtcgtcttgtgccagcagcagcagcagcgagctggggtccctgttcgccgcgttcgacaaggacggcgacgggcggatctcggcggcggagctgcggctgtgcatgaaggcgacgctgggcgaggacgtgtcggcggaggacgcggaggcgctggtggcctcggtggacgcggacggcgacgggctgctggacggggacgagttcgcgcgcctggtgcacgccgaggtcggggaggaggagcgccaccgggggctccgccaggcgttcggcatgtacgagatggagggccagggctgcatcacccccaccagcctcaagcggatgctcagcaggctcggcgcgcaccaggagatcgacgactgccgcgccatgatctgcaggttcgacctcgacggcgacggcgtgctcagcttcgacgagttcaagatcatgatgagcgcatgaaacacaagacgattattgtgcttgcggttcattattattggtgtaggatgttcatatacatagcatagtcccatcccatacatccatccattgattcattcattgattcattcattctttaatttggtatatatatattgttgataaatctggcagctgtgcgtgcatattcgtttattcagcagaaataattgaattgttcgttacttg

SEQ ID NO: 29175 - protein, 152 aa, Panicum virgatum
  misc_feature: Ceres CLONE 1889482
  misc_feature (15)..(43): Pfam Name: efhand Pfam Description: EF hand
  misc_feature (125)..(152): Pfam Name: efhand Pfam Description: EF hand
  misc_feature: SWISSPROT Homolog: EC 2.7.11.1 Non-specific serine/threonine protein kinase
MVVASSSCASSSSSELGSLFAAFDKDGDGRISAAELRLCMKATLGEDVSAEDAEALVASVDADGDGLLDGDEFARLVHAEVGEEERHRGLRQAFGMYEMEGQGCITPTSLKRMLSRLGAHQEIDDCRAMICRFDLDGDGVLSFDEFKIMMSA

SEQ ID NO: 29176 - DNA, 670 bp, Panicum virgatum
  misc_feature: Ceres CLONE 1889562
  misc_feature: Encodes the peptide sequence at SEQ ID NO. 29177
accatcatcagcttcaattcattctagctccttccacacgcgtcgtagatgaacgcacgatcgagctcacaccgagaagcagccaccgaccaagacgaagacgaagcggcgctagggtgcatgggactttccttgtgttcccagcagagatctccggccaggccagaaattgcgaccaggggtattcgtgatcgcctgcaacccagcgctgctgctgctattcagaagggccgtggtgagggcgataagatcaatatgccgccgatccaaagcaacgaagagttgaagaacgtcttgaggcaggccaaggagccaaactccaacctggtggtgctggagttcacggcgccgtggtcggagccgtgcaagttcatgaggccggcgctggagaagatcgcctccgacttcaaggatcacgccgacttctacacgctcgacgtcgagcagttcaagacatttgctcggaacacccgggtggaggcgctgccgacgttcctgctggtgaggaaaactatcttggagcgcgtcatcggcgtcagcaaggacgagctgcagcgcagcatccaaaagcacatatctggcattgccattgatcattttcatccataaattaaatccacgtcttcatcggttggactcacattcatgactcatcaacacgtatatacat

SEQ ID NO: 29177 - protein, 162 aa, Panicum virgatum
  misc_feature: Ceres CLONE 1889562
  misc_feature (47)..(151): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGLSLCSQQRSPARPEIATRGIRDRLQPSAAAAIQKGRGEGDKINMPPIQSNEELKNVLRQAKEPNSNLVVLEFTAPWSEPCKFMRPALEKIASDFKDHADFYTLDVEQFKTFARNTRVEALPTFLLVRKTILERVIGVSKDELQRSIQKHISGIAIDHFHP

SEQ ID NO: 29178 - DNA, 715 bp, Panicum virgatum
  misc_feature: Ceres CLONE 1889590
  misc_feature: Encodes the peptide sequence at SEQ ID NO. 29179
tcatcacaagcgaagcagagcacacaagaagcagcactccaccttcttcagccgcgctacctgcttccttcctcgctcgtgatcaccgagaggatatgtcttgctgcggcggcaactgcgggtgcggctccggctgcaagtgcggcaacggatgcggcgggtagtaatctaatcgaacctggtatcatcatttcgatcaattccatggcggaatctgtagcggctgatcgcctgacgaatgtgtatgatccgcgtgtatgcagctgcaagatgtcccctgacgtggaggcctcctccaccaccaccaccaccatggtcatcgccgccgccagcagcaaggcgagctccggcgggttcgaggcggccaccgagggcggcggctgcgactgcaacacctgcaagtgcggcaccagctgcggctgctcctgctgcagctgcaactgaggcggccatgcgccgccgccatggagcacgaggaggaaggagaagcccccggcgtagtatatagtagcagcgcgtctaaataagaacttgccaactgcgccatccatcatctatcgtgtcgtgtcgtgacattcatggtcgcctgccgtgtctcagctggggttgtcgatctgaacgtctctgctgatcgacgacgcatgccggtcgtcgatcttagcttgtgtgtccgtcctcctcgtgcacgccacctctcctttaatatgtgtatttc

SEQ ID NO: 29179 - protein, 79 aa, Panicum virgatum
  misc_feature: Ceres CLONE 1889590
  misc_feature (18)..(78): Pfam Name: Metallothio_2 Pfam Description: Metallothionein
MAESVAADRLTNVYDPRVCSCKMSPDVEASSTTTTTMVIAAASSKASSGGFEAATEGGGCDCNTCKCGTSCGCSCCSCN

SEQ ID NO: 29180 - DNA, 731 bp, Panicum virgatum
  misc_feature: Ceres CLONE 1889593
  misc_feature: Encodes the peptide sequence at SEQ ID NO. 29181
ctgccttaggttccctggtcagcttaattccgatctccggaagctggcagtgaacctgatccccttcccccgtctccacttcttcatggtcggcttcgccccactgacatcccgtggctcccagcagtaccgtgccctcacagtccccgagctcacacagcagatgtgggatgccaagaacatgatgtgtgccgccgaccctcgccatgggcgttacctcactgcctcagccatgttccgtgggaagatgagcaccaaggaggttgatgagcagatgatcaatgtccagaacaagaactcatcctacttcgtggagtggatccccaacaatgtgaagtccagcgtgtgtgacatcccgccgaggggcctgtccatggcgtccaccttcatcggcaactcgacctccatccaggagatgttccggagggtgagcgagcagttcacggccatgttcaggaggaaggctttcttgcactggtacacaggcgagggcatggacgagatggagttcactgaggctgagagcaacatgaacgacctggtgtcggagtaccagcagtaccaggacgcgactgcagacgaggagggtgagtatgacgaggaggaggaggagatgcaccccgaggacatgtgagacctgatacccatgaggcttggtggttctacccttctagagctggcagatttcgatgggttgcgttccttccgtgttgttgccatgttgctactgg

SEQ ID NO: 29181 - protein, 210 aa, Panicum virgatum
  misc_feature: Ceres CLONE 1889593
  misc_feature (8)..(145): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
CLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYDEEEEEMHPEDM

SEQ ID NO: 29182 - DNA, 870 bp, Panicum virgatum
  misc_feature: Ceres CLONE 1889627
  misc_feature: Encodes the peptide sequence at SEQ ID NO. 29183
actaataaaccctcgccgcctcccccttcccgcgccgccaaagtcctccacctcctccctctcccacccacccagctctccccgagcgagcccgagggcggcaccacacgcgccatgcggccaccgagagggcgcggcggaggcggccgcttcggcggcggcggcggccgtggcggcggcgggggccggttcggcggcggtggcggccgcttcggcggtgggcgcggcggcggcggcgggttccgcgacgagggcccgcccgccgaggtcgtcgaggtgtcgacgttcctgcacgcgtgcgagggggacgcggtgacgaagctcacgaacgagaaggtgccctacttcaacgcgcccatctacctccagaacaagacccagatcggcaaggtcgacgagatcttcggccccatcaacgaatcgtatttctctgtaaagatgatggaagggatcattgcaacctcctacaaggaaggcgacaagttctacatcgaccccatgaaattgttgcccctctcgcgcttcctgccacagccaaaggggcaatctcaaggagcaccgagaggtggtggccgtggtggaagaggtggtggccgaggctggggtggttcattccgtggtggaagaggaccaccaagggggcgtggtgggcctccaaggggtggagggcgtggcggctttagaggccgaggcagattctaggtgtagtttgagtctgatgttctacaaacatcatatccgactctaccaaattggaagttttcatgttcttgtaacccgatgttaaattggcagagcacttgcaactttttatgtgtggaactcagattctctattgaaaaatattaccagttggccttgtttatgccg

SEQ ID NO: 29183 - protein, 195 aa, Panicum virgatum
  misc_feature: Ceres CLONE 1889627
  misc_feature (45)..(146): Pfam Name: Gar1 Pfam Description: Gar1 protein RNA binding region
MRPPRGRGGGGRFGGGGGRGGGGGRFGGGGGRFGGGRGGGGGFRDEGPPAEVVEVSTFLHACEGDAVTKLTNEKVPYFNAPIYLQNKTQIGKVDEIFGPINESYFSVKMMEGIIATSYKEGDKFYIDPMKLLPLSRFLPQPKGQSQGAPRGGGRGGRGGGRGWGGSFRGGRGPPRGRGGPPRGGGRGGFRGRGRF

SEQ ID NO: 29184 - DNA, 661 bp, Panicum virgatum
  misc_feature: Ceres CLONE 1889658
  misc_feature: Encodes the peptide sequence at SEQ ID NO. 29185
gccatgagatacaaatctgagggccttgccaccataattctcgctggtgctgagtacggaagtggcagttctcgtgattgggctgccaagggaccgatgctcctgggagttaaagctgtgattgccaagagttttgagcgtatccacagaagcaatttagtggggatgggaatcattcctctctgcttcaaagctggtgaggatgctgattcgctcggccttactgggcatgagcggtacagcatcaaccttcctaccaacctcagcgagatccgtcctggccaggatgtgactgtcacgaccgacaatgggaaatctttcacctgcacccttcgctttgacactgaggtggagctggcgtacttcaaccatggaggtattctcccctatgtcatccgcaacttggcgcagaactaaggcagattacaccgattcacccgtgatggcagatggctggctcgtcaccccacagggtggacggcctggttggatgtagagttttcgctatggatgtcagggcctttgtcgattcaatcctatcattaaactctgaaataaaagcctgaggtagcaggacccaccagcgggtgtgtgctgattgagcagcttcacctgatgtttggttacaatgatgaaccgtgtcatggaacagactgtcctg

SEQ ID NO: 29185 - protein, 138 aa, Panicum virgatum
  misc_feature: Ceres CLONE 1889658
  misc_feature (1)..(66): Pfam Name: Aconitase_C Pfam Description: Aconitase C-terminal domain
  misc_feature: SWISSPROT Homolog: EC 4.2.1.3 Aconitate hydratase
AMRYKSEGLATIILAGAEYGSGSSRDWAAKGPMLLGVKAVIAKSFERIHRSNLVGMGIIPLCFKAGEDADSLGLTGHERYSINLPTNLSEIRPGQDVTVTTDNGKSFTCTLRFDTEVELAYFNHGGILPYVIRNLAQN

SEQ ID NO: 29186 - DNA, 915 bp, Panicum virgatum
  misc_feature: Ceres CLONE 1889714
  misc_feature: Encodes the peptide sequence at SEQ ID NO. 29187
atctaactcagaaagccaatgcaatatcaacagcaacaaaagttagccagttgacgcgcggctccctcagcagctctgagtcaatctcctatagctaaggtccagtccagcagcagccacactgcccactgctccatccatggggttgctcgacgagtgctgcgacgactgccgctgctacagctgcagagaattctggtggggcgtcctctgcctcgccgtcctcgccgccgtcgccctcatcgtcgtcctcgtcgccgccttcggcttcgtccgccacgtgagcgtcaccgtggacgacgcctccctgacgcgcctcgcgctcgtcggcggcgcgccggccgcggcgacggcgttcgcgtacaacctctcggtgacgctcaccgtccgcaacccgaactgggcgatgagcatggccaacaccaagccgctcgacgcggcgtacagcttcgacggccagcagttcgaccgcgtgcggctcgccggcgagggcgacaagcaccccgccggcaagaccagggtgtacaggctgacgtccggctccgacggcgcgcccgtctcgctgggcaacgccggcgtcgccgagttcggcagggagaacgccacgggggtgttcgaggtggaggtggcggtgagaggcgaggtcaagtacacggcgcgccccgccaagtgcgccatcgtggccacctgcccgctcaagctccagctcgcgccgccggggcaggcgccggcggccgtcgtgttccagaaggtcaagtgcaagctcgccaaggcagagaagggctgctagctaggccgcggaaatgccggttggcgatgatgttcataaataatatgcaaggctgttgtcatttatatgtttgtgtaagtctgcagtctgcactgcacgaactaaaactatggaacgtgcagttt

SEQ ID NO: 29187 - protein, 216 aa, Panicum virgatum
  misc_feature: Ceres CLONE 1889714
  misc_feature (43)..(184): Pfam Name: Hin1 Pfam Description: Harpin-induced protein 1 (Hin1)
MGLLDECCDDCRCYSCREFWWGVLCLAVLAAVALIVVLVAAFGFVRHVSVTVDDASLTRLALVGGAPAAATAFAYNLSVTLTVRNPNWAMSMANTKPLDAAYSFDGQQFDRVRLAGEGDKHPAGKTRVYRLTSGSDGAPVSLGNAGVAEFGRENATGVFEVEVAVRGEVKYTARPAKCAIVATCPLKLQLAPPGQAPAAVVFQKVKCKLAKAEKGC

SEQ ID NO: 29188 - DNA, 692 bp, Panicum virgatum
  misc_feature: Ceres CLONE 1889715
  misc_feature: Encodes the peptide sequence at SEQ ID NO. 29189
attcacatctcctgcatctttgcctccttcctctcactagatctcacctttgcgacggcaaggtaggcgcattggagatcagagaaatgtcaacccagtttgcatccgagcatgtttgctatgtcaactgcaactattgcaataccatcctggtggtgaatgtgccgaacacttgttcctacaacatcgtgactgttaaatgtgggcattgcacaatggcgctctcgatggatctcagtcctttccaccaggcacggattgttccagacaaccaggttgttcagaacagaggatttcatcaatacaataattttgggagctatgagccagcctccagaaatctacgaaatcagtccatgtaccagatgtcaaacaatcagccacaagtgcaaccaatgcgatccccagagaagagacagcgtgttccgtcagcatacaacagattcatcaaggaagaaatacaaaggataaagactagcaatccagagattagccacagggaggcattcagtgctgcagcaaagaattgggctcatcttcctcggctccatttcggcctgagtgtcgccgacggtggcggcggcagcagctagatcatcgctgatgctgtgcttgctacatatgtcaagaagatagatcgagcgctgcgtacgcgtatgcgcacgctgacgatcgatggagaactcttcacc

SEQ ID NO: 29189 - protein, 168 aa, Panicum virgatum
  misc_feature: Ceres CLONE 1889715
  misc_feature (1)..(158): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1150 in the 10/666,642 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSTQFASEHVCYVNCNYCNTILVVNVPNTCSYNIVTVKCGHCTMALSMDLSPFHQARIVPDNQVVQNRGFHQYNNFGSYEPASRNLRNQSMYQMSNNQPQVQPMRSPEKRQRVPSAYNRFIKEEIQRIKTSNPEISHREAFSAAAKNWAHLPRLHFGLSVADGGGGSS

SEQ ID NO: 29190 - DNA, 726 bp, Panicum virgatum
  misc_feature: Ceres CLONE 1889732
  misc_feature: Encodes the peptide sequence at SEQ ID NO. 29191
acgcgcgcctcgcgaaatcaccccctcgccgccgccgccagtcgttccccggaggaagccagccagccagccggccagccaggcccgccggagatgtcgtacgcctacctcttcaagtacatcatcatcggcgacacaggcgtcggcaagtcgtgcctgctgctgcagttcaccgacaagcgcttccagcccgtccacgacctcaccatcggcgtcgagttcggggcccggatgatcaccatcgacagcaagcccatcaagctccagatttgggacacggcaggccaagagtcattcagatccataactagatcatactacagaggggccgctggtgctcttttggtctatgatatcaccaggagggagactttcaatcacctcgcaagctggctggaggatgcgaggcagcatgccaacgccaacatgacgataatgctggttgggaacaagtgtgatctgtctcacaggcgtgcagtgagctatgaggaaggcgagcagtttgcaaaggaacatggcctgatcttcatggaggcatcagcaaaaaccgcacaaaatgttgaggaggcatttgttaagactgctggagcaatctacaagaaaatccaagatggtgttttcgatgtatctaatgagtcttatgggatcaaagttggatacgcagtccctggccaatccggaggcgctggttcatctccctctcagggggggggctgctgcagctat

SEQ ID NO: 29191 - protein, 210 aa, Panicum virgatum
  misc_feature: Ceres CLONE 1889732
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
MSYAYLFKYIIIGDTGVGKSCLLLQFTDKRFQPVHDLTIGVEFGARMITIDSKPIKLQIWDTAGQESFRSITRSYYRGAAGALLVYDITRRETFNHLASWLEDARQHANANMTIMLVGNKCDLSHRRAVSYEEGEQFAKEHGLIFMEASAKTAQNVEEAFVKTAGAIYKKIQDGVFDVSNESYGIKVGYAVPGQSGGAGSSPSQGGGCCS

SEQ ID NO: 29192 - DNA, 306 bp, Panicum virgatum
  misc_feature: Ceres CLONE 1889773
  misc_feature: Encodes the peptide sequence at SEQ ID NO. 29193
atcgatcgagccagccatccagccagtcgcctatcctcgcctgctgcgcgcgtctctctgctctcctagggagatctcgcgcagcgcggtaacccgccttcccacctcgtcgccgtcgcagatggccggcctcaggatgaagctcgccgccgccgccgccgtggccgccgcgctggtggcccccaccgcggccgccccccacgccgccgccccggcgcccgtgtggcacaccgccgccccggtgccgctcgtcctcgtctccctcggggtcacccccctccgctcggtgttcagctacatcagcct

SEQ ID NO: 29193 - protein, 61 aa, Panicum virgatum
  misc_feature: Ceres CLONE 1889773
  misc_feature: Functional homolog of the protein sequence given in SEQ ID NO 50452
  misc_feature: Useful for making plants with altered carbohydrate content
MAGLRMKLAAAAAVAAALVAPTAAAPHAAAPAPVWHTAAPVPLVLVSLGVTPLRSVFSYIS

SEQ ID NO: 29194 - DNA, 668 bp, Panicum virgatum
  misc_feature: Ceres CLONE 1889851
  misc_feature: Encodes the peptide sequence at SEQ ID NO. 29195
acacaccaccagagcacagccaagagcgagacgcccaagcaaccaccgctccacagctaagctaagccaagccagccaccgcgagaacaagtcgcagcgaaaaagcctgctacgcttgccatgacttccatggagctgctccacgccgtgatcccggagttcaagtgctccgtctgcggcaagtccttcagctcctaccaggcgctggggggccacaagaccagccaccgtgccaagctgccgacccctcctgcttccgcgggcgctccggccgcacccgtcgttgaggcccccgccccgatcaccgtcgtcgtcccgccgccgatcgaggtcgcccgcgagccggccacgtcatccaccgccgcgtcctccgacggggcggccgcctcgagcagagtccacaggtgctccatctgccacaaggagttccccaccgggcaggcgctcggcgggcacaagaggaagcactacgacggcggcgcgggcagcgccgccgccgccgcctccaccgatctcctggctgccgccgagacgtccgaggtggggagctccggcaacggcagctccgcggcccgggcgttcgacctgaacctcccggccgtgccggagttcgtgttccggtgcggcaaggccggcaagatgtgggaggaggacgaggaggtgcagag

SEQ ID NO: 29195 - protein, 179 aa, Panicum virgatum
  misc_feature: Ceres CLONE 1889851
  misc_feature (11)..(33): Pfam Name: zf-C2H2 Pfam Description: Zinc finger, C2H2 type
MELLHAVIPEFKCSVCGKSFSSYQALGGHKTSHRAKLPTPPASAGAPAAPVVEAPAPITVVVPPPIEVAREPATSSTAASSDGAAASSRVHRCSICHKEFPTGQALGGHKRKHYDGGAGSAAAAASTDLLAAAETSEVGSSGNGSSAARAFDLNLPAVPEFVFRCGKAGKMWEEDEEVQ

SEQ ID NO: 29196 - DNA, 702 bp, Panicum virgatum
  misc_feature: Ceres CLONE 1889852
  misc_feature: Encodes the peptide sequence at SEQ ID NO. 29197
tattttctctctggaaagtgcaggtcgaagagctactgaaggaatatgagaatgtctgcaccctgcgtgtccggatgcccatatcttctgaccttagcaacccccggaatttcgtgacaaagatcagccgttacgacaaggtggtgaacatcccaaacagcatgacaatactggatgagctcctgccgatctcaatcgagatggccaagaggaacctgcggggcatctataatttcaccaaccctggcgtcgtcagccacaacgaggtcctggagatgtacaagcagtacattgaccctagcttcaagtggacaaacttcaccctcgaggagcaggccaaggtcatcgtcgcgccccggagcaacaacgagttggacaccaccaagctggagcaggagttccccgagttgctgtcgatcaaagactcgttgatcaagtacgtcttcgagccaaacaggaaggtgccagcaaactgaaggccagcagagccgatacaacagaaaatgcagcagccattattagcttgtagcgcatccattcgtcgtgaacggttcatcagaatttgtacttgttatactcagcagcatatctccgctatagtttgattcagagctgctttgtagtttttggcaacatggcgattccccaatttgctgcagagaccatatgtactacttgctgagttcaatgttcagtatgtgt

SEQ ID NO: 29197 - protein, 157 aa, Panicum virgatum
  misc_feature: Ceres CLONE 1889852
  misc_feature: Functional homolog of the protein sequence given in SEQ ID NO 51125
  misc_feature: Useful for making plants with altered carbohydrate content
  misc_feature: Functional homolog of the protein sequence given in SEQ ID NO 51306
  misc_feature: Useful for making plants with altered cell wall content and/or composition
FSLWKVQVEELLKEYENVCTLRVRMPISSDLSNPRNFVTKISRYDKVVNIPNSMTILDELLPISIEMAKRNLRGIYNFTNPGVVSHNEVLEMYKQYIDPSFKWTNFTLEEQAKVIVAPRSNNELDTTKLEQEFPELLSIKDSLIKYVFEPNRKVPAN

SEQ ID NO: 29198 - DNA, 717 bp, Panicum virgatum
  misc_feature: Ceres CLONE 1889874
  misc_feature: Encodes the peptide sequence at SEQ ID NO. 29199
aaaaccctagcgccggcgcctccacttcgcttcctcgccccatctcctcgcgctcagggttcggcgcccaagggaggcaagatgtacaccgcgaggaagaagatccagaaggagaagggcctcgagccctccgagttcgaggactccgtcgctcaggctttctttgacctggagaatgccaaccaggagctcaagagcgacctcaaggacctctacatcaacaatgctatccagatggacgttgccgggaacaggaaggctgttgtgatccacgtcccgtaccgcctgcgcaaggccttcaggaagatccacgtcaggctcgtcagggaactggagaagaaattcagtggcaaggatgtcgtagttgttgcgacaagaaggattgtgaggccgccaaagaagggttcagctgttcagcgccctcgcacgaggactctgactgctgttcatgatggaatcttggaggatgttgtgtacccagccgagatagttgggaagcgtgtcagataccgtttggatggtgccaagatcatcaagatcttcttggacccaaaggagaggaacaacactgaatacaagctggagaccttcaccgcagtctaccgcatgctttgtgggaaggacgtggtctttgagtaccctgtggctgaaaacgcataaagctgaagtcgtggatatctccattacatttctttgaagcaggatgttttggttggg

SEQ ID NO: 29199 - protein, 192 aa, Panicum virgatum
  misc_feature: Ceres CLONE 1889874
  misc_feature (6)..(191): Pfam Name: Ribosomal_S7e Pfam Description: Ribosomal protein S7e
  misc_feature: Functional homolog of the protein sequence given in SEQ ID NO 50192
  misc_feature: Useful for making plants with modulated biomass
MYTARKKIQKEKGLEPSEFEDSVAQAFFDLENANQELKSDLKDLYINNAIQMDVAGNRKAVVIHVPYRLRKAFRKIHVRLVRELEKKFSGKDVVVVATRRIVRPPKKGSAVQRPRTRTLTAVHDGILEDVVYPAEIVGKRVRYRLDGAKIIKIFLDPKERNNTEYKLETFTAVYRMLCGKDVVFEYPVAENA

SEQ ID NO: 29200 - DNA, 722 bp, Panicum virgatum
  misc_feature: Ceres CLONE 1889964
  misc_feature: Encodes the peptide sequence at SEQ ID NO. 29201
gcttctatccacagtcgcaagttccaagccgctccaacggcagccatggcttccatcaccgtcctttccctcgctcccaccgccggagccaccttcctccacatcccagcctccacctcctccttcgtcgccgctcccggaatcctcaccagccgccgggcagcgccccgcgccctcccgctccgcgcgcgcccgctgcgccgcgtcaccgtcgtctgcagcggcgccgctgcggcagccgaggcctcggatgcggcggcgcccgccgagaagtttcggctcgacaacctgggcccacagaaggggtcccggcggcggcccaagcgtaaggggcgcggtatcgcggcgggccagggcgcgagctgcgggttcggaatgcgggggcagaaatcgcgctcggggcccggcggccggcgcgggtttgagggagggcagatgccgctctaccgccggattcccaagctacgcggcattgccggcggaatgcacattgggttgccgaagtatgtgccattcaatttaaaagatatagtgcgtggtggattcaaagatggtgacgagctatcactggagaccctgaaatcacggggcttgatcaacccttcaggcaaggaaaggaagctgccattgaagattttaggggatggtgatgtgtcagtcaagttgaacatcaaggctggagcattctcagcatcggctaaagagaagcttgatgcagctgg

SEQ ID NO: 29201 - protein, 225 aa, Panicum virgatum
  misc_feature: Ceres CLONE 1889964
  misc_feature (77)..(184): Pfam Name: Ribosomal_L15 Pfam Description: Ribosomal protein L15 amino terminal region
MASITVLSLAPTAGATFLHIPASTSSFVAAPGILTSRRAAPRALPLRARPLRRVTVVCSGAAAAAEASDAAAPAEKFRLDNLGPQKGSRRRPKRKGRGIAAGQGASCGFGMRGQKSRSGPGGRRGFEGGQMPLYRRIPKLRGIAGGMHIGLPKYVPFNLKDIVRGGFKDGDELSLETLKSRGLINPSGKERKLPLKILGDGDVSVKLNIKAGAFSASAKEKLDAA

SEQ ID NO: 29202 - DNA, 400 bp, Panicum virgatum
  misc_feature: Ceres CLONE 1889976
  misc_feature: Encodes the peptide sequence at SEQ ID NO. 29203
acacaggccacagcaccaccaccagagcacagagagagcagagcgccacaggccgtccgatccgcccgcgcgaagcagatcagatggctctcgctctctccggctcctccgcgctccgcgccgcgctggcctcgctggcccccgccaggggctacgcggcgtcggcggcgtccggggccctgcggcgcgcggcggccgcggcggagggcgccgccgcgggggaggccaaggaggccgggcgcggcgccgcctccgagatctcctgggtcccccaccccgtctcgggccagtgccgccccgccaactgggccgccgccgccgaccccgccgacctccgcgccgcgcgcctcgcccgggcgtgaaccccgcgcccgcccgccccctctcgtctgacctagca

SEQ ID NO: 29203 - protein, 92 aa, Panicum virgatum
  misc_feature: Ceres CLONE 1889976
  misc_feature (1)..(90): Pfam Name: LEA_3 Pfam Description: Late embryogenesis abundant protein
MALALSGSSALRAALASLAPARGYAASAASGALRRAAAAAEGAAAGEAKEAGRGAASEISWVPHPVSGQCRPANWAAAADPADLRAARLARA

SEQ ID NO: 29204 - DNA, 602 bp, Panicum virgatum
  misc_feature: Ceres CLONE 1889981
  misc_feature: Encodes the peptide sequence at SEQ ID NO. 29205
atcgagcaccctccaatcttcaaggcgtcgcagcaggcaaggcatcgatcgatcacaccagcagcgcgtgccgcgtagagagatcgagagagagagagagagagagagagagagagagagagagagaggagtctcaccggagaagggaggaatcgtcatcgccaccgccaccgccaccgccaccgccatgggcaaggtccgctccttcttctcccgcagcggcaagcgcggcgccggtccgtcctcgccgtcctcctccgcggcgggcagcgcgccgtcgtcgccgtccccgagaaagtcgtcggcgtcggcgccggcggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgcgccgccttcatggtcttcgacgccgacg

SEQ ID NO: 29205 - protein, 138 aa, Panicum virgatum
  misc_feature: Ceres CLONE 1889981
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPAAPAAETKDEMERVFRKFDANGDGRISRSELAALFEGVGHAATDDEVSRMMEEADADGDGAISLPEFAALVRSADADADAVEEDLRAAFMVFDAD

SEQ ID NO: 29206 - DNA, 584 bp, Panicum virgatum
  misc_feature: Ceres CLONE 1890011
  misc_feature: Encodes the peptide sequence at SEQ ID NO. 29207
agatccgccgccctgcgcccgtctccgccgtccgccggccgcgccgccgcctctccccggccctcgctcgctcctgcccgtcgcccgcgcgcctccccgcgctcgtacgggacacggcgccgcccgtctctccggcacgcgccgctcctccgcggcgtccgcgctcccgctcgcgctcgcgccgcccgtctccccggctgagaaatggaactaggtgataaggcggttggttttctgctgacgctaacgagcttatccatcttcacctactatacattctgggtcattatcttgccgtttgttgacagcgaccactttgtgcacaagtacttcctgcctcaagagtatgcgattttgataccagtgattgccggcatggttctcctttctttcttgagcatctttgtgggtctcgtgatgctcaagtcaaagaaaaagaagaagaccacttgattgggtttggcttgtatattgtagtactcttcgcttactatgatgattaaatccatgagttcagaatctatgtaattgctggaagctcggtaaacagttccatcatattgaaggcgctcactttgtaactc

SEQ ID NO: 29207 - protein, 82 aa, Panicum virgatum
  misc_feature: Ceres CLONE 1890011
  misc_feature (1)..(80): Pfam Name: DPM2 Pfam Description: Dolichol phosphate-mannose biosynthesis regulatory protein (DPM2)
MELGDKAVGFLLTLTSLSIFTYYTFWVIILPFVDSDHFVHKYFLPQEYAILIPVIAGMVLLSFLSIFVGLVMLKSKKKKKTT

SEQ ID NO: 29208 - DNA, 682 bp, Panicum virgatum
  misc_feature: Ceres CLONE 1890013
  misc_feature: Encodes the peptide sequence at SEQ ID NO. 29209
gaatccaccactaccatcccaatctttctcctcccgcatcgcatcgcacccacctcccctacccggaaaacccccaaattgcaatcaggtcccaggcgggttcctcccccaaatccgcaacccagctcgaggaaattcgagaattcatcgacggagcctgacggatcgggcggcgaggatgggcatctcgagcatgccgacgcccaaagacagcctgatggggttcgtcctgtacaacacggcggtgtcggtggcgatcctggcggggctggtgcgcgcggcgctggtgttcctgggcctggcggcgccgtctccgtgggagggcttcgccgccgacgagcacccccaccaccaccgccgccgccgccaggtggtgtcgtcgatctcgcccctggggccgagcctcgcggaccggttccggagccggttccgcccgtcgcggttcgggcggcggcgcggcggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgatgactacgcggccgtggcggcggcggcggccgtccggttttatgagaat

SEQ ID NO: 29209 - protein, 167 aa, Panicum virgatum
  misc_feature: Ceres CLONE 1890013
  misc_feature (100)..(141): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MGISSMPTPKDSLMGFVLYNTAVSVAILAGLVRAALVFLGLAAPSPWEGFAADEHPHHHRRRRQVVSSISPLGPSLADRFRSRFRPSRFGRRRGGAGADCRVCLARFEPESVVNRLPCGHLFHRACLETWLDYDHATCPLCRLRLLPPAADDDYAAVAAAAAVRFYE

SEQ ID NO: 29210 - DNA, 723 bp, Panicum virgatum
  misc_feature: Ceres CLONE 1890057
  misc_feature: Encodes the peptide sequence at SEQ ID NO. 29211
catccccgtatccgtgaggaagagaaaggcgtcgtgctctgggctccgtcgccgcgccgcgcccgcaaggccgcaaccgcaacagctagccgtcgattacgtgaggagtcggaggggggaggggagcgaggcgacggtcgatggagacggtggaggaggacgtggaggagtacagctggcgggaggtggtgctgccgcgcctcgtccccgtggtgcccaacgcgccgccggagctcgagcgggagaccggggagcggcggcgcggcagggacctcctcgtcgccgtcgacttcggccccaactccaagcacgccttcgactgggcgctcgcgcacatcgcgcgcatcgccgacacggtccacctcgtccacgccgtctccaatgtgcataatgagattgtgtatgagaaaagtcgggagctaatggaggatctggctattgaggcattcaagacttcattggtccgtaccaaggcacgaattgttgaaggggatgctggaaaagttatatgccgagaagcagaccgactgaagccagcagctgtcattcttggtacacgtggtagaggccttattcaaaggatctccactcagcaaggaaaaaatatcttgatgctaacttgttaagggattgtttgctggcctcagaatggtctatcaagtatttgtctaattaacattactgttggtagtttgaagctcaaattagggcgcgtatggtcct

SEQ ID NO: 29211 - protein, 161 aa, Panicum virgatum
  misc_feature: Ceres CLONE 1890057
  misc_feature (42)..(160): Pfam Name: Usp Pfam Description: Universal stress protein family
METVEEDVEEYSWREVVLPRLVPVVPNAPPELERETGERRRGRDLLVAVDFGPNSKHAFDWALAHIARIADTVHLVHAVSNVHNEIVYEKSRELMEDLAIEAFKTSLVRTKARIVEGDAGKVICREADRLKPAAVILGTRGRGLIQRISTQQGKNILMLTC

SEQ ID NO: 29212 - DNA, 709 bp, Panicum virgatum
  misc_feature: Ceres CLONE 1890075
  misc_feature: Encodes the peptide sequence at SEQ ID NO. 29213
caacgcagcgtcaagtgagcctagggcatgtgctgcaccaaaaacagattctgccaagacgccaatgaagactcgtggtgtacattctgatggtgattctgcgagaaagcatgctaatacgtcatgtgataaagccaattccacacagttaccatctgctggtagctcattaggtgctgaaaaaaagaagaaaattcctgtagtttctgatgaaatacctgtggaaaggacagctctatcggtccctgatcattttcagctgaaggatgacaagagtggtggggctagcagttcgtcacagaatgattatgtgacccagaaactctcttctgacataagccagctaaatgtagacaagaacaatgtgaatgttacaaaaccttgtttgcctgaagagtataagcctgagaagtggatgttagctgatcaggagtcaggggtgctgagccaactaaaccttgcaatagtgggtcatgttgattctggcaagtcgacactatctgggagattactgcatctattacgaaggatatcgagaaaagatatgcacaagaatgagaaggagtcgaaagagaaagggaagggatcatttgcttttgcatgggccatggatgagagcagtgaagaaagggaacgaggtgtgacaatgacagtaggtgtggtctatctggagacgaagaaataccgtgtggttttgcttgactcacct

SEQ ID NO: 29213 - protein, 235 aa, Panicum virgatum
  misc_feature: Ceres CLONE 1890075
  misc_feature: SWISSPROT Homolog: EC 2.7.7.4 Sulfate adenylyltransferase
NAASSEPRACAAPKTDSAKTPMKTRGVHSDGDSARKHANTSCDKANSTQLPSAGSSLGAEKKKKIPVVSDEIPVERTALSVPDHFQLKDDKSGGASSSSQNDYVTQKLSSDISQLNVDKNNVNVTKPCLPEEYKPEKWMLADQESGVLSQLNLAIVGHVDSGKSTLSGRLLHLLRRISRKDMHKNEKESKEKGKGSFAFAWAMDESSEERERGVTMTVGVVYLETKKYRVVLLDS

SEQ ID NO: 29214 - DNA, 1303 bp, Panicum virgatum
  misc_feature: Ceres CLONE 1890083
  misc_feature: Encodes the peptide sequence at SEQ ID NO. 29215
acgcctctgaccttcccctccgctccgccccctagacacgcgcgcacggcctcctctgctggtgctggggcctggccgcgggccgccccgctcgctcgcgtcggggccaacaaacacagggtgatcgaagtgaagatcgtcaggggccacgcattccgatcgagccgggacgggagcctcgttttcgtttcgtcagggagacgcaaaggagatcatcagagctccatcggatcggaggccgtcgagcaccttcgcgtcgttcaacttcgatcgagttcgacgaggaggcgctactctaccgtgctagcagaaagtcaccacacttgtaggccttgtcgcccgaggatgctgcagaaacgatggcagggatgcgtcttcttgctcgccttccttctctgcgacgcgtcagagcggaccccgagctcctgcgatccctagccggcagcgatgcagagctcatgctcgccatccccaacgagcagctggagcacatcgccgagttccaggaggaagccgacctctgggtcatcgcctacgtggcgcgcttcctcccggcggccaggatcacgcacgtcctggcgggcgacgacgtgctgaccacctcccccgggagcgcatacttcctcgtcccggcgatgctcaacctccgctcggccctcgccgccgcggggctcgacggccgggtcaaggtgtcgaccgcggtgtccgcggaggccctggccgccccggcgtggtcgggcgtcgcgggccacgtcctgcggttcctgagctccgccggctcgccgctgttcctcaagtcccgcccgtcggaggccagcgatgccgaggccgacgccgcgtacggcgcgatgcgcgcgctgggcgtcccggccgttcccgtggtcgcggcagacctcggtgccgccgccggcggcgaagcggcggcgtactactactacggctacccgggcggccagccgggtgaacggggcacgcggcggtcgctggcgacggggacgttctgcgtggcgctgcagaacgcggacccggcggcgctgcaggccgggctcaactgggcgtgcgggccgggccacgccgactgctccgccatccagcccggcgggccctgctaccagcagaacaacctgccggcgctcgcctcctacgcctacaacgactactaccagaagatgtccagcaccggcgccacctgctcgttcaacggcaccgccaccaccaccaccaacgatcccagctcaggatcttgcgttttcgcgggaagctccacggcgggaggctccaactcgagcacgccgacgccggt

SEQ ID NO: 29215 - protein, 314 aa, Panicum virgatum
  misc_feature: Ceres CLONE 1890083
  misc_feature (213)..(298): Pfam Name: X8 Pfam Description: X8 domain
  misc_feature (3)..(234): Pfam Name: Glyco_hydro_17 Pfam Description: Glycosyl hydrolases family 17
  misc_feature (212)..(298): SWISSPROT Homolog: EC 3.2.1.39 Glucan endo-1,3-beta-D-glucosidase
  misc_feature (7)..(115): SWISSPROT Homolog: EC 3.2.1.73 Licheninase
  misc_feature: Functional homolog of the protein sequence given in SEQ ID NO 50730
  misc_feature: Useful for making plants with altered carbohydrate content
MAGMRLLARLPSLRRVRADPELLRSLAGSDAELMLAIPNEQLEHIAEFQEEADLWVIAYVARFLPAARITHVLAGDDVLTTSPGSAYFLVPAMLNLRSALAAAGLDGRVKVSTAVSAEALAAPAWSGVAGHVLRFLSSAGSPLFLKSRPSEASDAEADAAYGAMRALGVPAVPVVAADLGAAAGGEAAAYYYYGYPGGQPGERGTRRSLATGTFCVALQNADPAALQAGLNWACGPGHADCSAIQPGGPCYQQNNLPALASYAYNDYYQKMSSTGATCSFNGTATTTTNDPSSGSCVFAGSSTAGGSNSSTPTP

SEQ ID NO: 29216 - DNA, 742 bp, Panicum virgatum
  misc_feature: Ceres CLONE 1890089
  misc_feature: Encodes the peptide sequence at SEQ ID NO. 29217
atcacactgattgctgaagatgagttcctccacgtccagcgctctcgtgctagcagcagcagtgctcctagcagcactgaccgtagcacagcatggctccctcgccgcagccgccggccccagggtcatcatcgtcggcgccggcatgtccgggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggattcgcaacacatagctcgagagaccgcctcgcgtcgcctcctgtgaggcggctcgggggtcggggcgacgcactccgccgtcgaggcggcccgtctgctccttggccgccgccgctgctctccggcgagcggtggcggcggtggcgctcaaaaaggctgccatgatccgtggccctcgacgccggatccgtcgtctccagctcgggttacggtgccggagctcgcggtgatgccagggtccgtgggtggtgcggttcccggagcagaccgtcgtctcccccaggcctgcagctctcggcgtgggggcactgcgctcgcggtcgtcggcctccagtcttta

SEQ ID NO: 29217 - protein, 100 aa, Panicum virgatum
  misc_feature: Ceres CLONE 1890089
  misc_feature: SWISSPROT Homolog: EC 1.5.3.11 Polyamine oxidase
MSGISAAKTLSEAGITDLLILEATDRIGGRMHKKNFSGINVEIGANWVEGVNGGKMNPIWPIVNETLKLRNFLTDFSVATNIYKEDSQHIARETASRRLL

SEQ ID NO: 29218 - DNA, 638 bp, Panicum virgatum
  misc_feature: Ceres CLONE 1890092
  misc_feature: Encodes the peptide sequence at SEQ ID NO. 29219
acacaggccacagcacccccaccggagcacagagagagcagagcgccacaggccgtccgatcctccgcgcgaagcagatcagatggctctcgctctctccggctcctccgcgctcggcgccgcgctggcctcgctggcccccgccgggggctacccggcgtcggcggcgtctggggccctgaggcgagaggagggaggagcggacggcgcggggagaggatgtcgtacctgcggccgcatctgcgctcggggtgggcggtggaccacgccatcctcgccgaggaggagcgcctcgtcatcatccgcttcggccacgactgggacgagacctgcatgcacatggatgaagtgctggcgggagtagctgaaaccattaacaactttgcggtcatctaccttgtggacatcaccgaggtccctgacttcaacaccatgtacgagctgtacgacccatccacggtgatgttcttcttccgaaacaagcacctcatgatcgatctcgggacgggaaacaacaactagatcaactgggccctcacagacaagcaggagttcatcgacatcgtggagacggcctacaggggtgcccggaagggccgtggtctggtgatcgcccccaaggactactccaccaagta

SEQ ID NO: 29219 - protein, 100 aa, Panicum virgatum
  misc_feature: Ceres CLONE 1890092
  misc_feature (4)..(100): Pfam Name: DIM1 Pfam Description: Mitosis protein DIM1
MSYLRPHLRSGWAVDHAILAEEERLVIIRFGHDWDETCMHMDEVLAGVAETINNFAVIYLVDITEVPDFNTMYELYDPSTVMFFFRNKHLMIDLGTGNNN

SEQ ID NO: 29220 - DNA, 671 bp, Panicum virgatum
  misc_feature: Ceres CLONE 1890107
  misc_feature: Encodes the peptide sequence at SEQ ID NO. 29221
aacgtgttagctccggctcaaatgatgagctgcagaatttgcagatctagctcacccctctccgtcccacactcccataccttgctcgcggatctgctgctgttgccgctgcagatgggaaaggccttgggcgactgagcatcaggacggcctcatcagctgagcttcacaatggcaggtttcatccggtcgtccactcaagtcatggcaatggcaatggcaagcgtcgcagtcgttcatcggcgtcaactacgggacgattgccgacaacctcccgccgccggcgtcgacggccagcctgctcatgtccacgtccatcggcaagctccgcctctacgagccccagccggagctggtcgcggcgctcgcgggctccaacatctccatcctgctgggcatccccaacggcgacgtgccgaacctcgcgtcctcccccgccgcggccgcgtcatgggccgccgccaacatccccaccacggtgcccgtctccgccatctccgtcggcaacgagctgctcaactccggcgaccccaccctcgcgccccagctcctccccgccatgcagaacctcctcgccgcgctccccgccggctcgaccaccaagatctccaccgtgcactccatggccgtgctgtcggcgtcggaccccgcgtcgtccggcgcgttccact

SEQ ID NO: 29221 - protein, 122 aa, Panicum virgatum
  misc_feature: Ceres CLONE 1890107
  misc_feature: SWISSPROT Homolog: EC 3.2.1.39 Glucan endo-1,3-beta-D-glucosidase
  misc_feature: Functional homolog of the protein sequence given in SEQ ID NO 51189
  misc_feature: Useful for making plants with altered carbohydrate content
  misc_feature: Functional homolog of the protein sequence given in SEQ ID NO 51307
  misc_feature: Useful for making plants with altered cell wall content and/or composition
MSTSIGKLRLYEPQPELVAALAGSNISILLGIPNGDVPNLASSPAAAASWAAANIPTTVPVSAISVGNELLNSGDPTLAPQLLPAMQNLLAALPAGSTTKISTVHSMAVLSASDPASSGAFH

SEQ ID NO: 29222 - DNA, 724 bp, Panicum virgatum
  misc_feature: Ceres CLONE 1890109
  misc_feature: Encodes the peptide sequence at SEQ ID NO. 29223
accaatcccctcccctccactcgtttccttctcgcggcaaaagccctcgaagcagataaggccgccgtgcccccggccaccgccgtcggccatggtcggcgtcgccgcaggcttcgccttcgcgccggcagtgtcccgcgcaccttacaggcccggcgccgtatccaacgcatcgggccccccctcctcgtcggcgcggttcccggccaggccgtgggcgccggcgaggctcgtcgtggtcgcgcggtactcgtcctcgccctcgtacgagagcgacgaggaggaggatgaggaggcgctcggaggcggcgggtggggaaggagggaccgcgggcccgaccctgactccgaccccgcccttgacattgaacgaatcgagtcctcgactgtaaggctcttggatgaacagaaaagaatggttggcgtggtatccgtaagcgaggcagttcaaattgcagacgacaatgaccttatactggcaatattatcattagacggagatcccccagtacttcgactctttgaggagagagattacaaaaagcacaggtatgagcagcagaagaagaaaaagattcagcagaaaagatctgttgcaaaacgcatgggcttgaaggagttgaaaatggggtaagaacatgtcagctttactttttttttgtctcaatacattaattattcaagcttatgtctaaacttttgctttttgtggaccttctttaat

SEQ ID NO: 29223 - protein, 180 aa, Panicum virgatum
  misc_feature: Ceres CLONE 1890109
  misc_feature (86)..(165): Pfam Name: IF3_N Pfam Description: Translation initiation factor IF-3, N-terminal domain
MVGVAAGFAFAPAVSRAPYRPGAVSNASGPPSSSARFPARPWAPARLVVVARYSSSPSYESDEEEDEEALGGGGWGRRDRGPDPDSDPALDIERIESSTVRLLDEQKRMVGVVSVSEAVQIADDNDLILAILSLDGDPPVLRLFEERDYKKHRYEQQKKKKIQQKRSVAKRMGLKELKMG

SEQ ID NO: 29224 - DNA, 661 bp, Panicum virgatum
  misc_feature: Ceres CLONE 1890115
  misc_feature: Encodes the peptide sequence at SEQ ID NO. 29225
agcttccctctcctccgcagaacatcatctccaacactgcgctcccctctccgcgtcgggcctttctccaatggaggccaccagcacactcgcactctcctcgtcccccgccgccgcgcgacgctcgccggagaagtcagccgtagcctccctccacctccgccgcttccccacgacctcctcgctccacctccgcgcggtccagagcccagcgcttcgcgctcactcctcagccttccagggatggaggaggcggaggagggcgggcgggctggtagtccgggcggagatgttcgggcagctaactaccggcctcgagtctgcctggaacaagctgcggggagtcgatgtattgacaaaggaaaacatcgccgagccaatgcgggatattagaagagcacttttggaggcggatgtaagcttgccggtagtaaggagatttattgaatctgtaagtgaaaaggctgtagggaccgatgttatccgaggtgtcagtcctgatcaacagctggtgaaggttgttaatgatgaacttgtacaactgatgggtggtgaggtatcagatttgtcatttgcaaagtctggcccaactgttatcttgttagcaggtctgcaaggtgttgggaagactactgtttgtgcaaagcttgccttgtatcta

SEQ ID NO: 29225 - protein, 196 aa, Panicum virgatum
  misc_feature: Ceres CLONE 1890115
  misc_feature (75)..(160): Pfam Name: SRP54_N Pfam Description: SRP54-type protein, helical bundle domain
MEATSTLALSSSPAAARRSPEKSAVASLHLRRFPTTSSLHLRAVQSPALRAHSSAFQGWRRRRRAGGLVVRAEMFGQLTTGLESAWNKLRGVDVLTKENIAEPMRDIRRALLEADVSLPVVRRFIESVSEKAVGTDVIRGVSPDQQLVKVVNDELVQLMGGEVSDLSFAKSGPTVILLAGLQGVGKTTVCAKLALY

SEQ ID NO: 29226 - DNA, 586 bp, Panicum virgatum
  misc_feature: Ceres CLONE 1890127
  misc_feature: Encodes the peptide sequence at SEQ ID NO. 29227
gagcggtgcagagagttcgctgcagttcgtggtcttggtctgttggtcgtccttgcagcgcagccatggcgagctccaagaaaccctccctcttcatctcccttctcctcctcttgctcgttgtttcagctgtccatggagctcagcctgcagatgctggggacacagcaggcggcgccgagcgggtcgcggtgaggagctcaggccatggccacgggtacagcagcagccacagcggtgggcacacgagcggcggcaccggcacgccggagcagggcggcgcggggtccgtcgacccccggaacctcaacgccaggagccaccaccgcagcggcgcggcgagcagggccggcctcgggtactcttctccggtggcttgggggcttgtcggagcgatccttgccgtggctcttcttccatgacacgttgaacaaatgctgagcgcaaatgcaatgtatcgtgcgtgttgcagtttcttcgctagtcccttgtgttttgcttgtatggaggctagagggagggaccgaaatgtgcgcgtgaatgtgaagtagttctgccccctagagtgaagtttcaaatttttggc

SEQ ID NO: 29227 - protein, 118 aa, Panicum virgatum
  misc_feature: Ceres CLONE 1890127
  misc_feature (1)..(73): Pfam Name: GRP Pfam Description: Glycine rich protein family
MASSKKPSLFISLLLLLLVVSAVHGAQPADAGDTAGGAERVAVRSSGHGHGYSSSHSGGHTSGGTGTPEQGGAGSVDPRNLNARSHHRSGAASRAGLGYSSPVAWGLVGAILAVALLP

SEQ ID NO: 29228 - DNA, 1960 bp, Panicum virgatum
  misc_feature: Ceres CLONE 1890142
  misc_feature: Encodes the peptide sequence at SEQ ID NO. 29229
atcccgggccatcgcgttgccggatcgagctcaactctctcgaacctcgcttcgccgcacggcacaaaaaagcccggccgcgccctgccccccgcaccctcgtcccctccacacgtttccgcctccccgatccacagccgccgccgccgacacagcaccgccccccttcccctcgcagccctcgccgcagccgcagccgaggccgaccgaccaaccagccagccagccccgctccttcgtcgccaggcggcgcgggcgctgcggggcgcacgccgggagcgagcggggggccgcgaggcgcggctattgttgtcgtctgtgggaaggcggttcgggggcgtgcgcggcgcggaggatggcgtcgagcgcggcggaggcggcgggccgagtggcggacgaccacgacggctgggcgtcggacggcgaggcggacatggagatggaggcgggcggcgaggcccacggacgcgatgccggcgcggacgacgtcgacgacgcgtactcgctgatcactagggtaagtgacacatcagcagctgaagcaaggataggaaaggatatacaaggtattccatgggaggggctaaacataactaggcaggactacagaaaagctaggttggaacaatataaaaactacgaaaacttccctcaatctggagagctcattgataagttgtgcaagcaagtggagccgtgcagcaagtattacgagtttcagcacaacactagatcggtgaagccatcaattctccattttcagcttaggaatttgttatgggcaacctcaaagcatgatgtctattttatgtcggagtccacagtaggccactggtcatcactgtctcacaaattgtcaacggttctcgacttctcagggcacattgctccagcagagaagcatcctggcagtttactagaaggattctctggggttcaagtcagcacacttgctgtgaatgagggtttattggtagctggtggttttcaaggagaactaatttgcaagggtttagcagaccgcaatgtgaaattctgtacaaggacaactttgagcgatgctataacgaattccatagatatacacagatctacaagtggaagcttgtgcattacagtatccaataatgattgcggtgtccgtgaatatgacatggaaagatttcagctcttgaatcacttccgttataactggccagtgaatcacacatctgtgagtccggataggaaacttttggctgtggttggagatgatcgggatgcacttcttgtggattcacgaaacgggaaggtaacctctaccctagtcggccatctggactattcattcgcaacggcatggcacccagatgggcgcaccttcgcaacagggaaccaggacaaaacctgccgtgtctgggacatgcgcaatctgtcgacctcccttgcagtccttcggggcaacattggtgcgatccggtgcatccgctactcctccgacgggaggttcctggtgttctcagagcctgccgacttcgtgcacgtgtacagcactgccgcagactacaagaagcggcaggagatcgacttctttggtgaggtgtctgggatcacgctcagccctgacgatgagtctctgttcgttggggtgtgcgaccgtgtctacgccagcttgatgcagtacaggatggcccatgcgttcaactatcttgacttacgtgtgaagaactgaatatcaggtgttctctgtctggtgctggctatcggtcactgctctcagtggcggttctggtgtgcggttcaggtaatgtatccgcctgttctcgtgcgcctgttctcgtgcgctgtaccatggtgtacggcgagttgaggctcgggcgagtctgccgtgtaaatagttttgtagttgaagtataatgtcaaggaccgctactgtctgaacatgactatatgagcaatgtatgtttgcgcggttagtttc

SEQ ID NO: 29229 - protein, 451 aa, Panicum virgatum
  misc_feature: Ceres CLONE 1890142
  misc_feature (311)..(349): Pfam Name: WD40 Pfam Description: WD domain, G-beta repeat
  misc_feature: SWISSPROT Homolog: EC 2.3.1.48 Histone acetyltransferase
MASSAAEAAGRVADDHDGWASDGEADMEMEAGGEAHGRDAGADDVDDAYSLITRVSDTSAAEARIGKDIQGIPWEGLNITRQDYRKARLEQYKNYENFPQSGELIDKLCKQVEPCSKYYEFQHNTRSVKPSILHFQLRNLLWATSKHDVYFMSESTVGHWSSLSHKLSTVLDFSGHIAPAEKHPGSLLEGFSGVQVSTLAVNEGLLVAGGFQGELICKGLADRNVKFCTRTTLSDAITNSIDIHRSTSGSLCITVSNNDCGVREYDMERFQLLNHFRYNWPVNHTSVSPDRKLLAVVGDDRDALLVDSRNGKVTSTLVGHLDYSFATAWHPDGRTFATGNQDKTCRVWDMRNLSTSLAVLRGNIGAIRCIRYSSDGRFLVFSEPADFVHVYSTAADYKKRQEIDFFGEVSGITLSPDDESLFVGVCDRVYASLMQYRMAHAFNYLDLRVKN

SEQ ID NO: 29230 - DNA, 705 bp, Panicum virgatum
  misc_feature: Ceres CLONE 1890153
  misc_feature: Encodes the peptide sequence at SEQ ID NO. 29231
aaaaagctgaagagtgtaactgaatttgctgtagatttggagcacaatcaatataggtcatttcagggtttgacctgcttgatgcagatttcaaccagaagagaagacttcattgtggacactcttaagcttcgcatatacatcggtctctacttgcaagaaccttttaaagatccaaccaagagaaaggtaatgcatggtgtggatcgtgatataatgtggctccaacgggatttccacatctatgtatgcaatctttttgacacaggacaggcttctagggtcttacagatggagagaaacagcctagagcacctattgcttcacttttgtggagtgacagcaaagaaggaatatcaaaatgcagactggaggtcgaggccacttcctgaagaaatgatcaagtatgctagagaagatacacactatctgctgtacatatatgacttaatgaaacagagactacaaagggagtcgacacctgaaaatgatcatcttctagaggttcataagcgcagtaatgaaatttgcttacagttctatgaaaaggagctgctgacagatacatcctatctccatatatatgggttgcaggaacatgagttgaatgcaaaacagctggctgttgttgctgctctacatgggtggagagatcgtatagctcgtcaagagatgagagcactggttatgtattaccaaataatg

SEQ ID NO: 29231 - protein, 234 aa, Panicum virgatum
  misc_feature: Ceres CLONE 1890153
  misc_feature (1)..(156): Pfam Name: 3_5_exonuc Pfam Description: 3'-5' exonuclease
  misc_feature: SWISSPROT Homolog: EC 2.7.7.7 DNA-directed DNA polymerase
KKLKSVTEFAVDLEHNQYRSFQGLTCLMQISTRREDFIVDTLKLRIYIGLYLQEPFKDPTKRKVMHGVDRDIMWLQRDFHIYVCNLFDTGQASRVLQMERNSLEHLLLHFCGVTAKKEYQNADWRSRPLPEEMIKYAREDTHYLLYIYDLMKQRLQRESTPENDHLLEVHKRSNEICLQFYEKELLTDTSYLHIYGLQEHELNAKQLAVVAALHGWRDRIARQEMRALVMYYQI

SEQ ID NO: 29232 - DNA, 3063 bp, Panicum virgatum
  misc_feature: Ceres CLONE 1890188
  misc_feature: Encodes the peptide sequence at SEQ ID NO. 29233
agacacccgcgtcagagagagaagagagacgaacaccacccttcttcctcttctctctctctctctcaacatctcctgccctctatcgccggtgacatctccggcggcgctgcgtctccggcgacccccgccgccaccgctccccatttctccgatcgccgcatcaagcacggtaccccccgccttgaccccgcgcggctgcccctgccgagatccatccacccagtgtcctcggcgctccccacgcgccgatcggcgggcaggggaggccccgtggccgcgcgctcgagcgccagatccagcgatccgccttccgccgggcccggcatggacgacttccagggcctgctggcccgggacttcggtctccgcccgcaagggaaggacgcgcccatgtcggccacccggtcctcggggccttccggatccgcctgggccagcaccagatccgcctcggcgtccgcagcccccgccgcgccctcgtacgacgacctcttcgggcctgctgcgtcggccccgccgccgaccaagcccgccccgacgccgtcggcctcctttgactccatcttcgactcgtacaaggagccctcgcccgccgcgacgccgcccaagccgaagcactcgtccatgccggtgtacgacaagccggtctacgacgatgacatcttcgacggggtccctgggattaagagctcctcggcgcggtacgacgacgtgttcgggggcagccaggaccatgcgccgcctccggctttcgatgatctgcttggtgggttcgggaagaagtcacaggggagggaagaggcggaggagaagaggaagcccaagcctgctgctgcgtccactgggttcgatgatttgatcccaggatttggcgggagaagctcgccgcggcaaagggagactgttggtgcaaaagaaaagaaggtttccatgtcaacatctaagccaactgctagcatggcaagtgacccctttgttgtttttgaagcaacttcttcatcatctcatccattcactgatcccttggatgaattgggtaaacctgcaaaatatcaagggaaaagccatgaaagtactgccactgacagcagcttgtttgaggatccaagcactttcaaccagacttcaaaatcagaacctttgtttgcctcagaggtgaacaatgtaccgaaagataggaatgactcgagcagagcccgagactcaaatcctgtacaaaatttccccaaaaggaaccctgcccaacagcattctgtagaggattttgaaaatatctttcccaagtcacaatctgccagatattctgatgtccatgttgacattggcactgggaaatacagtgggaatggtgtaaatgatcagtcaccaagatctgatgaatctgaagatgagatatggcttacagtttctgagattcccctcttcacacagccaactagtgccccaccaccttcaagaccaccgccacctcttgcaattaagcaaaaacagcatggatcgaaatctaaaagaaaagatgatgagtatctgcggcggtctaggaaaaactatgatcatcaaagaagttcatcaaatagggctggtgtttcttcagtagatgaactagaagattttgcaatgggcaagtctcagaatgcacatgcttttaatgaggaagaatttgagagaagcacagcagcagcagcatctgcagctgctatgaaagaggccatggataaagctgaggcaaagttcaaacatgccaaggaagtacgagagagagaacgtgatgcaaagcttagaaatagagaacatcaggaacaagataatgaagcaaggtcgtatgcccaggatcgtgaggacaaggagagaaaggaaagactagaacaagaaagagagatggggcaaaaagaggaaaaggaaagagagcaaagaagacttgaagaagagagagaacttgagcgacagagagaaagagaaagagctaggcaagcagtggagagagctacaaaggaggcaagggaaagagcagctgctgaggctcgtgcaaaagcagaaagggaggcacgccaacgtgcggaacgtgctgcagtgcagagagctcaacaggaagcacgtgagagggctgcagtggaggctaaagagcgagcagagagagctactgcagaagcaaaggaaagggctgctgctgaagctaaggagaaagccactagtcaagccagggatagggctgcagcagaaagagctgctgtggagagagctcagcaagaagccaggaagagagctgaacgagctgcagtggaaagggctgctgctgaggctcgggaaaggcaggctgctgaggctcgggaaagacaggctgcagccacagcggctgcagctgcaagagaaaaacagagtaaaccagatgatcttgagtcattcttcggtatgggtgcccgagctaatagtgctccgaagcaaagggctccaacagtggattcaatgttcgatactcaaacgcaaaatagagggacttccacttcagcatcaatgaaaaaggcatcatcaacaacaaatattgctgatgacttgtctgcaatatttggaggagctcctacatcatcagatgaatttcaagaaattgatggggagagtgaagaaagaaggcgtgctagattggaacggcatcaaagaactcgtgaacgagcggcaaaggctttggctgagaagaatgaacgtgacatgcagcaacaacgagagcaggctgaaagacataggattgcggaaacactggactttgagattaagcggtgggctgctggaaaagaaggcaatttgcgtgcattgctgtcaactttacaatatgttctttggccagaatgtgggtggcaacctgtatcccttactgatttgatcacagccgccgctgttaaaaaagtgtacagaaaagcaacattgtgtatccatcctgacaaggtgcaacaaaagggtgcaaatctccagcagaaatatattgctgagaaggtttttgatctccttaaggaggcatggaacaaattcaactctgaagagctcttctaacaagccatgaatgaacat

SEQ ID NO: 29233 - protein, 905 aa, Panicum virgatum
  misc_feature: Ceres CLONE 1890188
  misc_feature: SWISSPROT Homolog: EC 2.7.11.1 Non-specific serine/threonine protein kinase
MDDFQGLLARDFGLRPQGKDAPMSATRSSGPSGSAWASTRSASASAAPAAPSYDDLFGPAASAPPPTKPAPTPSASFDSIFDSYKEPSPAATPPKPKHSSMPVYDKPVYDDDIFDGVPGIKSSSARYDDVFGGSQDHAPPPAFDDLLGGFGKKSQGREEAEEKRKPKPAAASTGFDDLIPGFGGRSSPRQRETVGAKEKKVSMSTSKPTASMASDPFVVFEATSSSSHPFTDPLDELGKPAKYQGKSHESTATDSSLFEDPSTFNQTSKSEPLFASEVNNVPKDRNDSSRARDSNPVQNFPKRNPAQQHSVEDFENIFPKSQSARYSDVHVDIGTGKYSGNGVNDQSPRSDESEDEIWLTVSEIPLFTQPTSAPPPSRPPPPLAIKQKQHGSKSKRKDDEYLRRSRKNYDHQRSSSNRAGVSSVDELEDFAMGKSQNAHAFNEEEFERSTAAAASAAAMKEAMDKAEAKFKHAKEVRERERDAKLRNREHQEQDNEARSYAQDREDKERKERLEQEREMGQKEEKEREQRRLEEERELERQRERERARQAVERATKEARERAAAEARAKAEREARQRAERAAVQRAQQEARERAAVEAKERAERATAEAKERAAAEAKEKATSQARDRAAAERAAVERAQQEARKRAERAAVERAAAEARERQAAEARERQAAATAAAAAREKQSKPDDLESFFGMGARANSAPKQRAPTVDSMFDTQTQNRGTSTSASMKKASSTTNIADDLSAIFGGAPTSSDEFQEIDGESEERRRARLERHQRTRERAAKALAEKNERDMQQQREQAERHRIAETLDFEIKRWAAGKEGNLRALLSTLQYVLWPECGWQPVSLTDLITAAAVKKVYRKATLCIHPDKVQQKGANLQQKYIAEKVFDLLKEAWNKFNSEELF

SEQ ID NO: 29234 - DNA, 200 bp, Panicum virgatum
  misc_feature: Ceres CLONE 1890188-R
aacagagccccaaaacgccagagccaaaacaaagaaccggcgaaggcacaggaccccaagaccaagaagaaaaacgaaagccgcagccagaagaaaaacagaggagcaggggcagccgaaccggagaaagaaaaccaggaccccgccgagcggccaggacgaaagggaacaaggaacaagaaaggcgaagacaggggaaa

SEQ ID NO: 29235 - DNA, 693 bp, Panicum virgatum
  misc_feature: Ceres CLONE 1890203
  misc_feature: Encodes the peptide sequence at SEQ ID NO. 29236
tttaattgggccggcacagcgagacctcttctaccatttttgcaggaaggaagagctgctagctccttgtgtgtgggagacaggaagagggtcgagatggctacggcgtacgctcccatggcgagccaggtgatgaagagcagcttgatgcactccaggccgagaggcctcacgaggcggccccgcttcaccgtgaaggccatccagcccgagaagccaacgtaccaggtggtgcagcccatcaacggcgaccccttcatcggcagcctggagacgcccgtcacctccagcccgctcgtcgcctggtacctctccaacctcccggcctaccgcaccgccgtgagcccgctgctccgtggcatcgaggtcggcctcgcgcacggctacctcctcgtcggccccttcgccctcaccggcccgctccgcaacacgcccgtgcacggccaggccggcgccctgggcgccgccgggctcgtcaccatcctcagcgtctgcctcaccatgtacggcgtcgcctcgttcaacgagggggacccgtccacggcgcccacgctcacgctcacgggacgcaagaaggaggccgacaagctgcagaccgctgacgggtgggccaagttcaccggaggcttcttcttcggcggcatctccggcgtgctctgggcctacttcctcctctacgtgctcgacctcccc

SEQ ID NO: 29236 - protein, 198 aa, Panicum virgatum
  misc_feature: Ceres CLONE 1890203
  misc_feature (43)..(198): Pfam Name: PsaL Pfam Description: Photosystem I reaction centre subunit XI
MATAYAPMASQVMKSSLMHSRPRGLTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGISGVLWAYFLLYVLDL

SEQ ID NO: 29237 - DNA, 617 bp, Panicum virgatum
  misc_feature: Ceres CLONE 1890249
  misc_feature: Encodes the peptide sequence at SEQ ID NO. 29238
acacattacttccttattctgcgttctccctcgcacttcctccgctcgactgacatctcctcccgtcctttcctttcgaaccctcggggatcccggcgatggccaccgccgccaccctggtgtcgggcgacgaccagctctaccagcttcgcgccgaggtcgccaagctcgaccacatcagcgagaacgacaagtccgggttcatcagcctcgtgtcgcgctacctcagtggggaggcggagcagatcgagtggagcaggatccctaccccgaccgatgaggtggtggtgccgtacgacaccctcccgtcgcctcccgaagatctcgaggagacgaagatgctgctggacaagctcgttgtgctccagcttaatggagggctcgggacgaccatgggctgcactggccccaagtctgtcattgaggtccgcaacgggttcacattccttgaccttattgtgattccaattgagtcttagaacaagaagtatggatgcagtgtccctttacttctgatgaactctttctacactcatgatgacacacggaatattgttgagaagtatgccaactccaacattgagattcacactttcaagcacagccagtatcctcgc

SEQ ID NO: 29238 - protein, 126 aa, Panicum virgatum
  misc_feature: Ceres CLONE 1890249
  misc_feature: SWISSPROT Homolog: EC 2.7.7.9 UTP--glucose-1-phosphate uridylyltransferase
MATAATLVSGDDQLYQLRAEVAKLDHISENDKSGFISLVSRYLSGEAEQIEWSRIPTPTDEVVVPYDTLPSPPEDLEETKMLLDKLVVLQLNGGLGTTMGCTGPKSVIEVRNGFTFLDLIVIPIES

SEQ ID NO: 29239 - DNA, 763 bp, Panicum virgatum
  misc_feature: Ceres CLONE 1890251
  misc_feature: Encodes the peptide sequence at SEQ ID NO. 29240
ctttttctctccgccgcactagttctccgatccggcttctgcaagcgcgccgcccctcaccgccggcttctgcccctcctccacccctgccaccgccccgcagttggagacgctcgcctcgccggaaatcatgtaccgcgccgcggggagccacctgcgctccctgaagcatctcggtgctaccaggcttgctagtacaagtgttgtgaagcagccccaaggtggtcttttcagctggcttcttgggggaaattcaagccaacttcctcccctagatgttccgctaccaggcattactattcccccacctctaccagactttgtagaaccatctaagacaaaaatcactactcttccaaatggcatcaagattgcctcggaaacgtcaccgagcccagcagtctcagtgggtctgtatattgactgtggttccatttatgaaacacccgtttcatctggagtctcccatctattggagagaatggccttcaagagcacagtaaatcgtagtcacttgcggctagttcgtgaggtagaagccattggaggaaatgtctccgcatcagcttcccgtgagcaaatgagctatacctacgatgcattgaagaactatacaccagaaatggttgaagttctcattgacagtgtgaggaatccagcatttcttgaatgggaggtcaaggagcagctccagaagatcaaatctgaaatagctgaagtgtctgttaatcctcaaggtctacttctgggaggcgcttcattc

SEQ ID NO: 29240 - protein, 210 aa, Panicum virgatum
  misc_feature: Ceres CLONE 1890251
  misc_feature (80)..(210): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHLGATRLASTSVVKQPQGGLFSWLLGGNSSQLPPLDVPLPGITIPPPLPDFVEPSKTKITTLPNGIKIASETSPSPAVSVGLYIDCGSIYETPVSSGVSHLLERMAFKSTVNRSHLRLVREVEAIGGNVSASASREQMSYTYDALKNYTPEMVEVLIDSVRNPAFLEWEVKEQLQKIKSEIAEVSVNPQGLLLGGAS

SEQ ID NO: 29241 - DNA, 1410 bp, Panicum virgatum
  misc_feature: Ceres CLONE 1890258
  misc_feature: Encodes the peptide sequence at SEQ ID NO. 29242
accctctccgcagtcccatgagccatcagccccgcccgggatccttgtcccattctgctccagcctcgccgtccgtccccgcggtctcgccggcggccgggcccccgtcgtcggtcgtcacggacgagaccgcctccaggctcacgcggtcaccggccagcgcgggcggagccacctcgcctggccgcgccgaagggcaggcgtcgcgccagagccgcccgctgccgcccccctctgccggtgccggcgggagtgcagatccatccgggctcgggttcatttccgctggtcctgccaggattctgccagtacaaatgccgatctgtagctgtgaacagacaatcaatgagtttgagacattaacacgcgatcgcgatgctggacgcgtgcagcaggatacactaagaaagatcctcgagttgaacgctgatgctgaatatctgaaccactatggcctcaatgggagggcggatgtagagagctacaaatcttgcatccccctgtgcgttcacagcgatgttgagccatatatccaaaggattgctgatggtgattcctcaccactgctcactgggaagcccgtcacttccctgtctctcagttctgggacaacacagggaaagcccaagttcttgccatttaatgatgaattgcttgagaccacacttcaaatattccagacttctcatgcatttaggaaccgtgaatatcccataggcaaaggaaaagccttgcagtttatctatggtagcaagcaagtgataacaaaaggtggcatccttgctacaactgcaacaacaaacttgtacaggaggtcacgttacaaggaagggatgaaggatatccagtctcagtgctgcagtcctgatgaagttgtttttggccctgacttccaccagtccttatattgtcacttgctctgtgggttaatatactctgacgaggtccatcaggtgttctcaacatttgctcacagcttagtccatgcatttcaaacatttgaggaggtttgggaagatttatgtgctgacataagagatggtgttctctcaaagaaagttacagtgccatcgattcgtgaagctgttacgaagatcctgaagcccaaccctgaacttgctgagtcgatccacaggaagtgtattggcttgagcaactggtatggtgtaatcccagcactctggccaaatgcaaagtatgtctacggcatcatgacaggatcaatggaaccatatcttaagaaattaagacattatgctggccacttaccactgataagcgcagactacggtgcatctgagggatggattggcgctaatataaaccccacactgccacctgaacaggtgacatatgctgtgcaccctcagactgggtatttcgagttcattcctttgggaaaaacaaaag

SEQ ID NO: 29242 - protein, 365 aa, Panicum virgatum
  misc_feature: Ceres CLONE 1890258
  misc_feature (8)..(365): Pfam Name: GH3 Pfam Description: GH3 auxin-responsive promoter
  misc_feature: Functional homolog of the protein sequence given in SEQ ID NO 50709
  misc_feature: Useful for making plants with modulated light quality sensitivity
MPICSCEQTINEFETLTRDRDAGRVQQDTLRKILELNADAEYLNHYGLNGRADVESYKSCIPLCVHSDVEPYIQRIADGDSSPLLTGKPVTSLSLSSGTTQGKPKFLPFNDELLETTLQIFQTSHAFRNREYPIGKGKALQFIYGSKQVITKGGILATTATTNLYRRSRYKEGMKDIQSQCCSPDEVVFGPDFHQSLYCHLLCGLIYSDEVHQVFSTFAHSLVHAFQTFEEVWEDLCADIRDGVLSKKVTVPSIREAVTKILKPNPELAESIHRKCIGLSNWYGVIPALWPNAKYVYGIMTGSMEPYLKKLRHYAGHLPLISADYGASEGWIGANINPTLPPEQVTYAVHPQTGYFEFIPLGKTK

SEQ ID NO: 29243 - DNA, 649 bp, Panicum virgatum
  misc_feature: Ceres CLONE 1890258-R
  misc_feature: Encodes the peptide sequence at SEQ ID NO. 29244
tcaacatcgccaagaacactgagaaagatctccaactggctgttgaggaggcaggaaagctcttggaagcggagaagctggaaattgtggattttactagctttgtggagaagtctagtgatcccggtcgctatgtcatcttctgggagctgagctctgatgcgagcgaggatgtcttacgaagctgtgcaaattgcttggatctagcctttgttgatgcgggctacgtgggttcaaggaagattaggaccattggcccccttgagctacggattcttaagaagggaacctttgaggagatcctagattacttcctgagccttggtggtgctgtgagtcagttcaagacgcctcgattcgtcaacccgttgaacatcaaggtactgcagatactaagtaggaacaccaccaaaagttacttcagtaccgcctatgggctgtgacaaaaaaggaaatgctgctagttccatgtaattatcttttcttccatgttctgttttagtcttcagataaagaaaacaatctgttttagtctcttgccataatactacatattctagtgctgctggtggctagaatctctgtaaatccacatgcagttgtaccaagaggtatcagaaaaagtgaagttgctgcatccttcctgtct

SEQ ID NO: 29244 - protein, 146 aa, Panicum virgatum
  misc_feature: Ceres CLONE 1890258-R
  misc_feature: Functional homolog of the protein sequence given in SEQ ID NO 51062
  misc_feature: Useful for making plants with modulated light quality sensitivity
NIAKNTEKDLQLAVEEAGKLLEAEKLEIVDFTSFVEKSSDPGRYVIFWELSSDASEDVLRSCANCLDLAFVDAGYVGSRKIRTIGPLELRILKKGTFEEILDYFLSLGGAVSQFKTPRFVNPLNIKVLQILSRNTTKSYFSTAYGL

SEQ ID NO: 29245 - DNA, 672 bp, Panicum virgatum
  misc_feature: Ceres CLONE 1890259
  misc_feature: Encodes the peptide sequence at SEQ ID NO. 29246
cccttctctcgcactctctcatcccttgctctaccttccccggcggcggcggcggcggcggcgactgggcgagcggcggctccatttattctatcttcgcccagccctttgctggcgatgagcgcatcctccagaatggaggagtccgatggggaggatattggtgttccagaagttggtatggtgttcaataatcacacagaagtcaaccgattttaccgcaagtatgctcgtcgtgttggctttggtgtctctgtaaggaggtcctcattttcacaagaaggaacctgcttatatctcgagcttatgtgctgcaaaggagggcggccgcgttatgagccaaagttccggaaacgggcctcatcgaccactaactgcccagccaagattcgagtgaagttgtggggagacaaattgttgcatgtagagttggtgatccttgatcacaatcatccagtgagcccagcaatggcaagattcttgaactcttataagcagctctctggccctgcaaagaggcggttacgtatgggtggccctggggctatgcctgttgaagagccaagtaagatgcccatgaataagttgggggaacttgaggagcttttgtttggtgagagcaagcaccacagttttgtggagaggggtcgtttgaagctccaacctggagat

SEQ ID NO: 29246 - protein, 178 aa, Panicum virgatum
  misc_feature: Ceres CLONE 1890259
  misc_feature (26)..(110): Pfam Name: FAR1 Pfam Description: FAR1 family
MEESDGEDIGVPEVGMVFNNHTEVNRFYRKYARRVGFGVSVRRSSFSQEGTCLYLELMCCKGGRPRYEPKFRKRASSTTNCPAKIRVKLWGDKLLHVELVILDHNHPVSPAMARFLNSYKQLSGPAKRRLRMGGPGAMPVEEPSKMPMNKLGELEELLFGESKHHSFVERGRLKLQPG

SEQ ID NO: 29247 - DNA, 2964 bp, Panicum virgatum
  misc_feature: Ceres CLONE 1890261
  misc_feature: Encodes the peptide sequence at SEQ ID NO. 29248
ctcgtctcctcgcgctgtctgtctgtcggcggagcgtggccggcgctactcggctccctcctgcccgcgcggccgccgacgccgccggagcccgcgctgctgacactgcttgctcccgcccgcagctggcgaagcgccacacccacctgccagcggctggcggagcacgccccgcggctgctcggctcccggcacacggccggcggagcgcggctcccttcgcggccagccgcctacccgtgcccgcggcgctgtcgggcagtaatctcgcggccgcctcaatccgccgctgctgattcccattcgccgcctccgctttcgcgtcctcgcccgtgccgcgggacctcgccgacgacccaccttttcgcgatgctctctccatggcgttctctcctctccccgaccgcacctcctgccactgagatacgggcaccgctgcgtccaccaaaccgctacctgcgctccccgcttcgatcaccaccaccacgttccgtggcgcgaaccgcccccacgctctccgccaccacgacggctgtctcctcgccgccctctccaaagaagaaggttctcgtgcccatcgccatgggcacggaggagatggaggcggtcgtcctcgccggcgtcctccggcgagccggcgccgacgtgacgctggcctccgtcgaggacggcctcgaagtggaggcgtcctgcggctcccgcatcgtcgcggacacgcacattgcctcctgcgccgaccaggtgttcgaccttgtggctcttccgggaggaatgcctggttcagtgcggttgagagacagtgatatccttcagagtatcacagttcgtcaggctgaggagaaaagactgtacggtgctatatgtgctgcgcctgcagttgttctaatgccgtggggtctccacaagcgaaaaaagatcacctgtcacccatcttttataggagatctccctacattccgagctgttgaatcaaacgttcaggtttcaggagagcttactacaagtcgtgggccagggacatcattccagtttgctttatcatttgttgagcaaatgtttgggcctcatgcagccgaagatgtggacagaattttggtttgtcagaagaaactttaatatctatgttatttcacataatagacttaaaatatcttaatgttttagctgatgagagaaccgaacaacagctcagttggcattcccaccaattgaaggtcggcacaccccaggcttaaagccaggtgcttgcaggctgtgtgtatacctccctaaaggttccgtactcccatctcttaggacaaagggggacaatcttctccctgtgtcgagtttctttatcttttagatgattataggcactcctgttcaaggataaatctttgggcacattccatccttgcaattctccttttattgcctcctccaatgtcaatttcggccttcccctgagcactcgttcaactagcccttcgtgctggttaatgagctgcgacttttcttttcgcagaacttgaccgttgctgaactactgtaatttcgttgctctaagtaacgatatttgggctcaccccgctatgaaaaaaaaattcggccttcccctgcctactggctaaactaaaaaaattaaagatacataattttttttcttaaattcagtttgttcgggcccactggcaactcaaactactcagtttcggtttattagtgttgatgtttttttgtattacactacagatgacacaaattgacggcgattttgaaaggagtgcagaggtcaatgaacttgagtggtgtattgatcgcaatcctcgtgttcttattccaatcgcaaatgggtctgaagagatggagatcataattctggttgatattttaagacgtgcaaatataaatgtggtattggcatcagttgaaaaatctccaggtattgttggatctcaaaggatgaagattgttgctgataaaagcatcacgagtgcctccaattcaaaatacgacctaatcattcttcctggaggaactgctggagttgagcggttgcacaggtcaagaattttgaagaagttactcaaagaacaaaagcaagctggcaggatgtatggtggggtctgttcttctctgaaggtcttgcagctgcaaggtttacttgaggataaaatagtggcagcttgtcctgctgtagccaatgagcttacatgcaaaattgttgaacgatcaaataatgtgatcgacggaaatttgattactgggaaggggattgggacagttgttgattttgccctaggtatcatcaggaaattttttggccatggacgagccaaaagtgtggcaaatggaatagttttcgagtaccctaagagctaaagcaccaagaatttgctgaaaatacgagatgcacaaacatttatggttgtaatcaaagatctggctatctatgctccagataaaaggtgaactgatgcttttgggactgcaagagtcctcctttctggacagctggactgaaatctccagatccactatatatgttgggatggacaaaattacactaagaagcttcagtggaagtcatttcattgtcttgttgatatgatttgttggcggataaatgacacagagtgattgcaaactgattatgtgcattcagaggaaactttactgtcttcagtgtgcctgtattggtctgggaacacatttcctgaggtctgaagcccttagatgttgctatatacaatctgtggattcatctgaaaagcttatccaactctgggactttcccagatactgggtttcaggagtgcaagctaactgaatcaacatttgcttaaattggcacttgtgcattgctgttttttttttatcagaagtcagtttgacctcactgtgtgtgttaccgattttattagaagcagttttgatcttttgtactgatggattgtgcttttcaattcatggttcaatgtc

SEQ ID NO: 29248 - protein, 248 aa, Panicum virgatum
  misc_feature: Ceres CLONE 1890261
  misc_feature (92)..(230): Pfam Name: DJ-1_PfpI Pfam Description: DJ-1/PfpI family
MLSPWRSLLSPTAPPATEIRAPLRPPNRYLRSPLRSPPPRSVARTAPTLSATTTAVSSPPSPKKKVLVPIAMGTEEMEAVVLAGVLRRAGADVTLASVEDGLEVEASCGSRIVADTHIASCADQVFDLVALPGGMPGSVRLRDSDILQSITVRQAEEKRLYGAICAAPAVVLMPWGLHKRKKITCHPSFIGDLPTFRAVESNVQVSGELTTSRGPGTSFQFALSFVEQMFGPHAAEDVDRILVCQKKL

SEQ ID NO: 29249 - DNA, 714 bp, Panicum virgatum
  misc_feature: Ceres CLONE 1890267
  misc_feature: Encodes the peptide sequence at SEQ ID NO. 29250
accacatcagagcaagccggcagccatgggaagcttcaagctatccttgctccgcaattttctcattcccttccttctccttgcttcaaccgttgccgaggagctcacagccggcgacggtgtaccccggacgttcatcgaactccccgccggcgaagacgagctccgaacgttcatcgtgcacgtgcagccgcccgagaaccacgtgttcggcaccgccgacgaccgcacggcgtggtaccagtcgttcctcccggaggacggccggctactccacgcgtaccaccacgtcgccagcggcttcgccgcccggctgacgcgccgggagctggaggccatgtccgccgcggcggggttcctctgggcgcagccgagcggggtataccagctgctgacgacgtacacgcctaggttcctcggcctcgacgtgccgcgcggcgcgaacccggggaaccatagcgcctcagggttcggcgacggcgtcatcgtcggcgtccccgacagcggcgtgttcccctaccacccgtcgtacagcggcgacggcatgccgccgccgccggcgaggtggaaggagcgctgcgacttcagcggctcggcgtgcaataacaagctcataggcgcgcagtcattcgagtccgacccgtcgccgctcgacgagaccgggcacggcacgcacacgtcgagcaccgcggcggggggctctcgtgcccggcg

SEQ ID NO: 29250 - protein, 229 aa, Panicum virgatum
  misc_feature: Ceres CLONE 1890267
  misc_feature (48)..(123): Pfam Name: Subtilisin_N Pfam Description: Subtilisin N-terminal Region
  misc_feature: SWISSPROT Homolog: EC 3.4.21.25 Cucumisin
MGSFKLSLLRNFLIPFLLLASTVAEELTAGDGVPRTFIELPAGEDELRTFIVHVQPPENHVFGTADDRTAWYQSFLPEDGRLLHAYHHVASGFAARLTRRELEAMSAAAGFLWAQPSGVYQLLTTYTPRFLGLDVPRGANPGNHSASGFGDGVIVGVPDSGVFPYHPSYSGDGMPPPPARWKERCDFSGSACNNKLIGAQSFESDPSPLDETGHGTHTSSTAAGGSRAR

SEQ ID NO: 29251 - DNA, 106 bp, Panicum virgatum
  misc_feature: Ceres CLONE 1890267-R
cacggggcccgggccgcgagggcagaggggaacggcgaagggggggcagggcgcgccccggggggggcccgacaggcacaccgccagaagccccaaacccaccacg

SEQ ID NO: 29252 - DNA, 719 bp, Panicum virgatum
  misc_feature: Ceres CLONE 1890268
  misc_feature: Encodes the peptide sequence at SEQ ID NO. 29253
atcttcacttctgggacaggtgacctcccccctctcatctgcggcgtccgcggcgagcgagcaagtagcggcggcggcggccagacggcgtcacagagaggacgcacgccatatgttcgacggaatgcggcttccgaagcggggcaagaacggcgaggcgtccaccgcgtggagcggcgcggacctcatcagcggcctgccggagggcgtcctccaccacgtgctgtctctcctcccggcacacgacgcggtgcggacgtgcgtgctcgcgcggcgctggcgccacctctggagatccgcgcctgggatccgcatcaccggcgtcaaggggtggcgcgacgccggccggttcgtcgccttcgtggacagcctgctgagcctccgccgcggcggcgcggcgccagtggagtcgtgcaagatgaagttcgacgcgggcgacttcgacttcgactacttcctgcttgccgagaagcagcacgtgagccactggatcatggatgccgtgcgcctggatgtccaggtgttgctgttatcctttgctgaattggaaagcttcatcctgcctgatcttcatctcgactgccagcacctcgtgaggctagagctttcctgcgttgatgccaacgacagcattcttgatttttcaggctgtcccgcattggtagttctgaggatgaagtactgctttcataatgctggcaaactgttatctgcatcct

SEQ ID NO: 29253 - protein, 202 aa, Panicum virgatum
  misc_feature: Ceres CLONE 1890268
  misc_feature (24)..(71): Pfam Name: F-box Pfam Description: F-box domain
MFDGMRLPKRGKNGEASTAWSGADLISGLPEGVLHHVLSLLPAHDAVRTCVLARRWRHLWRSAPGIRITGVKGWRDAGRFVAFVDSLLSLRRGGAAPVESCKMKFDAGDFDFDYFLLAEKQHVSHWIMDAVRLDVQVLLLSFAELESFILPDLHLDCQHLVRLELSCVDANDSILDFSGCPALVVLRMKYCFHNAGKLLSAS

SEQ ID NO: 29254 - DNA, 2217 bp, Panicum virgatum
  misc_feature: Ceres CLONE 1890270
  misc_feature: Encodes the peptide sequence at SEQ ID NO. 29255
gacgctccggtggcggcatccccttcgtcgtcatcgtcgcgcggcgcccgattggctgagcaccagcctcagtcccggcctcccaatggcgtggtgagagtgagagaaccccctcccctacccttgctgtcgactcgtctcgtcccctccagggggggaagaagatgagctgctcctcctgctgcgccgccgccgccgttccgtctcccccggtggttctctccatgccgcgggtgaggttcactgcttcctgctccacaagaacaggccataaggtgcttttcttcggttccagacagtttccaagcatcacatacaacccatcaagccgtgcgtcgtcacggttgtcgcggagagaggtaatagcttttgccgggcaacagtcttgggacatcggcagatttgtcaggactttgtacttcttcaacggccccccaaaccctctgaagattgtagagtccatcattagcagtatcactggctctgcttctagcgaagcgccgaagaaaatggaaacatcggatgtggtgctggtcactggagccactggtggtgttgggcgccgggtggtcgacatcttgcggaagaagggcgtacccgttcgagtattggctagaaatgaagataaggcaaggagcatgttggggcgtgacatagatttgatcataggagatgttacaaaggaagatacactcgatcctaagctcttcgaaggggtcaggaaagtagtgaacgctgtatctgtcatagtaggaccaaaggaaggtgatacaccagatagacagaagtacaaacaaggcatcaagttttttgaacctgagatcaagggaccttcacctgaaatggtagagtacatcggaatgcaaaacttgattaatgccataaagaacagtgttggactaagtgaagggaaacttctatttgggcttaaaggcaacttatctggaaagattgtgtggggagctcttgatgatgttgtaatgggtggtgttagtgaaagtacttttcaaatcctaccaacaggaagtgaaactggtgggccaactgggttgttcaaaggtactgtatctacttcaaataatggtgggtttactagtataaggacaaagaatttcactgtgccagaggacctgtcagcatacgatggtattgaattacgagttaaaggtgatgggcgacggtataaactcattattcggacaagctatgaatgggatactgttggctatacagaaagctttgacacaaccaagggagaatggcaaagtgttaaaatacctttctcttctctgaaacctgtatttcgtgctcgtactatgactgatgctccacccttcgatgcaagcaacattacttcactgcagcttatgttcagcaagtttgaatatgatggaaaactcaacccaacatttaatgaaggtccattcgagcttcctttttcaagtattagagcatacatcaatgagccgatcactccaaggttcgttcatgtgagttccgcaggagttacaaggcctgaaagaccgggtctagatttaagcaagcaaccgcctgctgttcgcttgaacaaagagcttggctccatcttaacttataagttgaagggagaggatttaattagggaaagtggtgttccgtacactattgtgcgaccatgtgcattaactgaggaaccagctggagcagatctcatatttgaccagggggacaatatcacagggaagatatcaagggaagaagttgcccgcatttgtgtagcggctctggcaagcccaaacgctgtggggaaaactttcgaggtcaagagcactgtcccattcagcgaaccatatgtgattgacccttcaaatccccctcctgaaaaggactatgaagtgtacttcaaagaactaaaagaacgcatcacgggtaaagaggcactggaagctacacctgctcaggtctgaagaatcgctgcatgaagaatgccatctgcttttggtgaaatttgacgtggtaaccctccactccccatggtgattttaataccaaaggggggatcctctgttaaagaagatgctttcgatatggaatgtgaaatgagaaggcaatggctaccatgcatgtatatgaagagaaacgtgagtcgcatagaattgtgggtgacacttggatggtaaatctaggatatgaatctatagggcagatctatgtatctgtatttttattgtttcacaa

SEQ ID NO: 29255 - protein, 573 aa, Panicum virgatum
  misc_feature: Ceres CLONE 1890270
  misc_feature (231)..(410): Pfam Name: CIA30 Pfam Description: Complex I intermediate-associated protein 30 (CIA30)
MPRVRFTASCSTRTGHKVLFFGSRQFPSITYNPSSRASSRLSRREVIAFAGQQSWDIGRFVRTLYFFNGPPNPLKIVESIISSITGSASSEAPKKMETSDVVLVTGATGGVGRRVVDILRKKGVPVRVLARNEDKARSMLGRDIDLIIGDVTKEDTLDPKLFEGVRKVVNAVSVIVGPKEGDTPDRQKYKQGIKFFEPEIKGPSPEMVEYIGMQNLINAIKNSVGLSEGKLLFGLKGNLSGKIVWGALDDVVMGGVSESTFQILPTGSETGGPTGLFKGTVSTSNNGGFTSIRTKNFTVPEDLSAYDGIELRVKGDGRRYKLIIRTSYEWDTVGYTESFDTTKGEWQSVKIPFSSLKPVFRARTMTDAPPFDASNITSLQLMFSKFEYDGKLNPTFNEGPFELPFSSIRAYINEPITPRFVHVSSAGVTRPERPGLDLSKQPPAVRLNKELGSILTYKLKGEDLIRESGVPYTIVRPCALTEEPAGADLIFDQGDNITGKISREEVARICVAALASPNAVGKTFEVKSTVPFSEPYVIDPSNPPPEKDYEVYFKELKERITGKEALEATPAQV

SEQ ID NO: 29256 - DNA, 2165 bp, Panicum virgatum
  misc_feature: Ceres CLONE 1890297
  misc_feature: Encodes the peptide sequence at SEQ ID NO. 29257
ctccgacttccgagtccagctctctcccccccgaattgaaatcctcctcctccccgcctagggtttcgctacctccaccccgccgtccgagcatcctctacccagccggcggccgcggccgcggccgccgccacctcctcctctcggcgcccggagacttcccctaccgccgccgcccgtctcggttgcctgctcggccgcgccacggccgccccgccctgacccgaggtcgttcgtggcaccaagagtgccaagagtggaacagcgaaatttctaagtgaagaataaggcgggtttgaagctatctgctgttgttgcttccatggcaaccaatgagaacctcccaccaaatgttatcaggcaattggctaaagaactgaagaatcttgatgagtcaccttcagaagggattaacgtgattgtcaatgatgatgacttcaccactatttttgctgacattgaaggccctgctggaactccatatgagaatggagtgttcaggatgaagctattattgtcttgcgacttccctcaatctcccccaaaaggattcttcttgacaaaaattttccatccgaatatagctactagtggtgagatttgtgtaaacacactgaagaaggattggaatcctggccttggattaagacacgttcttctggtagtgcggtgccttctgattgaaccgtttccggaatctgcgctgaatgaacaagctgggaaaatgttacttgaaaattatgaggaatatgcacggcatgcaaggttatacactggcatccatgcacttaaacctaagaataagtccaagactggagctatttctgagtcgaccacagctttgaatgtggacaagtcaagtactgcttccatcgagaacacaccaatgccaccagcagtatctacatccacttcatccagagcatttggcacaagcttgcaggatcagaacccaactgtttctgaccctgccgtaggagctgcagcagcacgaaagaaggatggcccaatggcctccaaagctcctcttgataagaagaagatggatgcgcggaagaagagcttgaagagattataggcgaaaacatcccgggaaaaggattcaaatttgttcgcatgccgccgagttcagcagatgcttagtgaaactggggggcaaaaataagtggggagacatctgatgatctggctttcgggacaagaggggggaagggggcggggccagaaaggaataatgtgaactgggtccttcgggacaactgtattatgtgcaatttccaatcattcggaagaccaaaaaaaaaaaaaaaacaggagcagtgctggacagcgaggctcgccccggcggccctccggaggcagcgctcgtcgcggcggggccccggcggagcggagccccccggcggccaggctcggcgcggcggccgcagagggccccggcgaactggcgaacgggcggcgcgtggcggcggctggagctgcggcggctgcggcatcgcgcagccgcggacgcggcgacgctggcggcgggggctggagctgcggcgggggtggcgcgaggccgcccggcggcagccctgaggcccctggcagcggtgctcggcgcggcgaccgtggagggccccggcggccaggcggacgggcggcgcacggcgggggctggagctgcggcggccgcggcatcgcgcggccgcggacgcggcgacgcgggcggcgggaggcggcgcggaggcccccggcggcgcgcggccgggccgcggacgcggcggcgcgcggcgggggctggagctgcggcggcgggcggtgacacgcgcggcgagcggcggcgctcttctgggagctgcacgcttgacctttttttattttttaaatcaattacttggggcggataatggggtgacccacctctagaaatcgatttctaagtacgggtgaatgggtgatggggtgacccgactctggaaatacatttttaggggcagacgccgcacccgcccctgctttccgcagctatatttttagctgcggaaagtaggggcgggtgcagcgtccgtgccctaaaaatgctatttcacccgcctctagaaacctttttttttttgctgtagtggaggttgctcgaccccttaaattttgctaaattcaatagaaaatactgttcatcc

SEQ ID NO: 29257 - protein, 251 aa, Panicum virgatum
  misc_feature: Ceres CLONE 1890297
  misc_feature (14)..(151): Pfam Name: UQ_con Pfam Description: Ubiquitin-conjugating enzyme
  misc_feature: SWISSPROT Homolog: EC 6.3.2.19 Ubiquitin--protein ligase
MATNENLPPNVIRQLAKELKNLDESPSEGINVIVNDDDFTTIFADIEGPAGTPYENGVFRMKLLLSCDFPQSPPKGFFLTKIFHPNIATSGEICVNTLKKDWNPGLGLRHVLLVVRCLLIEPFPESALNEQAGKMLLENYEEYARHARLYTGIHALKPKNKSKTGAISESTTALNVDKSSTASIENTPMPPAVSTSTSSRAFGTSLQDQNPTVSDPAVGAAAARKKDGPMASKAPLDKKKMDARKKSLKRL

SEQ ID NO: 29258 - DNA, 719 bp, Panicum virgatum
  misc_feature: Ceres CLONE 1890299
  misc_feature: Encodes the peptide sequence at SEQ ID NO. 29259
gccctcttgcttgctctcccccctcccctccacaccgcgcaatgccttggcgtcggcagagcgcgcgtccatccaggccgtagcgtgcgtgtcctacccgtccgtcccctgggcgcggcccagaatgggcgcgcccgtgcagctactgctggtgctggccgccgtcgcctgcgcggccgcggagccgccgcagcaggagcggtcggcgctgcaggcgttcctcgcgggcacgccgcacgagcgcgcgctgggctggaacgcgtccgtgccggcctgcgcctggaccggcgtccggtgcgacgctgccaacgccacggtcgtcgagctccacctcccgggcatcggcctcatcggcggcgtgccgccgggcacgctcggggggctgcgggcactcgaggtcctctcgctgcgcgacaaccgcctcctcggcgacatcccccgtgacctcctcggcctcccgcggctccgctcgttgtacctgcagggcaacctgctcaccggcgccatccccgccgaggtcggccggctcgcctcgctcgagcacctcgcgctgtcccgcaacaacctcaccggcgccgtcccgtcggcgctcagcaacctgacgaggctccagtcgctgaggcttgacgcgaaccgcctctccggcagcctcccgagcctcagcttccgccggctcgaggtgttcaacgtctcctacaacgacctcaacggctccatcc

SEQ ID NO: 29259 - protein, 198 aa, Panicum virgatum
  misc_feature: Ceres CLONE 1890299
  misc_feature (22)..(59): Pfam Name: LRRNT_2 Pfam Description: Leucine rich repeat N-terminal domain
  misc_feature: SWISSPROT Homolog: EC 2.7.11.1 Non-specific serine/threonine protein kinase
MGAPVQLLLVLAAVACAAAEPPQQERSALQAFLAGTPHERALGWNASVPACAWTGVRCDAANATVVELHLPGIGLIGGVPPGTLGGLRALEVLSLRDNRLLGDIPRDLLGLPRLRSLYLQGNLLTGAIPAEVGRLASLEHLALSRNNLTGAVPSALSNLTRLQSLRLDANRLSGSLPSLSFRRLEVFNVSYNDLNGSI

SEQ ID NO: 29260 - DNA, 723 bp, Panicum virgatum
  misc_feature: Ceres CLONE 1890308
  misc_feature: Encodes the peptide sequence at SEQ ID NO. 29261
cccctgtcccgcggctcacctcacctcacctcactccaccctcgttcgttggctgcctccccccaccccccccccccttccgcgcgcagaccgagggggcggcggcgatggggaagaacatgcgcatcaagacggcgcccaaggccaaccgcgtccccctcctcggcgacggggtggacgctctatctctccccctctccgcctcgcagcgcggcggcggcttgctattcgagtttggtttctgattgcgtgcgctggtgcgtgcaggagacgtcgagggcgctctccgacctggaggagggcagcaacgtccagccagcgaacgtcgggttctgtcgagttatcaagttggccaagcaggacaccgggaagctggtcctcgccaccatagcgctgcttgtagcctccctcagcaacattctcgttccgaaatatggtggcaagataattgacattgtgtcaagagatgttcggcgcccagaagataaggctcaagccttggaggacgtgaagggcacaatcttgtacattgtgataatcgttgtagtcggttcagtttgcacggctcttcgggcatggctattcaattctgctagtgagagagtagtcgctcgacttaggaaggacttgttcagtcatctcataaaccaggaaatagcgtttttttgatgtgactaggacaggagagctcttaagcaagctttctggagatacacagataat

SEQ ID NO: 29261 - protein, 222 aa, Panicum virgatum
  misc_feature: Ceres CLONE 1890308
  misc_feature: SWISSPROT Homolog: EC 3.6.3.44 Xenobiotic-transporting ATPase
PLSRGSPHLTSLHPRSLAASPHPPPPSARRPRGRRRWGRTCASRRRPRPTASPSSATGWTLYLSPSPPRSAAAACYSSLVSDCVRWCVQETSRALSDLEEGSNVQPANVGFCRVIKLAKQDTGKLVLATIALLVASLSNILVPKYGGKIIDIVSRDVRRPEDKAQALEDVKGTILYIVIIVVVGSVCTALRAWLFNSASERVVARLRKDLFSHLINQEIAFF

SEQ ID NO: 29262 - DNA, 675 bp, Panicum virgatum
  misc_feature: Ceres CLONE 1890310
  misc_feature: Encodes the peptide sequence at SEQ ID NO. 29263
taacaacactaactagtatcacactgtctagtgaaacaagttctcgccaaggaacacgcataagattttggcctgataaagatatatttaccaccacgatcagttttgactttaatacaatctctagtcgcatccgagagcttgcctttctaaatcctgagctgacaataaccttgactaaggaagaagggcacacagaggttcaacataatgaatactgctatgctggtggccttgttgagtatgttaaatggttgaatactgataagaaacccctgcatgacctgattgcgttcagaaaggagttggacggtataacagtggatgtctcccttcaatggtgttctgattcctactctgatacagtgctaggatatgcaaacagtatccgtactattgacggcggtactcatattgatggtctgaaggcttcattgactagaacaattaataaccttgcaaagaagtcgaagagtattaaggataaggatattaccttgagtggggagcatgtaagagaaggaatgacgtgcatcatttcagtgaaggtccctagtccagaatttgaaggtcaaacgaagacaaggttgggaaatccagaagtacggagaatagttgaacaatctgttcaagaaaacttaacagagtacttagagctccatccagatgttctcg

SEQ ID NO: 29263 - protein, 224 aa, Panicum virgatum
  misc_feature: Ceres CLONE 1890310
  misc_feature (77)..(224): Pfam Name: DNA_gyraseB Pfam Description: DNA gyrase B
  misc_feature: SWISSPROT Homolog: EC 5.99.1.3 DNA topoisomerase (ATP-hydrolyzing)
TTLTSITLSSETSSRQGTRIRFWPDKDIFTTTISFDFNTISSRIRELAFLNPELTITLTKEEGHTEVQHNEYCYAGGLVEYVKWLNTDKKPLHDLIAFRKELDGITVDVSLQWCSDSYSDTVLGYANSIRTIDGGTHIDGLKASLTRTINNLAKKSKSIKDKDITLSGEHVREGMTCIISVKVPSPEFEGQTKTRLGNPEVRRIVEQSVQENLTEYLELHPDVL

SEQ ID NO: 29264 - DNA, 2122 bp, Panicum virgatum
  misc_feature: Ceres CLONE 1890359
  misc_feature: Encodes the peptide sequence at SEQ ID NO. 29265
aaaatttcccactccactcgaattagaaccctagcggcaaaaacctcggtccgcgccgccgcctgctcctcccgtcccgccgccggcgccaccgcccgcttccgccgaggggctcgccgtccggggcgctctcgcgcggcgctgcgcctctccacgcgccgccgtcctcggctgccatgatctgcccgagtaaacgccctcccctctctgcctcccgcatctccgccccgtaaccctagcttgcctgatccgtcgcctcgtgagctaaatcgtcccgtgtcgcttctccgcagtctccggcgaggtgccggccgagccggtggtgtccaagaagtcggggctcctcttcgagcggcggctcatcgagcgctacattgaggaccatggcaagtgtccggtcaccaaggaggagctcaccatggacgatatcgtgccggtcaagaccaacaaggttgtgaagccgaggcctttgcagtctgcaagcattccaggacttcttgggatatttcaaaacgagtgggatgctctcatgctttctaattttgctttggagcagcagcttcacacagcaagacaagaacttagtcatgcactctatcagcatgatgctgcctgccgtgttatagccagattaaagaaggaaagagatgaggcaagaacacttttggcccaagctgagagacagattcctgcatcacttgcaggagctgctcctgcaactgtagtttccaacggaaaaagagcaatggaagatgaaattggccctgatggcaagaagattcgtcctggtatcaaccctgtcatgatcgaagaacttacagaatgcaataccatgctttccgcacagcgtaagaaaagacaggtcccgccaactctggcgccgatcgatgcacttgagagttatactcagatcagcagtcatccccttcataagacaaacaaaccaggcattttgtccatggacattcatccttcaaaggacattgttgcaactgggggtattgatacaaatgcagtactgtttgatcgaccgtctggtcaaatcttgtgcacgcttactggtcactcaaagaagataaccactttgaagtttgttccacgtgatgaactctttgtaactgggtctgcagataagactgtacgcatttggcgagagagcgagaatgggaactataactgcatccatacattgaaagatcatactgctgaggttgaagctgttacagtccatgcaactcaaaagtatttcgtgactgcttccaaggataactcctggtgcttctatgatatttcgacaggatcttgcctcacacaggttggcgaggcttcaggacaagagggatatacttctgcatcgttccatccggatggtcttatccttggaactggaaccactgatggtgttgttaaaatttgggatgtgaagactcagtcaaaggctgcaacgttcgaggggcatgttggaccagtcactgctatgtccttctctgaaaatggttacttcctagcaaccgctgctcacgatggtgtcaagctttgggatctccggaaattaagaaattttaggaccttatctccttatgattcagacacaccgaccaatgctgtggaattcgattttaccggaaactatcttgcacttggtggttcagatataagggtttaccaagtagctaatgtcaaggttgaatggaatcttatcaagacattaccagacttatcaggaacaggtaaagtaacatctgtgaagttcggagccgatgctaagtacattgccgtaggttctatggaccgcaacctacggatatttggactccctggagatgaccaaatggaggaatcgaatacagccgagtgaggaaaaccattgtacttgatttatttctttttgcgatgctcctggtgtcatttgatgagggcagcgtgcgcatggatacatcaccactacaagagggaaggaagatcctcgcagggagcagtggtctcggcatcggtcagtgtaaacaagcttgtgacattattgtattgtagggcttactaattcgtctgatgaggatatgatttgttctattttgaacacgagtacgatgctaaagttctcttgcggagatttaagcgattc

SEQ ID NO: 29265 - protein, 479 aa, Panicum virgatum
  misc_feature: Ceres CLONE 1890359
  misc_feature (207)..(245): Pfam Name: WD40 Pfam Description: WD domain, G-beta repeat
  misc_feature (252)..(290): Pfam Name: WD40 Pfam Description: WD domain, G-beta repeat
  misc_feature (338)..(375): Pfam Name: WD40 Pfam Description: WD domain, G-beta repeat
  misc_feature (18)..(87): Pfam Name: Prp19 Pfam Description: Prp19/Pso4-like
  misc_feature: SWISSPROT Homolog: EC 2.7.11.7 [Myosin heavy-chain] kinase
MDDIVPVKTNKVVKPRPLQSASIPGLLGIFQNEWDALMLSNFALEQQLHTARQELSHALYQHDAACRVIARLKKERDEARTLLAQAERQIPASLAGAAPATVVSNGKRAMEDEIGPDGKKIRPGINPVMIEELTECNTMLSAQRKKRQVPPTLAPIDALESYTQISSHPLHKTNKPGILSMDIHPSKDIVATGGIDTNAVLFDRPSGQILCTLTGHSKKITTLKFVPRDELFVTGSADKTVRIWRESENGNYNCIHTLKDHTAEVEAVTVHATQKYFVTASKDNSWCFYDISTGSCLTQVGEASGQEGYTSASFHPDGLILGTGTTDGVVKIWDVKTQSKAATFEGHVGPVTAMSFSENGYFLATAAHDGVKLWDLRKLRNFRTLSPYDSDTPTNAVEFDFTGNYLALGGSDIRVYQVANVKVEWNLIKTLPDLSGTGKVTSVKFGADAKYIAVGSMDRNLRIFGLPGDDQMEESNTAE

SEQ ID NO: 29266 - DNA, 691 bp, Panicum virgatum
  misc_feature: Ceres CLONE 1890362
  misc_feature: Encodes the peptide sequence at SEQ ID NO. 29267
agcgaaaatacagtgtagcccggcgactgggcttctagtgggccggcccagcccgaacagctctcctgctcggcgctgtgctgtcctttccaatccccccccgtgtcatcgccgtcgacggagacgagggtttaggcacctcctccccgcgccggcgtctcccccccgctggagcctctcttccctcgcgcagcaggctcaacccgcagcgctcgggcgatccatggagcctgcggaggccacgtggaagagggcccgcccgtgcagctgccgcggcggcggcgggggctctgaccgactgagcgccctgccggactgcctcctacacgtcatcatgtcctccctcaaggcccggcaggcggtgcagacgtgtgtgctgtccaggcgatggagggacctctggcgctcggtgccatgcctcgacgtcgacatcaacgagttcagggccaacacggcggcgcctgatctcaaccaggacgccggctcgggtggcgacggcatccctcgctccagtgacgacgccggctcgggtggcgacagcatccctggctccagtgacgacagcactagctctgactacagcagctctagctcggagagcgacgactgctctgactcggatagcaacaacagctatgactcgttcatgatgcagttgatgccctcgccctactactcctcagatgtcgac

SEQ ID NO: 29267 - protein, 155 aa, Panicum virgatum
  misc_feature: Ceres CLONE 1890362
  misc_feature (24)..(71): Pfam Name: F-box Pfam Description: F-box domain
MEPAEATWKRARPCSCRGGGGGSDRLSALPDCLLHVIMSSLKARQAVQTCVLSRRWRDLWRSVPCLDVDINEFRANTAAPDLNQDAGSGGDGIPRSSDDAGSGGDSIPGSSDDSTSSDYSSSSSESDDCSDSDSNNSYDSFMMQLMPSPYYSSDV

SEQ ID NO: 29268 - DNA, 730 bp, Panicum virgatum
  misc_feature: Ceres CLONE 1890370
  misc_feature: Encodes the peptide sequence at SEQ ID NO. 29269
aaccacacatgcatcttctacaacaaacccaggtgtgcttcggcagtaaacattcggttcttggttagcctccattgccattgctctctgctcgatctctagcagactcggatccattggcaagcatggagcagctcacgtactacctgctggcgctccttctccctctcctgcttctcaagctcatcgcgaggcgcgacggcaatggcatgaggctgccgccgggcccgtggcagctgccggtcatcggcagcctccaccacctgctcggcagcccgctgccgcaccgcgccatggcccgcatcgcgcgccgcctcggcgcgccgccgttcatctacctccggctcggggaggtccccgtggtcgtggcgtcgtccccggccgccgcccgcgaggtcatgaagacgcacgacgcccgcttcgccacgcgcccgtggacgcccacgacgagggtcctcgtggaggccggagaaggcctggtgttcgcgcgctacggcgcgctgtggcggcagctccgcaggatcagcgtcctggagctgctcagcgcccgccgcgtccactcgttccgcgccgtccgggaggaggaggcccgccgcctcgtggccgccgtcgccgccgccgcggccggcgagggcggcggcgcccgtcacgtcagcaagcggatcgccgtggtcgtcacggacacggccgtgcgcgccataatccgcgaccggttcgagagggcgggagg

SEQ ID NO: 29269 - protein, 201 aa, Panicum virgatum
  misc_feature: Ceres CLONE 1890370
  misc_feature: SWISSPROT Homolog: EC 1.14.13.68 4-hydroxyphenylacetaldehyde oxime monooxygenase
MEQLTYYLLALLLPLLLLKLIARRDGNGMRLPPGPWQLPVIGSLHHLLGSPLPHRAMARIARRLGAPPFIYLRLGEVPVVVASSPAAAREVMKTHDARFATRPWTPTTRVLVEAGEGLVFARYGALWRQLRRISVLELLSARRVHSFRAVREEEARRLVAAVAAAAAGEGGGARHVSKRIAVVVTDTAVRAIIRDRFERAG

SEQ ID NO: 29270 - DNA, 745 bp, Panicum virgatum
  misc_feature: Ceres CLONE 1890407
  misc_feature: Encodes the peptide sequence at SEQ ID NO. 29271
  misc_feature (651)..(651): n is a, c, t, g, unknown, or other
agccaacccgaggtcaatccagccacagcccacccagctcgtacccagatctcccggacccgttcagcgcctgctgtagcgtcggcgatggccagcacggcggccgaggcggcgaaggcggcggagcagccggccaacggcaacggcgagcagaagacgcgccactccgaggtcggccacaagagcctgctcaagagcgacgacctctaccagtacatcctggacacgagcgtgtacccgcgggagcccgagagcatgaaggagctccgcgagatcaccgccaagcacccgtggaacctgatgacgacgtcggcggacgaggggcagttcctcaacatgctcatcaagctcatcggcgccaagaagaccatggagatcggcgtctacaccggctactccctcctcgccaccgccctcgcgctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgccttcgtggacgccgacaaggacaactacctcaactaccacgagcggctgctncagctcgtgaagctcggcggcctcatcggctacgacaacacgctgtggaacggctccgtcgtgctccccgacgacgcgccccatgcgcagtaca

SEQ ID NO: 29271 - protein, 219 aa, Panicum virgatum
  misc_feature: Ceres CLONE 1890407
  misc_feature (45)..(219): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Functional homolog of the protein sequence given in SEQ ID NO 51308
  misc_feature: Useful for making plants with altered carbohydrate content
  misc_feature: Functional homolog of the protein sequence given in SEQ ID NO 51309
  misc_feature: Useful for making plants with altered cell wall content and/or composition
  misc_feature: Useful for making plants with altered lignin content
MASTAAEAAKAAEQPANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFAFVDADKDNYLNYHERLLQLVKLGGLIGYDNTLWNGSVVLPDDAPHAQY

SEQ ID NO: 29272 - DNA, 1721 bp, Panicum virgatum
  misc_feature: Ceres CLONE 1890409
  misc_feature: Encodes the peptide sequence at SEQ ID NO. 29273
cacccccaaaaaagcgagcgccctacctgcgcgtaccacctccatggccgcgccatgaggcacccccggcccgctccacgctctcacacccccgcccccaccgctccacttcgctcggctccgcctctgcccgccacctccaccaccaccaccaccgcctccccatgcttccgcgctgccgcctcgccgccggtgccttcttctgcctcgccgtgctcctgctgcgcgcggacgcccaggggcagccgccgcctcaccagcccgcgctcgcgccgcaggacgtcgctgcgctccgcggcctgcgcgcgtcgctgggcgtgcgcgcccgcgactggcccgccagggccgacccctgcgccgcgtggcgcggcgtcacctgccgcgccggccgcgtcgcggagctccgcctctccgggctccggcgcacccgcgcgggggcacgccgcgcggccttcgccgtcgacccgctgcggggcctgaccgcgctcgagacgctcaacgcctcggggttcccgctcccgggccggatccccgcgtggttcggccgcggcctgccgccgtcgctcggcgtcgtcgacctccgctccgcccgcgtcaatggcgagctcccggccgatctcggcacgtccgggaacctgaccacccttgttctctccggtaacagactctccggccccattccggcgtcgctgctatcaatccctggtctccgcgttctcgatctctccagcaacgatctcacggggccgctaccgaacctgcctttccctggcagtaatggagctggagttctgttcaacgcttctgataattccttgtacggcgctatcggtgatgccattaggaagcggttctgggttattgatgtgtcaggaaattacttcgatcaggccgttggaactggctttgagaattggatcgatggtttagtggatttcagaatgaactgcttgtctggtgccgcaggccagcgcacccgtggagattgtgaggcgttctacacgaggaatggggtgaggctaggggaggttccccggccatcatcaccatctccggagccacagccaccacaggtgcttccagtgccatcaacgggcaagagaagggacaaatggaagcacgtattggctggggtccttggaggtgctgcaattgtggtaactctcggtcttggtgcgctggtgttttgcttgttgagaagaagaggaagggtgagactaagaacaagaggagtggagcagattgaggagggcatttggtctgggcggaggagtagcagtgtgaatcctgtcacaatgtcacccatggcatcccccggagccagtggttcaccaaagggtgttcctatcatcatagatgatttcaactatgacctgctgcagcgtgcaacaaggggttttggggacaacaaccttgtcaagcgtgggcactctggcaacatgtactatggtgtcctggagagtggcttcgaagttgtcgtcaaaaaggttgatctgaagagcagaaagaagtggcagggggagttgagcttcctcacaaagcatagccataggaggattgttccattgctgggccatctggccaaggatgagaagcaattgctcgtctacaaatacatggcaaaaggtgacctcacaactgcacttcacaagaagtcagtggaagttgaagaggggttgcgctcattggattggataacaaggctcaagattgcaattggt

SEQ ID NO: 29273 - protein, 518 aa, Panicum virgatum
  misc_feature: Ceres CLONE 1890409
  misc_feature: SWISSPROT Homolog: EC 2.7.11.1 Non-specific serine/threonine protein kinase
MLPRCRLAAGAFFCLAVLLLRADAQGQPPPHQPALAPQDVAALRGLRASLGVRARDWPARADPCAAWRGVTCRAGRVAELRLSGLRRTRAGARRAAFAVDPLRGLTALETLNASGFPLPGRIPAWFGRGLPPSLGVVDLRSARVNGELPADLGTSGNLTTLVLSGNRLSGPIPASLLSIPGLRVLDLSSNDLTGPLPNLPFPGSNGAGVLFNASDNSLYGAIGDAIRKRFWVIDVSGNYFDQAVGTGFENWIDGLVDFRMNCLSGAAGQRTRGDCEAFYTRNGVRLGEVPRPSSPSPEPQPPQVLPVPSTGKRRDKWKHVLAGVLGGAAIVVTLGLGALVFCLLRRRGRVRLRTRGVEQIEEGIWSGRRSSSVNPVTMSPMASPGASGSPKGVPIIIDDFNYDLLQRATRGFGDNNLVKRGHSGNMYYGVLESGFEVVVKKVDLKSRKKWQGELSFLTKHSHRRIVPLLGHLAKDEKQLLVYKYMAKGDLTTALHKKSVEVEEGLRSLDWITRLKIAI

SEQ ID NO: 29274 - DNA, 739 bp, Panicum virgatum
  misc_feature: Ceres CLONE 1890409-R
tgtgagtgctcaaaatgatgctgattcagatgagtggttgcaagaacattaggttacatcgacgcctatgacaaggagagtgtctcaggtattgtggatctttcccttgtcgtggatgaagaccatctggaggaagtatgggcagtggctattgtcgcgaagacatgcctgaatccaaagccctctaggcgcccacttgctcggtacatcctaaaagcgctggagaacccactaagggtggtgcgggagagggaagagctccactcccattcatctcggctcaagagtacgtcatctcgaagctggcgttttgcattccatggaaacaagtaccagagctgggatgtcatgccaatgtcggggaaaacacttgctcagaaaaataaagccaagtcccagggaactgcaggaagcgatgaggatgaggacaatttgttctcgttcaagagggcttcgcgggagaatttcccggatcctgtagagttggaagacagtgttgttgtgtaggagtaccacagattagcaatactttggtgcgcatctctttgatgcgacaaggatgaggacaattcgttctcgttcaagagggcttcgcggaagaatttcccagatcctgtagagttggaagacagtgttgttgtgtaggagtttcagattagcaatactttgctgtgcatctctttgatgcatctaggtaaaaaaactgtgtatacagagtaggcctcctttactttctccc

SEQ ID NO: 29275 - DNA, 691 bp, Panicum virgatum
  misc_feature: Ceres CLONE 1890413
  misc_feature: Encodes the peptide sequence at SEQ ID NO. 29276
attccgcctccaccaagcctctgccttcctcgctccttgcatccccggattccagtttggttgctcgtggctagggttggaccggcggcctcggcgatgtcggcgccgtggtgggactccgactggaaggaccgctccggcccggagtaccgctgcttcgtgggcaacctcccctacggcaccagcgagagctccctcaaggacgctttctccagttacgcccccctctactccgagatcgcggtggatcctgagacggggaggtcccgcggcttcgggtgggtgcagttcgaggaccagaagtcgatggacaacgccatccagggcatgaacggccagcaggtcggcggccgcagcgtcaccgtcagccaggccaaccaccgcccgcgccgctggagggcgtgaacggccggccggcacgccggtggccatggcctgctgcgcgcgtacaacagactagttggttatctcccccaatcgtcaggcctttagctaattagtactagtggtggtgttagttgtcttctatcgtcctaagtaatccgagattgctatgtcatgaactcatgatgttagttggttatctcccccaatcgtcaggcctttagctaattagtactagtggtggtgttagttgtcttctatcgtcctaagtaatccgagattgctatgtcatgaactcatgatgttc

SEQ ID NO: 29276 - protein, 102 aa, Panicum virgatum
  misc_feature: Ceres CLONE 1890413
  misc_feature (20)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
MSAPWWDSDWKDRSGPEYRCFVGNLPYGTSESSLKDAFSSYAPLYSEIAVDPETGRSRGFGWVQFEDQKSMDNAIQGMNGQQVGGRSVTVSQANHRPRRWRA

SEQ ID NO: 29277 - DNA, 783 bp, Panicum virgatum
  misc_feature: Ceres CLONE 1890423
  misc_feature: Encodes the peptide sequence at SEQ ID NO. 29278
aacacaaacaggaacagctacccagcaactagctagcatccatgcagccaatggcatccctcacagcgaacgcactgtgcgtcgtccccaccatggcgacggcagctgcaccgcgccgccaccgcagcctcgtcgtggccagagcttctgctgccaaggttgatgacgccgccggtgggcggcgccgagccatggtgttgctcgccgccgcggcggccaccactgcctcgacagcagccgccggccggtccgcgagagccgctgtgtccacgaaaaccgggcagtgggcggaaatagagaacgtgacggacccttacgtgcaggatctcggcaaatgggctgtcacggagcacaacaagcagtctggggagggtttggagtttggtaaggtcgtcagaggcaggcagcaagtcgtcgcgggcatgaactacagtctcgagatcgaaacgaagggaccctcccgtttctacgaagcgggtctgtttgtttccctgccgccggagaagcgtcagctcaagtccttcacgcccttgcttgggtgatgggaacaggttgctgcaagctgaggacggccattgcatgctctgagtctctctgatgtgtgtgtttgggccttgctactgttccccaatgtctgagagtcgtatgtggtgttctactaataatttggttttgcagaataaagggaacaaattaaaggtggcttgtgtttttcttttctcaattaactgtctatgttttcatgcatgcatgcaaggacatggccccgagaaaggtttcacg

SEQ ID NO: 29278 - protein, 149 aa, Panicum virgatum
  misc_feature: Ceres CLONE 1890423
  misc_feature (63)..(149): Pfam Name: Cystatin Pfam Description: Cystatin domain
MATAAAPRRHRSLVVARASAAKVDDAAGGRRRAMVLLAAAAATTASTAAAGRSARAAVSTKTGQWAEIENVTDPYVQDLGKWAVTEHNKQSGEGLEFGKVVRGRQQVVAGMNYSLEIETKGPSRFYEAGLFVSLPPEKRQLKSFTPLLG

SEQ ID NO: 29279 - DNA, 745 bp, Panicum virgatum
  misc_feature: Ceres CLONE 1890443
  misc_feature: Encodes the peptide sequence at SEQ ID NO. 29280
  misc_feature (647)..(647): n is a, c, t, g, unknown, or other
atctccatctccatctccatctccatggatgggtgtggatctcatcatctgctacctcatctccatcaactgcctgtcccccgcgccccccagttgccactgaagaaagccgctgatcggtcgagcagctagctagctatctttgcttgcttgcttcttgcttggataattattagacaccatcgtcagtcagttcgatcttcgagatggctttcaaagtgcaggacttccacgcgactcccggggatctttggaagtcttcaatccagacgccgcccccacctcgcgggagcccatcacctccccgttcctcatcgccgatgaggaggtgcaggaggacgacaaggatgctgccgtggggcgggccgcgcaaagggccgccgagtggggcctcatcctccagaccgacaagcacaccggccggccgcagggcgtcaccgcccgcccctccggctccggccacaccagcgagagtggaaactccctcgacgacaaggccgccgccggcatacctcgggtgtcggaggagctccgcgccgcgctctccgcgttccagcagaccttcgtggtgtccgacgccacccgccccgatcaccccatcctctacgctagcgctggattcttcaatatgaccggctactcctccnatgaggtcatcggaaagaactgccgcttcctccagggctccgggacggaccctgccgagatcgcccagatcaggcaagcgctctcagctggctcaaac

SEQ ID NO: 29280 - protein, 38 aa, Panicum virgatum
  misc_feature: Ceres CLONE 1890443
  misc_feature: SWISSPROT Homolog: EC 2.7.11.1 Non-specific serine/threonine protein kinase
  misc_feature: Functional homolog of the protein sequence given in SEQ ID NO 51310
  misc_feature: Useful for making plants with modulated light quality sensitivity
  misc_feature (7)..(7): Xaa is any aa, unknown, or other
MTGYSSXEVIGKNCRFLQGSGTDPAEIAQIRQALSAGS

SEQ ID NO: 29281 - DNA, 3072 bp, Panicum virgatum
  misc_feature: Ceres CLONE 1890447
  misc_feature: Encodes the peptide sequence at SEQ ID NO. 29282
accacatcacctgttcattaggtgtcagcattggttgaatccaacaacgcgccaggatcaccgtcgtcagccattgcctgtttggcttgccggccgccgccattcagcctctcccctccgtacttgcaccctctgcgagtctgcgttcacacacactggatagatcgtcttgtgtgaagccgggggcgctcatccttgatcgaattctcggctgattcttctgcttctgctgctgtcgagtgttttccttgtttttgttcttcaaatcggagtcgtcttcgcttccgcggcggcgctcgattggtgtggcaaccatggactgcgccgccgactacctgatcgccgtgggcaggtccacggcggatcccatgcggtggatgaagaagtggaggaaggccggtaacgtcatccggtcctgccacaggctggcccgcctcgcgttcctgtccgccgacatcctgcgccgcacgggctcctacgtcaccatcaagatccacgacgacgaagacgctgacgccgccggcacgtccaagcccgccgacgccgcgcttgcggaattctctgtcgcgcgcggcgacgaggacttccagggcctggtcaaggagaagcgcctcggctgcttccgccgcctcggcggcggcgccgggatcgccgccgcgctggcgtccggcgcggaggccggcatccgcggggacgaggccgacgtgggccgccgccgcgaggcgttcggcgccaacacgcacccgcggcggaagcccaaagggttctggcgccacgtgtgggacgcgctcagcgacgtcttcctcatcgtgctgctcgtctgcgccgccgtgtcgctggggttcggcatcaaggagcacggcctcaaggatggctggtacgacggcgtcagcatcttcctcgccgtcttcctcgtcgtggcggtgtccgcggtcagcaaccacggccaggccaagaggttcgacaggctcgccagcgagtccgacgacatcgcggtcaccgtcgtgcgcggcgggcggaggcaggaggtctccatcttcgacgtcgtcgtgggcgacgtagcggtgctcaagatcggcgacgtcgtgccggccgacggcgtgttcctggaggggcacgcgctgcaggtggacgagtccagcatgaccggcgagccccacccagtgcacgtcgacgccgacgaaagccccttcctggcctccggcgtaaaggtcatcgacggctacggcctgatggtcgtcacggccgtcggcacggacaccgcgtggggcgagatgatgagcagcatcaccagggagaagaccgagccgacgccgctccaggagcgcctcgagggcctcacctccagcatcggcaaggtcggcgtcgccgtggcggtgctcgtcttcgccgtgctcaccgcgcggcacttcacaggaagcacccgggacgagcagggcaagcccatgttcgacaagcagcacgtcaccttcaacaccgtcttcagcgcgctcgtcgggatcttccagcaggcggtgaccatcatcgtcgtcgccatcccggagggcctcccgctcgccgtcaccctgacgctggcattctcaatgaagcgcatggtcaaggagcacgcgctggtgcgcacgctctcggcgtgcgagaccatgggctccgtcaccgccatctgcaccgacaagacggggacgctcacgctgaaccagatgaaggtcaccgagttctgggtcggcaccgaccggcccagggcggcgacagcggtcaacggcggcgtcctcagcttgctgtgccagggggcggggctcaacaccacgggcagcgtgtacaagccggacaacgtttcgccgccggagatctctgggagcccgacggagaaggcgctgctgtcgtgggccgtgacggagctcggcatggacgctgacgcgctgaagcggagctgcaaggttctgcgcgtcgaggccttcaactccgacaagaagcgcagcggcgtgctggtcagggacaacgccaccggcgcggtgaccgcgcactggaaaggcgccgcggagatggtcctggcgagctgctcggcgtacgtcggcacggacggcgcggcgtgccagctcggcggcgagcggaggaggaacctcgagaaggttatcagcgacatggcggcaggcagccttcggtgcatcgcgttcgcctacaagcaggtcgacggagagcactccaggatcgatgacgagggcctgacattgctgggcttcgtcggcttgaaggatccctgccgtccagaggtgaggaccgccattaaggcctgcacgaaggcgggtgtcgcggtcaagatggtcaccggggacaacgttctcacggcccgtgccatcgccaaggagtgcggcatcatcccggacaaagacgatcgcgacggtgttgtgatcgaggggcacgagttccgcgccatgtcgccggaggagcagctggagatggtggaccgcatccgcgtgatggcgcggtcgctgcccatggacaagctggtgctggtccagcgcctgaagcagaggggccacgtggtggcggtcaccggcgacggcaccaacgacgcgccggcgctcaaggaggccgacgtcgggctgtccatgggcatccagggcaccgaggtcgccaaggagagctccgacatcgtgatcatgaacgacaacttcgacacggtggtgacggccacgcggtggggccgctgcgtcttcaacaacatccagaagttcatccagttccaactgaccgtcaacgtcgcggcgctcatcatcaacttcgtgtcggcgctgacctccggcaagatgccgctgacgacggtgcagctgctgtgggtgaacctgatcatggacaccataggagcgctggcgctggccacggacaagcccaccaaggcgctcatgcggcgcccgcccatcggccgcacggcgccgctcatcagcaacgccatgtggcgcaacctcgccgcgcaggccgcgttccaggtggccgtgctgctcgccctccagtaccgcggccgccacatcttcggcgtcggcgagaaggccaacggcaccatgatcttcaacgcct

SEQ ID NO: 29282 - protein, 919 aa, Panicum virgatum
  misc_feature: Ceres CLONE 1890447
  misc_feature (193)..(442): Pfam Name: E1-E2_ATPase Pfam Description: E1-E2 ATPase
  misc_feature (446)..(769): Pfam Name: Hydrolase Pfam Description: haloacid dehalogenase-like hydrolase
  misc_feature (96)..(178): Pfam Name: Cation_ATPase_N Pfam Description: Cation transporter/ATPase, N-terminus
  misc_feature: SWISSPROT Homolog: EC 3.6.3.8 Calcium-transporting ATPase
MDCAADYLIAVGRSTADPMRWMKKWRKAGNVIRSCHRLARLAFLSADILRRTGSYVTIKIHDDEDADAAGTSKPADAALAEFSVARGDEDFQGLVKEKRLGCFRRLGGGAGIAAALASGAEAGIRGDEADVGRRREAFGANTHPRRKPKGFWRHVWDALSDVFLIVLLVCAAVSLGFGIKEHGLKDGWYDGVSIFLAVFLVVAVSAVSNHGQAKRFDRLASESDDIAVTVVRGGRRQEVSIFDVVVGDVAVLKIGDVVPADGVFLEGHALQVDESSMTGEPHPVHVDADESPFLASGVKVIDGYGLMVVTAVGTDTAWGEMMSSITREKTEPTPLQERLEGLTSSIGKVGVAVAVLVFAVLTARHFTGSTRDEQGKPMFDKQHVTFNTVFSALVGIFQQAVTIIVVAIPEGLPLAVTLTLAFSMKRMVKEHALVRTLSACETMGSVTAICTDKTGTLTLNQMKVTEFWVGTDRPRAATAVNGGVLSLLCQGAGLNTTGSVYKPDNVSPPEISGSPTEKALLSWAVTELGMDADALKRSCKVLRVEAFNSDKKRSGVLVRDNATGAVTAHWKGAAEMVLASCSAYVGTDGAACQLGGERRRNLEKVISDMAAGSLRCIAFAYKQVDGEHSRIDDEGLTLLGFVGLKDPCRPEVRTAIKACTKAGVAVKMVTGDNVLTARAIAKECGIIPDKDDRDGVVIEGHEFRAMSPEEQLEMVDRIRVMARSLPMDKLVLVQRLKQRGHVVAVTGDGTNDAPALKEADVGLSMGIQGTEVAKESSDIVIMNDNFDTVVTATRWGRCVFNNIQKFIQFQLTVNVAALIINFVSALTSGKMPLTTVQLLWVNLIMDTIGALALATDKPTKALMRRPPIGRTAPLISNAMWRNLAAQAAFQVAVLLALQYRGRHIFGVGEKANGTMIFNA

SEQ ID NO: 29283 - DNA, 662 bp, Panicum virgatum
  misc_feature: Ceres CLONE 1890456
  misc_feature: Encodes the peptide sequence at SEQ ID NO. 29284
tctccccccttcttatccactgaccctcccctccgtcctcccccccccccaccccctcctcccgaccgcgagagctgccgccgcatccctccctagggctccgtcgcggcgccggcgtagcgtcccgccgccgcgcgcgcggctgcctccggccccgcccgccgctctcctccgcgcggaatctctccggctcaggcttaagtgacatttggctagggattctttgactgattcaatatggaggggactctagttcagtctgcgattgttcccaccgtattacaccggagcagctttggtcgatctcgtgttcgcgcgagggccacgatgctgcgcagtacgccgacgcggacgcttactcttggaggcttccaagggctgcggcagacaaattttcttgacacgaggtctgtgatcaagcgtgatttcggatctatcgtagcaagccagatttcgcggccacggggttcagcgtcaagaggtgtggttcgggccatgttcgagcgcttcaccgaaaaggccatcaaggtgattatgcttgcgcaggaggaggccagacgtctaggccacgactttgttgggacagagcatattttactaggtcttattggtgagggaactgggatagcagcgaaggttctgaaatctatgggaattaatct

SEQ ID NO: 29284 - protein, 141 aa, Panicum virgatum
  misc_feature: Ceres CLONE 1890456
  misc_feature (102)..(141): Pfam Name: Clp_N Pfam Description: Clp amino terminal domain
MEGTLVQSAIVPTVLHRSSFGRSRVRARATMLRSTPTRTLTLGGFQGLRQTNFLDTRSVIKRDFGSIVASQISRPRGSASRGVVRAMFERFTEKAIKVIMLAQEEARRLGHDFVGTEHILLGLIGEGTGIAAKVLKSMGIN

SEQ ID NO: 29285 - DNA, 2064 bp, Panicum virgatum
  misc_feature: Ceres CLONE 1890480
  misc_feature: Encodes the peptide sequence at SEQ ID NO. 29286
aaggagctgctggccttcctgcgtcctgccctccctccccacaatccttccaccaccgccgaccgccatggccgccgccgaggtggaccccgcccccaaccctacctccgacctccccaacggatcgtcggcgcaggaccggaagaagtcccgcgagagcgaccgccgccgccgacgtcgtaagcagaagaagaacaaggcggcttctaacgctgcagatgcaggcggggatgcggagcccgatgaggaggcggcgcccgacggcgccaaggagaacgccgatcagaaaccccaggttgaggtggaggtggagtacgtgccagagaaggcagagcttgacgacgccttcctcgccgactttaaggacatcttcgacaaattcaccttcaaggattcccccgctgccaccgaggatggtgagaagaagaatgaggctggcactgatgcagcgaaggaggggaatgaatccgactcggatgaagatgctcaggacgcccagcagaagaaggaagggggtgtctccaataagcagaagaaattgcaacggaggatgaaaattgcagagttgaaacagatatgtgccaggccagacgtggttgaggtatgggatgcgactgcatcagatcccaagttacttgtctatctgaagtcctaccggaacacagtacccgttccaaggcactggtgtcaaaagaggaagttcttgcaggggaagagaggtattgagaaacaacctttccaactccctgacttcattgcagctactggaatagaaaaaataagacaggcatatattgagaaggaggacagcaaaaagctaaagcagaaacagcgagagcgtatgcagcccaagatggggaagatggatatagattatcaggttttacatgacgctttcttcaaatatcaaacaaagccaaaattaactagtcatggtgacctgtattacgaaggaaaggagtttgaggtcaaacttagggaaatgaagcccggtgttctatctcgagaacttaaagaagctcttggtatgcctgatggtgcaccgcctccatggcttataaacatgcagagatatggccccccaccctcctatcctcaactgaagattcctggtctcaatgctccaattcctcctggtgcaagttttggatatcgacctggagaatgggggaaacctcctgttgacgaacatgggcgccccttatacggagatgtttttggagtcctacagcaggatgaacctaactatgatgaggagcctgttgatcgtagcaagcactggggagacttagaggaggaagaggaggaggaagaagaggaggaggaggaggaggaagagccaatggaagacgaagacatggaagagggcatgcaatctgttgacaccatttcaagcactcccactggcgtggaaacacctgatgttatcgatcttcggaagctacagaggaaagagcctgaaagacaaacagagaagcagctataccaggttcttgagcagaaggaggaaagaatcgcccctgggacactctacggatcaagccacacgtatgtgctcggggcacaagacaaagctgctcccaaaagggttgatcttctcaaaaaccagaagtctgataaggtggatgtcaccatacaacctgaggaattggaggttatggatgacgtgttggcggccaagtatgaagaagcacgagaggaggagaagctgcggaatcagaaggaagacttcagcgacatggtggctgagaacgcaagcaagaggaagaggaagcagcaggagaaggatgggaaatcgaaaaagaaggaattcaagttctaggaggattactatttccatgtccaagagtttgagctagtcattgctagacgagacaagacgagatggtgttttgtttgcctgcctgccttttctttagaaaaaaaatgcaaaggaactaagtttaccgtgcacgcattagatgtaagcttgtttcccgagatggtttgaggtgatgacgatgcatattgtatacctgtttccatggatcaatagtttgtttccgagcgggttgctggaactgg

SEQ ID NO: 29286 - protein, 584 aa, Panicum virgatum
  misc_feature: Ceres CLONE 1890480
  misc_feature (307)..(354): Pfam Name: PSP Pfam Description: PSP
MAAAEVDPAPNPTSDLPNGSSAQDRKKSRESDRRRRRRKQKKNKAASNAADAGGDAEPDEEAAPDGAKENADQKPQVEVEVEYVPEKAELDDAFLADFKDIFDKFTFKDSPAATEDGEKKNEAGTDAAKEGNESDSDEDAQDAQQKKEGGVSNKQKKLQRRMKIAELKQICARPDVVEVWDATASDPKLLVYLKSYRNTVPVPRHWCQKRKFLQGKRGIEKQPFQLPDFIAATGIEKIRQAYIEKEDSKKLKQKQRERMQPKMGKMDIDYQVLHDAFFKYQTKPKLTSHGDLYYEGKEFEVKLREMKPGVLSRELKEALGMPDGAPPPWLINMQRYGPPPSYPQLKIPGLNAPIPPGASFGYRPGEWGKPPVDEHGRPLYGDVFGVLQQDEPNYDEEPVDRSKHWGDLEEEEEEEEEEEEEEEEPMEDEDMEEGMQSVDTISSTPTGVETPDVIDLRKLQRKEPERQTEKQLYQVLEQKEERIAPGTLYGSSHTYVLGAQDKAAPKRVDLLKNQKSDKVDVTIQPEELEVMDDVLAAKYEEAREEEKLRNQKEDFSDMVAENASKRKRKQQEKDGKSKKKEFKF

SEQ ID NO: 29287 - DNA, 1332 bp, Panicum virgatum
  misc_feature: Ceres CLONE 1890482
  misc_feature: Encodes the peptide sequence at SEQ ID NO. 29288
actcgcggctcgcgtgccgcattccacctcgaggctttgtctgataaataggccccctccaaaagaatcgcaaggcagcagaacaaagaggcggccatcgctctcccgtactggcctcagagagacacagagagagagtgacttgcctgaactaacacacacacaccttatagttcatcgcagctgacggctgagctctgcttgagattttcagccgcagcgttacaggaagggatcaggcatggctgcaaggagggctgcttcctccgtcctctctcgctgcctcctcgcaaggccgcctcctccttcttgtcccgccggcaaatccgctcttctcggaccaggggctgttctccgctggttcggtactgcaccggcagccgccgccaccgaggagccgatccaacccgcagtggagatcaagcacacccagctcctcatcaatggcaacttcgtcgacgcagcttctgggaggacgttcccgacggtggacccgcgcaccggcgaggtcatcgcgctcgtcgccgagggcgacagcgaggacatcgaccgcgccgtcgccgccgcccgccgggccttcgacgagggcccgtggccgcgcatgaccgcctacgagcggtgccgggtgctgctgcggttcgcggacctgatcgagcagcacgcggacgaggtcgccgcgctggagacctgggacaacgggaagacgctgacgcagtcggccggcgccgaggtgcccatgctggcgcggtgcatgcggtactacgccgggtgggcggacaagatccacggcctggtggtgcccgccgacggcgcgcaccacgcgcaggtgctgcacgagcctgtcggcgtcgccgggcagatcatcccctggaacttcccgctgctcatgttcgcatggaaggtcggcccggcgctcgcctgcggcaacaccgtcgtcctcaagaccgccgagcagacgccgctctccgcgctctacgtcgccagcctcctccacgaggctggactccccgacggtgttctgaatgtggtctccggcttcggcccgacggccggcgccgccctgtgtagccacatgggcgtggacaagctcgcgttcaccggatcgacgggcacgggccagatcgtcctcgaactggcggcgaggagcaacctgaagccggtgaccctggagctcggcggcaagtcccctttcatcgtcgtggacgacgccgacgtcgaccaggccgtcgagctcgcgcaccacgcggtcttcttcaaccagggccaatgctgctgcgccgggtcccggacgttcgtgcacgagcgcgtgtacgacgagttcgtggagaagtc

SEQ ID NO: 29288 - protein, 363 aa, Panicum virgatum
  misc_feature: Ceres CLONE 1890482
  misc_feature (71)..(363): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Functional homolog of the protein sequence given in SEQ ID NO 50708
  misc_feature: Useful for making plants with altered carbohydrate content
MAARRAASSVLSRCLLARPPPPSCPAGKSALLGPGAVLRWFGTAPAAAATEEPIQPAVEIKHTQLLINGNFVDAASGRTFPTVDPRTGEVIALVAEGDSEDIDRAVAAARRAFDEGPWPRMTAYERCRVLLRFADLIEQHADEVAALETWDNGKTLTQSAGAEVPMLARCMRYYAGWADKIHGLVVPADGAHHAQVLHEPVGVAGQIIPWNFPLLMFAWKVGPALACGNTVVLKTAEQTPLSALYVASLLHEAGLPDGVLNVVSGFGPTAGAALCSHMGVDKLAFTGSTGTGQIVLELAARSNLKPVTLELGGKSPFIVVDDADVDQAVELAHHAVFFNQGQCCCAGSRTFVHERVYDEFVEK

SEQ ID NO: 29289 - DNA, 226 bp, Panicum virgatum
  misc_feature: Ceres CLONE 1890482-R
ggcggccacaagacgagcggcgccggccgggagaagggcgccaacgccccccgcaacgaccgccagaccaaggccgccggcacgcccaccaggggcgccgccgggcggggaccccggccgcagccggcgggccggccgcgacgacggacgccgggggaaggaccccggacagaaaagaagaacagggacggcggacaccagcaaagggggcgaacaagaacagccg

SEQ ID NO: 29290 - DNA, 1956 bp, Panicum virgatum
  misc_feature: Ceres CLONE 1890492
  misc_feature: Encodes the peptide sequence at SEQ ID NO. 29291
gactcatcagaccaccaccaaagaactggatcaaacgaaacagcaacccctctccccttgactggccaaggaattgttggggatggagaagagcttgagggttggggccatggaggaccgcggggactgggtgcacgactcctccgtggatcaccgcgggaggccgccctcccgcggcgccaccgggtcctggaaggccgcaatgttcatcatcctgatcgagttcagcgagaggctgagctatttcgggatagcgacgagcctgatgctctacctcaccaaggtgctgcaggaggagatgaaggtcgcggccaagaatgtcaactactggatgagcgtcaccacgctcatgcccttgctcggcggcttcctcgccgacggctacctcggcaggttctccaccgtcgtcttctccaccgtcgtctacctgctgggcctgatggtcctggccacggcgcagctgtcgccgcgcctcaagcccgagcactcgctgcgcctgcacgaggtgctcttcttcgtcggcatatacctggtgtccgtcggcaccggcggccacaagccggcgctggagagcttcggcgccgaccagttcgacgagagccacgcggcggagcgggtgcagaagatgtccttcttcaactggtggaactgcgcgctctgctccggcgtcctgctcggcgtcaccgtcatcgtctacgtgcaggagcgcatcggctggggcgccgccagcgtcgtgctcgcctcggtcatggccgcctcgctcgtcgtcttcctcgccggatggcgcttctaccgctaccgggtgccggagggcagcccactgacgccgctgctgcgggccgtcgtcgccgccgtgcggaagaggcgcctcgcgctgccggccgacgccggcgagctgtacgaggtgaagccgcagaatatcaagaagaggctgctttgccacacccaccagcttcggttcctcgacaaggcggccatagtggagcacggcggcggcgaggacgcgtccgggccgtggcgtctggcgacggtgacgcaggtggaggagacgaagctggtgctgggcatggtgcccatctgggtggcgacgctgcccttcggcatggcggcggcgcaggtgtccaccttcttcatcaagcaggggagcgtgatggaccggcgcatcggccctcacttcgtgctcccgccggcgtccatcttcgcgctgtcggcggtgggcatgatcgccaccgtggcggcctacgacaaggtgctggtgccgtacctgctccgcgccacgggcggcgagcgcggcatcagcatcctgcggcgcgtgggcatcggcatggcgctcgcgatcgtggccctggccgtggcggccgtggtggagcggcggcgcctgcggtccccctcgccggcgtccatgtcggtgctctggctggtgccgcagttcctgctgatgggcgtgggcgacgggttcgcgctggtggggctccaggagtacttctacgaccaggtacccgacggcatgcgcagcctgggcatcgggctctacctgagcgtgatcggcgccggcagcttcctgagcagcctggtgatcacggcggcggaccgcgcgagctcccgcggcgggcgcgccagctggttcgccaaggacctcaaccacagcagggtcgacctcttctactggctgctggcctgcatcggcgccgtcaacctgggcttctacgcggtggtcgccaccaggtactcgtacaaggccgtcaggcccggcaaggtcggcgacgacaagtccgccgccgccgacatcgagtgcgccgccgccgcttaggcgtagccgatcgatagataatcggtcaaccagttagctgcaggatcggatcgttagcggctagcgattagatatacatatatactatagtatataaaaaaaagtgtacgtatgataatgtggtgtatgtcatcgtgacgctctag

SEQ ID NO: 29291 - protein, 575 aa, Panicum virgatum
  misc_feature: Ceres CLONE 1890492
  misc_feature (105)..(488): Pfam Name: PTR2 Pfam Description: POT family
MEKSLRVGAMEDRGDWVHDSSVDHRGRPPSRGATGSWKAAMFIILIEFSERLSYFGIATSLMLYLTKVLQEEMKVAAKNVNYWMSVTTLMPLLGGFLADGYLGRFSTVVFSTVVYLLGLMVLATAQLSPRLKPEHSLRLHEVLFFVGIYLVSVGTGGHKPALESFGADQFDESHAAERVQKMSFFNWWNCALCSGVLLGVTVIVYVQERIGWGAASVVLASVMAASLVVFLAGWRFYRYRVPEGSPLTPLLRAVVAAVRKRRLALPADAGELYEVKPQNIKKRLLCHTHQLRFLDKAAIVEHGGGEDASGPWRLATVTQVEETKLVLGMVPIWVATLPFGMAAAQVSTFFIKQGSVMDRRIGPHFVLPPASIFALSAVGMIATVAAYDKVLVPYLLRATGGERGISILRRVGIGMALAIVALAVAAVVERRRLRSPSPASMSVLWLVPQFLLMGVGDGFALVGLQEYFYDQVPDGMRSLGIGLYLSVIGAGSFLSSLVITAADRASSRGGRASWFAKDLNHSRVDLFYWLLACIGAVNLGFYAVVATRYSYKAVRPGKVGDDKSAAADIECAAAA

SEQ ID NO: 29292 - DNA, 700 bp, Panicum virgatum
  misc_feature: Ceres CLONE 1890502
  misc_feature: Encodes the peptide sequence at SEQ ID NO. 29293
atcagcagcagcgagcaacgtaacgcagagccagagcacatcgcaccgaacactgcacgccttcagctaggcagctagctagcagcatcgagtccggccagccggcgaggcgacgcccggccacgatgggcggcgtagctaagattcccgcggcggcgctttggttgctgctaggcgtggtggttgcggcgaccccggcgcaggccttgaggaacaaggcgaactactacgacttcattatcgctgagacgaacgtcacccggttgtgccacgagcaggctatcctcaccgtgaacgggcagttcccggggccgacgatccacgcgcgccagggcgacgtcgtcttcgtcaacgtccacaaccggggccacaagaacatcaccctccactggcacggcgtggaccagccgcgcaacccctggttcgacggcccggagttcatcacgcagtgccccatccagcccggcgccaacttcacctaccgcatcgtcttctccgacgaggagggcacgctctggtggcacgcgcacagcgacttcgaccgcgccaccgtgcacggcgccatcgtcgtccgccccaagctcggctccgcctacccctaccccgagccgcacaaggacatacccatcatcctcggcgagtggtggaatgtaagcgtgcagcacttgctcgaggagaccatgcggagcggcggcgactt

SEQ ID NO: 29293 - protein, 191 aa, Panicum virgatum
  misc_feature: Ceres CLONE 1890502
  misc_feature (38)..(154): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 51311
  misc_feature: Useful for making plants with altered cell wall content and/or composition
MGGVAKIPAAALWLLLGVVVAATPAQALRNKANYYDFIIAETNVTRLCHEQAILTVNGQFPGPTIHARQGDVVFVNVHNRGHKNITLHWHGVDQPRNPWFDGPEFITQCPIQPGANFTYRIVFSDEEGTLWWHAHSDFDRATVHGAIVVRPKLGSAYPYPEPHKDIPIILGEWWNVSVQHLLEETMRSGGD

SEQ ID NO: 29294 - DNA, 456 bp, Panicum virgatum
  misc_feature: Ceres CLONE 1890510
  misc_feature: Encodes the peptide sequence at SEQ ID NO. 29295
atgctctccttgcatagcaaaacaagcgatccaaaagtccctgagattttcctacatctcgagttcgcctgctagtttctattccttcttcttctcccgttcgagcaagcgattccggtggcaatggccaagggcgagggaccggcgatcgggatcgatctcggcaccacctactcgtgcgtcggcgtgtggcagcacgaccgggtggagatggtcaccaacgaccagaggaaccgcaccacgccgtcctatgtcgccttcaccgacaccgagcgtctcatcggcgacgccgccaagaaccaggtcgccatgaaccccaccaactccgtcttcgacgcgaggtggttgattggtaggaggttctctgacccttcagagcagagtgacatgaacctgtggccgttcaagcgtcatccctgggcccggtgactagcccatgattgttgtcactacaag

SEQ ID NO: 29295 - protein, 101 aa, Panicum virgatum
  misc_feature: Ceres CLONE 1890510
  misc_feature: Functional homolog of the protein sequence given in SEQ ID NO 50336
  misc_feature: Useful for making plants with modulated heat sensitivity
MAKGEGPAIGIDLGTTYSCVGVWQHDRVEMVTNDQRNRTTPSYVAFTDTERLIGDAAKNQVAMNPTNSVFDARWLIGRRFSDPSEQSDMNLWPFKRHPWAR

SEQ ID NO: 29296 - DNA, 2847 bp, Panicum virgatum
  misc_feature: Ceres CLONE 1890519
  misc_feature: Encodes the peptide sequence at SEQ ID NO. 29297
tagtttggttacttcctggccatctactcgaaccctaggcgcgcttcactttcggcgcagttgctgggagccgggtttctcccaggatgtcggcggctgccggagaggtcgctggagcccgcggagagggaggcggcgtggaggcccggagggtcttcataggcgccggctgcaaccgtgtggtgaacaacgtctcgtggggagcttgcggccttgtggccttcggcgcccagaacgccgtcgccctcttctcgccccagagaggtgagatcgtgacgacgcttccggggcacaaggcaccggtgaactgcacgctatggcttcccaccaagaaggatgtgctccatgttcgtggcagggagacatactatctactctcaggaagtgctgatggcgcaatcctggcatggaagattggttctggcaaaggagactggtctcatgtgttgcagctcccagggatgcataagaaagggatcacctgtcttgctggaaggatggtgtctgatactaatgcaattttttcttctacttcgtcggatggtattgtggttatctgggaaatggtgattgagcccacccctggtggcagctgcaaagtgtcttgcctgcacactttgtccgttggttcaaaaccaatggtttcactttcgttagcagtgttaccagaacagagaagccatctaattttggcaatgggtggtctagatcacaagatccacatttattgtggggataagtcaggcaagttcattaaagcttgtgaacttaagggtcattctgattggatcagaagtttagacttttctttacccgtgacgataagcagtgaaaagcacaaccttttccttgttagctcatctcaggacagaaccattcggatatggaaaatggattcagaagccatttcttcaggctccacggcacaattgaggaaggcaaatattgagatgacctcctatattgagggaccactttttgtagctggtaatacaagctatcaagtatctctggaatctcttcttgttggccatgaagattgggtatattctgtagagtggcaaccacctacagtgttacctgggaatgaagctcatcaggcgatgagtatactatcagcatccatggacaagatgatgatgatatggaggcctgagaaaaatactggcctttggattaattcagtgactgttggtgaattaagtcattcagcacttggattttatgatggacactggcagcctgatggtaaatcgattcttgcacatggctatggtggttcctttcatatgtggagagatgttggactagattctgaaaattggcagcctcagattgtcccgtctggtcattttgcacctgtgtctgacttaacatgggcaagatctggtcaatatttgttatccgttagtcatgaccagacaacacgcatatttgctccgtggagaaatcaagttaaccctggagatatgatctactggcgcgaaattgcacgtccgcaaattcatggccacgatattaactgtgtggcattcattcagggtagtgggaaccaccggtttgttagtggtgctgatgaaaaggtctctagagtctttgaagctcccttatcatttttgaagaccctacaacaagcaactttgttgaaacctgacatctctgacgattttgacaatgtgcaagtccttggagcaaatatgtctgctcttgggttgtcacagaaacccatatatacacatggagtcaaggaatccccaagcagtaattctagtgacggtccagattctatggagacaattcctgatgcagttcctactgtatttaccgaaccccctgtggaggaccaacttgcatggaatactctatggcctgaatcgcacaaattatatggtcatggaaacgaactcttctcgatatgctgtgattatgaagggaagcttgttgcatcatcttgcaaggctcaatcagcgccagttgctgagatctggctctgggaagttggaacttggaaagctgttggccgcttgcaatcccacaatcttacagtgatacaaatggagttctctcgtgataatgcttttctcttgagtgtctcgagggatcgccatttgtcgatcttttcaatcaggaaaacaaaggaaggagtggaacaccatcttgttgcaaagcatgaagcacacaaaagaattatatggtcatgctcatggaacccctttggttatcaatttgcaactggatcaagggacaagaccgtcaagatttggtgtgttcaagatgcgtcttctgtgaagctgcttgcaacattgcctcagtttcgtgacagtgtcaccgcactggcatggatgggccatgaccgtgcttccaatgccggtattctcgctgttggcatggacaatggattaatcgagctctggagtgtttcaggtggaagagcttctgcaggcagtactacagactcgtctccgctcattgcagcgtgtatgctccaatttgatcctctgctgtgtcacgtgtcaaccgtgcaccgtttacgctggcggccacaagactcatctgatgagaaatcgacacttgagctggcttcctgtggagctgatcactgtgtgagggtgtttgatgtccattgcaggacatagactaatgcatccagatttaataggtcaaggggctggcagttttttgtcaatgtctgccaagatgtgttgtaaaactagtcctgataatgaaaaaaaaatagttttgtcatgaaacatttgatgtccatatgtaacactagttaagtggtaaaagatgcactgctgcatatctctcatgatctatgaaggaagatgtcgagttattagtggt

SEQ ID NO: 29297 - protein, 849 aa, Panicum virgatum
  misc_feature: Ceres CLONE 1890519
  misc_feature (689)..(727): Pfam Name: WD40 Pfam Description: WD domain, G-beta repeat
  misc_feature (222)..(268): Pfam Name: WD40 Pfam Description: WD domain, G-beta repeat
  misc_feature (60)..(109): Pfam Name: WD40 Pfam Description: WD domain, G-beta repeat
  misc_feature (413)..(451): Pfam Name: WD40 Pfam Description: WD domain, G-beta repeat
  misc_feature (307)..(355): Pfam Name: WD40 Pfam Description: WD domain, G-beta repeat
  misc_feature (641)..(679): Pfam Name: WD40 Pfam Description: WD domain, G-beta repeat
  misc_feature: SWISSPROT Homolog: EC 2.3.1.48 Histone acetyltransferase
MSAAAGEVAGARGEGGGVEARRVFIGAGCNRVVNNVSWGACGLVAFGAQNAVALFSPQRGEIVTTLPGHKAPVNCTLWLPTKKDVLHVRGRETYYLLSGSADGAILAWKIGSGKGDWSHVLQLPGMHKKGITCLAGRMVSDTNAIFSSTSSDGIVVIWEMVIEPTPGGSCKVSCLHTLSVGSKPMVSLSLAVLPEQRSHLILAMGGLDHKIHIYCGDKSGKFIKACELKGHSDWIRSLDFSLPVTISSEKHNLFLVSSSQDRTIRIWKMDSEAISSGSTAQLRKANIEMTSYIEGPLFVAGNTSYQVSLESLLVGHEDWVYSVEWQPPTVLPGNEAHQAMSILSASMDKMMMIWRPEKNTGLWINSVTVGELSHSALGFYDGHWQPDGKSILAHGYGGSFHMWRDVGLDSENWQPQIVPSGHFAPVSDLTWARSGQYLLSVSHDQTTRIFAPWRNQVNPGDMIYWREIARPQIHGHDINCVAFIQGSGNHRFVSGADEKVSRVFEAPLSFLKTLQQATLLKPDISDDFDNVQVLGANMSALGLSQKPIYTHGVKESPSSNSSDGPDSMETIPDAVPTVFTEPPVEDQLAWNTLWPESHKLYGHGNELFSICCDYEGKLVASSCKAQSAPVAEIWLWEVGTWKAVGRLQSHNLTVIQMEFSRDNAFLLSVSRDRHLSIFSIRKTKEGVEHHLVAKHEAHKRIIWSCSWNPFGYQFATGSRDKTVKIWCVQDASSVKLLATLPQFRDSVTALAWMGHDRASNAGILAVGMDNGLIELWSVSGGRASAGSTTDSSPLIAACMLQFDPLLCHVSTVHRLRWRPQDSSDEKSTLELASCGADHCVRVFDVHCRT

SEQ ID NO: 29298 - DNA, 680 bp, Panicum virgatum
  misc_feature: Ceres CLONE 1890527
  misc_feature: Encodes the peptide sequence at SEQ ID NO. 29299
gttcctgatctccatatatttaagaaagaagatgatcaagatcttcatggctgggataagagatacacaataatggaagggatctgtagaggtttagatttccttcatgaggaatgcaaacttactcatatggaccttaaacctgaaaacatactgatggatggcaatatggttccaaaaattacggatttcggtttgtctaggctcaaggatgcaaaaaagtctcaaattgtcactcagacgcttactggaacactcggatacatgccaccagaatacctacaccagggccaaatatcacatcagacggatatatacagcttgggtgttataatgtgcgagataatcacaggcgaaaagatgccctttgtctggagtagtgaggccacgagtaggaaattcacagagagagcttgcagaagatggatggaaatatttgacaagtcactgaatgacgcgtcactaaaggaaacatatatgaaacaagtaaaacagctgctcgacatagcccaaaactgcgtggaccacgacaggatgaaaaggcctagttcatcgaaaatacttgaagcagtttttaatcagaatccatcaagcttgtgtgaattagacagcaattatggacaggttagcgagcccctcaccgtgcatccactgcagctcgattttctcttcactgacac

SEQ ID NO: 29299 - protein, 226 aa, Panicum virgatum
  misc_feature: Ceres CLONE 1890527
  misc_feature (1)..(191): Pfam Name: Pkinase Pfam Description: Protein kinase domain
  misc_feature: SWISSPROT Homolog: EC 2.7.11.1 Non-specific serine/threonine protein kinase
VPDLHIFKKEDDQDLHGWDKRYTIMEGICRGLDFLHEECKLTHMDLKPENILMDGNMVPKITDFGLSRLKDAKKSQIVTQTLTGTLGYMPPEYLHQGQISHQTDIYSLGVIMCEIITGEKMPFVWSSEATSRKFTERACRRWMEIFDKSLNDASLKETYMKQVKQLLDIAQNCVDHDRMKRPSSSKILEAVFNQNPSSLCELDSNYGQVSEPLTVHPLQLDFLFTD

SEQ ID NO: 29300 - DNA, 716 bp, Panicum virgatum
  misc_feature: Ceres CLONE 1890528
  misc_feature: Encodes the peptide sequence at SEQ ID NO. 29301
aaaagcttcctcagagcgctcgcgcgaaaccagccgagaggtctcgaggagaacgaacgaagcagccagaatcccaagccgatttgggacgccggccggccacctcgccgtagttgccaccccccccacccctactctgctcctgctcgtctctgaatcttcctccctcgcggggactttccgcggtttcctcgggattccttgcccggccgggaacggcggcgggcgctcacgaggggaaaggaaagaaaagctccgatttttctttccctgccgagttcgcttccgattcattcccactatcttgagcagcagcctgcgcgcggccagcctcgccgcgggagtttttcttggcttttttgctcggccagaattagccattccctggagctaaaggccgagctcggccggggctaaacttcgcatcttctccgcggcggccgcgggggaattcgttcttctcccgtcagtcgccgccgtatctcgctcgccggccgggggagcggcgggggcggcaggcatggggctcggcttggtggcgcacctggtgcgcctgggcgtgctgggctccacctccgaccacgcgccagtggtgtccatcaacctgttcgtggcgttgctctgcgcctgcatcgtcctcggccacctcctcgagggagaccggtgggtcaacgagtccatcaccgcgctcatcatcgggctgtgcaccggcgtgg

SEQ ID NO: 29301 - protein, 65 aa, Panicum virgatum
  misc_feature: Ceres CLONE 1890528
  misc_feature: The sequence is a functional homolog of SEQ ID NO 2 in US patent 7250560
  misc_feature: The sequence is a functional homolog of SEQ ID NO 4 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
MGLGLVAHLVRLGVLGSTSDHAPVVSINLFVALLCACIVLGHLLEGDRWVNESITALIIGLCTGV

SEQ ID NO: 29302 - DNA, 667 bp, Panicum virgatum
  misc_feature: Ceres CLONE 1890534
  misc_feature: Encodes the peptide sequence at SEQ ID NO. 29303
acccccgcatcgcacccgcccgggcggccttctcttttccagcgtccgatctcccactcgccgccctcaccgcagctccctccgcttccccacctccgccttccccgcgcgcgcgcgcgcccgccacctcgccctcccctccttccacgtcgcgcccgcccgcgcttatataagggtttctgctggttggcccgcgcgcggcggcggtggtcctgctgcagtgcgggaggagcgcatggcggacgcgccagcgagccccgggggcggcggcgggagccacgagagtgggagccccaagggcggcggcgggggcggaggcggcggcgtcagggagcaggacaggttcctgcccatcgccaacatcagccgcatcatgaagaaggccatcccggccaacgggaagatcgccaaggacgccaaggagaccgtgcaggagtgcgtctccgaattcatctccttcatcaccagcgaggcgagtgacaagtgccagagggagaagaggaagaccatcaacggggacgacctactgtgggccatggccacgctggggttcgaggactacatagaacccctcaaggtgtacctgcagaagtacagagagatggaggtatgtggtattggaaccttttcattgtgttcatgagataacttttgcctgatcgtgaac

SEQ ID NO: 29303 - protein, 135 aa, Panicum virgatum
  misc_feature: Ceres CLONE 1890534
  misc_feature (36)..(101): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 791 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 44 in the 10/675,852 US patent application
  misc_feature: The sequence is a functional homolog of SEQ ID NO 42 in the 10/675,852 US patent application
  misc_feature: The sequence is a functional homolog of SEQ ID NO 60 in the 10/675,852 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 64 in the 10/675,852 US patent application
  misc_feature: The sequence is a functional homolog of SEQ ID NO 12 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 14 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: Functional homolog of the protein sequence given in SEQ ID NO 50466
  misc_feature: Useful for making plants with modulated drought sensitivity
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 62 in the 10/675,852 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 803 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 793 in the 10/374,780 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 788 in the 10/374,780 US patent application
  misc_feature: The sequence is a functional homolog of SEQ ID NO 22 in US patent 7166765
MADAPASPGGGGGSHESGSPKGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEVCGIGTFSLCS

SEQ ID NO: 29304 - DNA, 700 bp, Panicum virgatum
  misc_feature: Ceres CLONE 1890535
  misc_feature: Encodes the peptide sequence at SEQ ID NO. 29305
ggcatctctgactcatctctatcttttccggccaccgtataatcaatcctctaatcccaccagcaaggcagtaatggcggatggggagatggactggatcgcggcgcggttcctgctgtccaccatactcggggtgcacccgctggtggtcctggacgacggcggccgcgacgacgagcacttcgccgtggacgaccgcggccagcgcgtgacggtgccggtgccggcggcggtggaggcgcccgagggggtggccggcgtgtcggtgtgcgcggtgtgcacggaggaggtcgcggcggggcaggccgtggtgcggctgccgtgcgcgcactggtaccacgccggctgcatcgccccctggctgcggatccggaacaactgcccgacgtgccgggcggagctgcctcgggagagcggggcggagaggccgcggccgcctgccggctggttgcggcgggaggcgtcctacacgatgcttgccggcacgttgccctgctaataattaaactagctactagccggtggacgtgcgtgacagcctgacaggcaacgcgtcgtgacagtagtattaatgtacagcgatatttgaagaacttttttagtgttagcaatgtacagcgataaggcgataatataatcgaagcgatcaaaactaagagtttggagatttcactcgaaacttggttggaacaacagttcg

SEQ ID NO: 29305 - protein, 141 aa, Panicum virgatum
  misc_feature: Ceres CLONE 1890535
  misc_feature (66)..(106): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MADGEMDWIAARFLLSTILGVHPLVVLDDGGRDDEHFAVDDRGQRVTVPVPAAVEAPEGVAGVSVCAVCTEEVAAGQAVVRLPCAHWYHAGCIAPWLRIRNNCPTCRAELPRESGAERPRPPAGWLRREASYTMLAGTLPC

SEQ ID NO: 29306 - DNA, 2035 bp, Panicum virgatum
  misc_feature: Ceres CLONE 1890562
  misc_feature: Encodes the peptide sequence at SEQ ID NO. 29307
atcgcctgcgcagtggatcgaccgtacctacctaccacacggccggattggactcgtgtcgggcggaggagagggaagaaacaagctaagttaagatggatgtggagagccgcgcggcggagccggaggcggcggtcggcgccgtcgactggcgcggccgcccgtgccgcgcgcaccggcacggcggcatgcgcgccgccgtcttcgtcctagggatccaggcgttcgagatcatggcgatcgcggcggtggggaacaacctcatcacgtacgtgttcggggagatgcacttcccgctgccgcaggcggccaacgtggtcaccaacttcgtcggcaccatcttcctgctcgccctcctcggcggcttcctctccgactcctacctcggctgcttctggaccatcctcaccttcggcttcgtcgagctctcgggcttcatcctgctgtcgctgcaagcgcacctgccgcagctgaagccgccgccgtgcagcatggcgtccgtgggcggcggctgcgagaaggcccggggcttcaaggccaccgtcttcttcctcgcgctctacctggtggcgctcggcagcggctgcctcaagcccaacatgatcgcgcacggcgccgaccagttcgacgccgccgcgccgggcggcgccgggaggctctccacctacttcaactcggcctacttcagcttctgcgcgggcgagctcgtcgccctcacggcgctggtctgggtgcagacgcactccgggatggacgtcggcttcggcatctccgcggccgccatggccgccgggctcgtcagcctcgtctccggcgccgcgctgtaccggaacaagcccccgcagggcagcatcttcactcccattgcaagagttttcgttgccgcctacagcaagaggaagcaagtgtgcccttccagctccaattctgtcaacgccggagcttgcgagccgtcacacctcgccggcaacttccgccacggcaacaagttcaggttcctggacaaggcatgcatccgggtagcaccgcagaggccgaacacgaagccggagagcccatggcggctgtgcacggtggcggaggtgcagcaggccaagacgctcctcgccgtgacgcccatcttcgcgtgcaccatcgtcttcaacaccgtgctcgcgcagctgcagaccttctcggtgcagcaggggagcgccatggacacctcgttcccgccgggctcctccttccgcatcccgccggcgtcgctgcagggcatcccctacgccatgctgctggcgctcgtcccggcctacgagctcctcctcgtgcctctcatgaagcgcgtcacgggcacgcgttccgggatcaccccgctccagcgcatcggcgtcggcctcggcaccgtcgccttctccatggtcgccgcggcggacgtcgagcgcaggcgccgcgacgccgccgcgaggggccaccggatgtccgtcctgtggatcgcgccgcagttcctcgtcttcggcgtgtcggagatgttcaccgccgtggggctcatcgagttcttctacaagcaggcgtgcgccggcatgcaggccttcctcacggcgctcacctactgctcctacgcgttcgggttctacctcagctccgtgctcgtctcgctggtgaaccgggtcacggccaggcacggcggcggcggcggctggctcggcgacaacgacctgaacaaggaccggctggacctgttctactggatgctcgccgcgctcagcgtgctcaacttcttctgcttcctgctgtgcgcgaggtggtacaatgccggcgtggatggctctgatgcagctgctgcctccggtcaggtggcagcagagggtgttgatggcaagatcatctgaacaactcaagagcactgaaactgtatatccgtatagatgtatgtatagaactacagaagcctaagaaatagtcaccagaaaatgagcactaggttaaaatcagggctctcattaaagtacaatacgctagttctgcagtgaatcatatatatagcttcaggcaactc

SEQ ID NO: 29307 - protein, 590 aa, Panicum virgatum
  misc_feature: Ceres CLONE 1890562
  misc_feature (100)..(501): Pfam Name: PTR2 Pfam Description: POT family
MDVESRAAEPEAAVGAVDWRGRPCRAHRHGGMRAAVFVLGIQAFEIMAIAAVGNNLITYVFGEMHFPLPQAANVVTNFVGTIFLLALLGGFLSDSYLGCFWTILTFGFVELSGFILLSLQAHLPQLKPPPCSMASVGGGCEKARGFKATVFFLALYLVALGSGCLKPNMIAHGADQFDAAAPGGAGRLSTYFNSAYFSFCAGELVALTALVWVQTHSGMDVGFGISAAAMAAGLVSLVSGAALYRNKPPQGSIFTPIARVFVAAYSKRKQVCPSSSNSVNAGACEPSHLAGNFRHGNKFRFLDKACIRVAPQRPNTKPESPWRLCTVAEVQQAKTLLAVTPIFACTIVFNTVLAQLQTFSVQQGSAMDTSFPPGSSFRIPPASLQGIPYAMLLALVPAYELLLVPLMKRVTGTRSGITPLQRIGVGLGTVAFSMVAAADVERRRRDAAARGHRMSVLWIAPQFLVFGVSEMFTAVGLIEFFYKQACAGMQAFLTALTYCSYAFGFYLSSVLVSLVNRVTARHGGGGGWLGDNDLNKDRLDLFYWMLAALSVLNFFCFLLCARWYNAGVDGSDAAAASGQVAAEGVDGKII

SEQ ID NO: 29308 - DNA, 570 bp, Panicum virgatum
  misc_feature: Ceres CLONE 1890565
  misc_feature: Encodes the peptide sequence at SEQ ID NO. 29309
gaattgagagaatccccttccccacctcactcactgcctcccatccgccgccgccgccgccggcgatgtcgcggacgctggtgcagccggtggggcataagcgcctcaccaacgtggcggtggtgcggctgcgcaagcacggccagcgcttcgagatcgcctgcttccccaacaaggtgctctcctggcgcgcccgcgtcgagaaggacctcgacgaggtgctccagtcccacaccgtctactccaacgtctccaagggcgtcctcgccaagtccaaggacctcgtcaaggccttcggcaccgacgaccagaccaaaatctgcatcgagattctcgagaaaggggagctccaggtctccgggaaggagagggaagcgcagctctccagccagttccgcgacatcgccaccatcgtcatggagaagaccatcaacccggagacgcgccgcccctacaccatcactatgatctagcgcctcatgcacgacattctctttgccgtcgaccccaacctcacctccgaggagcaggctttaaaagttatcaataatctcatcgaccactttcccg

SEQ ID NO: 29309 - protein, 135 aa, Panicum virgatum
  misc_feature: Ceres CLONE 1890565
  misc_feature (15)..(105): Pfam Name: SBDS Pfam Description: Shwachman-Bodian-Diamond syndrome (SBDS) proteins
MSRTLVQPVGHKRLTNVAVVRLRKHGQRFEIACFPNKVLSWRARVEKDLDEVLQSHTVYSNVSKGVLAKSKDLVKAFGTDDQTKICIEILEKGELQVSGKEREAQLSSQFRDIATIVMEKTINPETRRPYTITMI

SEQ ID NO: 29310 - DNA, 759 bp, Panicum virgatum
  misc_feature: Ceres CLONE 1890572
  misc_feature: Encodes the peptide sequence at SEQ ID NO. 29311
ctctcacactgcattcatcactcacgtagaacacagaaccagatctgttaatccaggagctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggtggccgggtacgtcgacgccggcaaggtgatgcggcgggtggcgcgccggacgggcaagcgggtggagccctggccctacgtgccgtacgacgtggtggcgcacccctacgcgcccggcgcctacgacaagaaggcgccgcccggctacgtgcgcaacgtcgtcgccgaccccgccgccgcgccgctcgcccgggcctcgtccaccgaggtcaggtacaccgccgccttcagcgacgagaaccccaacgccgcctgcgccgtcatgtagagctgcacgctgcctcgctcctgtagtagtaggagtagatggactaggaagttgctgctgtttcttggagcatttttttttctactttagtatttctctacgcttgtgctctggttcgattcgctgtaaaaaaagaagatggttttgattcctcagtggtagtaagtaggcttgaaggctaactagtagtgtttgttgccttgttgattgatgtatcatttctg

SEQ ID NO: 29311 - protein, 156 aa, Panicum virgatum; identical to SEQ ID NO: 18903
  misc_feature: Ceres CLONE 1890572
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications

SEQ ID NO: 29312 - DNA, 1328 bp, Panicum virgatum
  misc_feature: Ceres CLONE 1890576
  misc_feature: Encodes the peptide sequence at SEQ ID NO. 29313
aatttatttagacttcacttctactcatgctccatttctctgatccaattgatgttttctatccttgcagtttgttaaaacgttgctggggttgcagcatgtgtagttgggcatatagagagattgcattgagttagtgctctgctctcggctgtagggacgcaatgggcgtcctaaaagctggttcgctttgctggctgttccatgtgctggttcttgtctgtgccttgtgtcagatactttatgttggatcaattggggctcaaactgctcagttgagtgtggatgcttcacctcagaatgctcaggtgatccctggaaatatgtttggcatcttcttcgaggagatcaaccatgctggagctggtggattgtgggcagagcttgtaagcaacagaggttttgaagctggtggtcctaatactccttcaaacattgacccatggttgaccattggggatgaatccaatattatcgtggcaacagatcggtcatcctgttttgctggtaacccaattgcacttcgaatggaagtacattgtgaaactagtggaactaatgcctgcccatcaggaggtgttgggatctacaatcctggttactggggcatgaacattgagagaagaaaagtttatagagctaccatgtacattaagtcgtcagattcggtggagttgacagtttccttaacaagttcagatggtcttcaaaatctagcttctcataccatcacgggtgacaaggaagattttgttgagtggacaaaggttgaatttgatttggaatcaattgatagaaatactaattcaagacttcagcttacgaccaccaaaagtggcataatttggttcgatcaagtatcacttatgccatcagatacttacatggggcatggctttcgtaaagatcttgcctctatgcttgcaaatctgaagcctcgatttctaaaatttccaggtggcaactatgtaatggggaattatcttgtaaatgcattccgctggagtgaaactgttggaccgtgggaagaaagacctggtcattttaacgatgcttgggcctactggactgatgatggacttggattttttgagttcctccaactagcagaagaccttggtgcttgcccagtttgggtggttaatgatggggccagcctcaatgaagaagtcccaactgcaacaatcgctgcctttgtaaaggatgttgttaatggaattgaatttgccaggggagacccccagactgcatggggttcagttcgtgcagcaatgggacatccagaaccctttcagctttattatgtttcaatagggaatcaagaatgt

SEQ ID NO: 29313 - protein, 387 aa, Panicum virgatum
  misc_feature: Ceres CLONE 1890576
  misc_feature: SWISSPROT Homolog: EC 3.2.1.55 Alpha-N-arabinofuranosidase
  misc_feature: Functional homolog of the protein sequence given in SEQ ID NO 51312
  misc_feature: Useful for making plants with altered carbohydrate content
  misc_feature: Functional homolog of the protein sequence given in SEQ ID NO 51313
  misc_feature: Useful for making plants with altered cell wall content and/or composition
MGVLKAGSLCWLFHVLVLVCALCQILYVGSIGAQTAQLSVDASPQNAQVIPGNMFGIFFEEINHAGAGGLWAELVSNRGFEAGGPNTPSNIDPWLTIGDESNIIVATDRSSCFAGNPIALRMEVHCETSGTNACPSGGVGIYNPGYWGMNIERRKVYRATMYIKSSDSVELTVSLTSSDGLQNLASHTITGDKEDFVEWTKVEFDLESIDRNTNSRLQLTTTKSGIIWFDQVSLMPSDTYMGHGFRKDLASMLANLKPRFLKFPGGNYVMGNYLVNAFRWSETVGPWEERPGHFNDAWAYWTDDGLGFFEFLQLAEDLGACPVWVVNDGASLNEEVPTATIAAFVKDVVNGIEFARGDPQTAWGSVRAAMGHPEPFQLYYVSIGNQE

SEQ ID NO: 29314 - DNA, 589 bp, Panicum virgatum
  misc_feature: Ceres CLONE 1890577
  misc_feature: Encodes the peptide sequence at SEQ ID NO. 29315
gctcggtccaaatattttccttgcttccatctccccgatggaatgcagcggcaacgacggtggcgagtgggtctgggtgcgacttccgacacaggctgaggccgtggcggcagcggcagcagagcagcagaaatcaccgtcggcagcagcgacagagatggaggaggaggagcgaccgctcaaggtggtgttcgcgtcgccggcagagtacttcacggacgcggcacccatcggcaacggcagcctcggcggcatggtctggggcggcgtcgccaccgagaagctccagctcaaccatgacaccctatggaccggtgcaccagggaactatactgacccggaggcgccggctgctctcgcggtggtgagggaacttgtcaaccaaggacgattcgctgatgccactgaggccgccaggcgcctcttcggtggccaatcagaagtaagcctacaatatggcttcgtccttgtttcgcttggagcagtatcaacacataatgtctatctaaaaacatagatgtcatcaattgtggtattattaatttccaaatttacatctctttttgattattgaattctctttctatat

SEQ ID NO: 29315 - protein, 159 aa, Panicum virgatum
  misc_feature: Ceres CLONE 1890577
  misc_feature: SWISSPROT Homolog: EC 3.2.1.51 Alpha-L-fucosidase
MECSGNDGGEWVWVRLPTQAEAVAAAAAEQQKSPSAAATEMEEEERPLKVVFASPAEYFTDAAPIGNGSLGGMVWGGVATEKLQLNHDTLWTGAPGNYTDPEAPAALAVVRELVNQGRFADATEAARRLFGGQSEVSLQYGFVLVSLGAVSTHNVYLKT

SEQ ID NO: 29316 - DNA, 484 bp, Panicum virgatum
  misc_feature: Ceres CLONE 1890582
  misc_feature: Encodes the peptide sequence at SEQ ID NO. 29317
ccccgcttaatttcggcagccgcagctcctcccttcgcttcgcttgctggtgtccgagagcctcagcttcgccttgctgtcggtctcactccctcggctcttctaccccgcactgtcgccggcgccgggggcgggaactagtcggcgggcgggggcggcgcgcggcgccgggcgcggatcggccgcgggtgcatggtggaggccgccgcggggcgccggtaggggaccacgcggcagcggccgatggggaggcgacgttaccgcagctcctaggtggtggtggccggctcggcggccatggcggagcagttcctccgcgtccgcgacgctaacttcagctgccgcccaccgaactccggcggggagcacatggcgcacacctaccaggacgtcgcgttcgctccctacggtccccggtggcgcgcgatgcggaaggtgtgcgccgtgaacctcttctccgcgcgcgcgctcaacgacctccgcg

SEQ ID NO: 29317 - protein, 62 aa, Panicum virgatum
  misc_feature: Ceres CLONE 1890582
  misc_feature: SWISSPROT Homolog: EC 1.14.13.21 Flavonoid 3'-monooxygenase
MAEQFLRVRDANFSCRPPNSGGEHMAHTYQDVAFAPYGPRWRAMRKVCAVNLFSARALNDLR

SEQ ID NO: 29318 - DNA, 669 bp, Panicum virgatum
  misc_feature: Ceres CLONE 1890666
  misc_feature: Encodes the peptide sequence at SEQ ID NO. 29319
agacagtagctagacagtaatgggtttcagcgaggctcaggaagagctcgttctgcgctcatggaaagccatgaagaaggacgccgaatccattgctctcaagttcttcttcaggatctttgagatcgcgccgggcgccaagcagatgttccccttcctgcgcgacgccggcgacgcgcccctggagaaccaccccaagctcaagacgcacgccgtcgccgtcttcgtcatggcttgcgagtccgcgacgcagctgcggagcaccggcgacgtgaaggtgagggaggcggcgctgaagcggctgggcgcgacgcacgtcagggccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacaccgccgccgcctgagttcatcgggaagaccttaacactcagacacacacatccctgctgctgcctgctgcctgctgcctgctgcctgctgctgctgcgaagaacgcgcgttgcttgggagagctgagctgccactgctgctgctgctactactctacgaagctgtcgctactgctactgtgttctgtttt

SEQ ID NO: 29319 - protein, 157 aa, Panicum virgatum
  misc_feature: Ceres CLONE 1890666
  misc_feature (7)..(117): Pfam Name: Globin Pfam Description: Globin
  misc_feature: SWISSPROT Homolog: EC 1.14.12.17 Nitric oxide dioxygenase
  misc_feature: Functional homolog of the protein sequence given in SEQ ID NO 50202
  misc_feature: Useful for making plants with modulated cold sensitivity
  misc_feature: Useful for making plants with modulated salt sensitivity
MGFSEAQEELVLRSWKAMKKDAESIALKFFFRIFEIAPGAKQMFPFLRDAGDAPLENHPKLKTHAVAVFVMACESATQLRSTGDVKVREAALKRLGATHVRAGVADAHFEVVKTALLDTIRDAVPDMWTPEMKAAWEEAYDQLAAAIKEEMKNTAAA

SEQ ID NO: 29320 - DNA, 1305 bp, Panicum virgatum
  misc_feature: Ceres CLONE 1890672
  misc_feature: Encodes the peptide sequence at SEQ ID NO. 29321
atcaagcgggcagcaggcagcagcagcaccgggacacgactcccctcaccatgtcttcttccccttcctcggcccactggctgagcctcgtcgggagcatctggctgcagaccatcaacgggcccaacgccgatttccccgtctactcgtcgcagctcaaggacctgaagcacatctcgcaggtgcagctcaacttcctggccttcgcgtccgacgccggcaagctcttcgggtggttctccggggtggccgcgctctacctgccgctctggctggtcgccttcgtcggcgccgcgttcggcctcgtcggctacggcgtccagtacctcttcctcgacagcgccggcctccggtactggcacctgttcctgctcacctccctggctgggaatggcatctgctggatcaacaccgtctgctacctcctctgcatccggaacttcggctccagcagccgcgtcgcggtgagcctcgccaccagctacctcggcctcagcgccaaggtctacaccagcctggccgactccatacccggcctggccaactccaaggccaaggcctacctcctcctcaatgccgtcgtgcccatgctcgtcaccgtcgtggtggcgccgtcgctccgggtggtcgacctcacgagcgcggcgagcacggacgcggcattcctcgtcatgttcgccatcacgctcgccacgggcgcctgcgccgtcgtcggcagcatcggctccacgtccaacgggctgtcgtcgagggagcacatggtcagcctcggcgtgctgctcgccacccccatcctcatcccgctggcgctcaggatccgcgagagcctcgacaagatacgggagaccaagcgggagaacaggatccacgacctcggcgccgacgatgccgacgccatcgagagggtcgtcgccatcgatatcgccgacgccgggagcaaggcgggggaccctgccgcggagttgccgcgagaggaggtcggcggcctccggctgctgaggaagctcgacttctggctctacttcttcagctacatgttcagcggcaccctgggtctggtgttcctcaacaacctgggacagatcgccgagtcgcgacggctcgcgcagacttccactctggtctcgctgtcgtcttcgtttggattcttcggccgcctgctcccctccttcctggactactactccgcgaagagcggctactccatctcaaggacaggatccatggcgtcgctgatggcgcccatgggcgggagccttcttcctgctgctccacccgagcgacctcttcctgtacctgagcacg

SEQ ID NO: 29321 - protein, 418 aa, Panicum virgatum
  misc_feature: Ceres CLONE 1890672
  misc_feature (9)..(252): Pfam Name: Nodulin-like Pfam Description: Nodulin-like
MSSSPSSAHWLSLVGSIWLQTINGPNADFPVYSSQLKDLKHISQVQLNFLAFASDAGKLFGWFSGVAALYLPLWLVAFVGAAFGLVGYGVQYLFLDSAGLRYWHLFLLTSLAGNGICWINTVCYLLCIRNFGSSSRVAVSLATSYLGLSAKVYTSLADSIPGLANSKAKAYLLLNAVVPMLVTVVVAPSLRVVDLTSAASTDAAFLVMFAITLATGACAVVGSIGSTSNGLSSREHMVSLGVLLATPILIPLALRIRESLDKIRETKRENRIHDLGADDADAIERVVAIDIADAGSKAGDPAAELPREEVGGLRLLRKLDFWLYFFSYMFSGTLGLVFLNNLGQIAESRRLAQTSTLVSLSSSFGFFGRLLPSFLDYYSAKSGYSISRTGSMASLMAPMGGSLLPAAPPERPLPVPEH

SEQ ID NO: 29322 - DNA, 470 bp, Panicum virgatum
  misc_feature: Ceres CLONE 1890709
  misc_feature: Encodes the peptide sequence at SEQ ID NO. 29323
atgaaggggctggacggcatccagggccccgtctacgtcggcaccggctgcgtcttcaaccgccaggcgctctacggctacgacccgccgcgcccggagaagaggcccaagatgacgtgcgactgctggccgtcctgatgctgctgctgctgctgcttcggcggcggcagcaagcaccagcgccgcggcaagaacgagggcggcggcgccgactccggcgccgacgagccgcgccgcggcctgctcggcttctacaggaagcgcggcggcaagaaggacaagctcggcgccaagaagggcggcgccgggatctacagcaagaagcaccagcagcgcgccgcgttcgagctggaggagatcgaggagggcctggaggggtacgaggagctggaccgctcctcgctcatgtcgcagaagggcttcgagaagcgcttcggccagtcgccggtgttcatcgcctccacgctcgt

SEQ ID NO: 29323 - protein, 45 aa, Panicum virgatum
  misc_feature: Ceres CLONE 1890709
  misc_feature: SWISSPROT Homolog: EC 2.4.1.12 Cellulose synthase (UDP-forming)
  misc_feature: Functional homolog of the protein sequence given in SEQ ID NO 50363
  misc_feature: Useful for making plants with altered cell wall content and/or composition
  misc_feature: Useful for making plants with modulated biomass
  misc_feature: The sequence is a functional homolog of SEQ ID NO 26 in US patent 7312377
  misc_feature: The sequence is a functional homolog of SEQ ID NO 2 in US patent 7049481
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: Functional homolog of the protein sequence given in SEQ ID NO 50125
  misc_feature: Useful for making plants with modulated plant growth and development
MKGLDGIQGPVYVGTGCVFNRQALYGYDPPRPEKRPKMTCDCWPS

SEQ ID NO: 29324 - DNA, 732 bp, Panicum virgatum
  misc_feature: Ceres CLONE 1890710
  misc_feature: Encodes the peptide sequence at SEQ ID NO. 29325
  misc_feature (639)..(639): n is a, c, t, g, unknown, or other
cccagtcagcatgcctagacctccttggcgtgaaaggcgcgaaccgggagtcccctggatcaaacgcgaggctgctggccaccgtagtggccggcggggttctcgccggggagttatccctcctgtccgcactcgctgctggccagctcgtgaagagccacatgaagtacaacagatccagcaaggacatgtccaagatcgtgccttgatcctggatttggatcgtcgcagggggaagatggacggatccggatagtgaaaatgccgtggaataagtttttcatgtccggtggaagcgcagaggtggggttggagggactgggcatggacagggctgaggttgtttgacacctggtcactttcccaagagccaaaagaagaattcaccgtcgacatcaagtgagctgcgaacagtgtgcatcaagcgaaaccgtcaagattgtgaattggccaggtccttgttctggagctgacccatttctttcttgacgccggccactccaactcggtcatgaaaccctgccaccgccgtcccctgcgcgctgaccaccggagaagcgagctaaccaacctctgtgtttcgtgttcataaaagctttgatcaccttggtgcagaaagcgttgttgttattgttgtangcccttgttagatctctcgccccttgcttcaggaagcagcagcttgtgaacctttttctattccccctttcagatctgcaactatttttctcc

SEQ ID NO: 29325 - protein, 68 aa, Panicum virgatum
  misc_feature: Ceres CLONE 1890710
  misc_feature: SWISSPROT Homolog: EC 1.1.1.34 Hydroxymethylglutaryl-CoA reductase (NADPH)
QSACLDLLGVKGANRESPGSNARLLATVVAGGVLAGELSLLSALAAGQLVKSHMKYNRSSKDMSKIVP

SEQ ID NO: 29326 - DNA, 481 bp, Panicum virgatum
  misc_feature: Ceres CLONE 1890715
  misc_feature: Encodes the peptide sequence at SEQ ID NO. 29327
aggtctcttcctcccttgcagccagcgcgccaccatgcagctcgcggagctctgcaccgaccccgtcgtgctctcctgcgccctcctctgcctcctcctccacctcgcgctccgctcctcctccggccgcggcggcggccgccgcctcccgccggggcctcctggcctcccgatcctcggcgcgctcccgctcgtcggcccggccccgcacgccgggctcgccgcgctggcgcgccggtacggccccatcatgtacctgaagatgggcacggccggggtggtggtggcgtcgtcccccgccgcggcgcgcacgttcctgatggcgctggacgcgcggcacgccaaccgccccgccgtggcgagcgccgcggatctcacgtacggctgccaaagcatgctgttcggccactaacggccaccgcggaccctgatgcgaaaactgctccatcagcccctgtgcggggcgccctcgagctgctga

SEQ ID NO: 29327 - protein, 125 aa, Panicum virgatum
  misc_feature: Ceres CLONE 1890715
  misc_feature: SWISSPROT Homolog: EC 1.14.13.88 Flavonoid 3',5'-hydroxylase
MQLAELCTDPVVLSCALLCLLLHLALRSSSGRGGGRRLPPGPPGLPILGALPLVGPAPHAGLAALARRYGPIMYLKMGTAGVVVASSPAAARTFLMALDARHANRPAVASAADLTYGCQSMLFGH

SEQ ID NO: 29328 - DNA, 680 bp, Panicum virgatum
  misc_feature: Ceres CLONE 1890718
  misc_feature: Encodes the peptide sequence at SEQ ID NO. 29329
acccaaaaaaattatcgaatcccgcctccctcgtttcgccccaacccaaaaccgagttccctccaattccacccgcctcccctccgagatggacgccggcgcaccgaaggtgaagaaggcggcggcgggccgcaagcttggcgggccgaagaagaagccggtgtcgcgctccgtcaaggccgggctccagttccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcaccttgctttgtgtgtatgtagtgccgcatctcaatgtatcgtgtcctccgagcttcggatcctatgtcgtaggtctaggctttagctgtagtggttggtgatggggatatgtatgtttccaaaatttaatgagaagtgggagcggtttgctttcctttacg

SEQ ID NO: 29329 - protein, 129 aa, Panicum virgatum
  misc_feature: Ceres CLONE 1890718
  misc_feature (15)..(78): Pfam Name: Histone Pfam Description: Core histone H2A/H2B/H3/H4
MDAGAPKVKKAAAGRKLGGPKKKPVSRSVKAGLQFPVYLAAVLEYLAAEVLELAGNAARDNKKNRIIPRHVLLAIRNDEELGKLLAGVTIAHGGVLPNIHSVLLPKKAAEKAEKAAKSPKKAAAKSPKK

SEQ ID NO: 29330 - DNA, 709 bp, Panicum virgatum
  misc_feature: Ceres CLONE 1890736
  misc_feature: Encodes the peptide sequence at SEQ ID NO. 29331
acgcctgatcccaccgccgccgtttcctcgggcgctcccgctcgacaagcctacatgggcgtagcaccagcggcgggcggtttcgtcttagccttggcttcttccagcttccgcttctgctccgcctagctgcctacgctctcgcttccagtggcgggagcgcccaatggacgaggagatcggcggcgccgccgcgcggcaggttcagtggaaaatttactgcaaaactctctccgtgctagcgttccagagcttaggtgtggtgtatggagacttgagtacgtcgcctttgtacgtctacagaaactcattgtccggaagactgaatgcctacattgatgagacaaccatctttgggttgttttctctgatattttggactcttacactggttccactgctgaagtacgtcataattgtattgagtgcggatgataatggggagggtggaccgtttgctttgtactcacttctttgcaggcatgcaaaattcagtttgctgccaaaccagcaagcggcagatgaagagctgtcaacatattatcagccaggcactggtcgccctgcggtgtcctctccattcaaaaggtttctagagaagcacaggaagctgcggacctgtttacttctttttgttctgtttagtgtctgcatggtgataggtgatggtgtacttacaccaactatatccgttttgtcagccatctct

SEQ ID NO: 29331 - protein, 180 aa, Panicum virgatum
  misc_feature: Ceres CLONE 1890736
  misc_feature: Functional homolog of the protein sequence given in SEQ ID NO 50430
  misc_feature: Useful for making plants with modulated biomass
MDEEIGGAAARQVQWKIYCKTLSVLAFQSLGVVYGDLSTSPLYVYRNSLSGRLNAYIDETTIFGLFSLIFWTLTLVPLLKYVIIVLSADDNGEGGPFALYSLLCRHAKFSLLPNQQAADEELSTYYQPGTGRPAVSSPFKRFLEKHRKLRTCLLLFVLFSVCMVIGDGVLTPTISVLSAI

SEQ ID NO: 29332 - DNA, 584 bp, Panicum virgatum
  misc_feature: Ceres CLONE 1890746
  misc_feature: Encodes the peptide sequence at SEQ ID NO. 29333
actcagctgagcgagctcctcgcgggcgtggccagctcgggggttccgacccgtgagaggcggcccaggcgccggagggatggcggcgccggcgctgcggtggtggtggtgggcggcggcggtcctgtcgttggtgctcggcgtgagccgccgggtcgtcgccaacacggagggtgatgctctatacagtctacgccaaagcctgaaagatactaacaatgtgcttcagagttgggatcccactttggtgaatccatgtacatggttccatgttacttgtaacaccaataacagtgtcatcagacttgatcttggaaatgcacaactagcaggtccattggtgccacagcttgggcagttgaaaaatatgcaatatctggaactctacagtaacaacataagtgggccaataccgcctgaactggggaacttaactaacctggtcagtttggatctgtacctcaacaacttcactggcaatattcctgacaccttggggcaactattgaagctgcggtttctccgtcttaataacaataccctttctggtcaaattccaaagaccttgactgctatcaccactc

SEQ ID NO: 29333 - protein, 168 aa, Panicum virgatum
  misc_feature: Ceres CLONE 1890746
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAPALRWWWWAAAVLSLVLGVSRRVVANTEGDALYSLRQSLKDTNNVLQSWDPTLVNPCTWFHVTCNTNNSVIRLDLGNAQLAGPLVPQLGQLKNMQYLELYSNNISGPIPPELGNLTNLVSLDLYLNNFTGNIPDTLGQLLKLRFLRLNNNTLSGQIPKTLTAITT

SEQ ID NO: 29334 - DNA, 2312 bp, Panicum virgatum
  misc_feature: Ceres CLONE 1890759
  misc_feature: Encodes the peptide sequence at SEQ ID NO. 29335
tcacctagctcctgcttactactcacatagtcacatttcccactaaaccccgacggtgccgagacgcacgcatcgcgacgcctccccgcacgcaggcacggacccctgtctatctcatctcacgcacgcagcagcaggcgcggaaagcgacgcgccttcaccgcccctgcttgccgcctccctcccctccccgtatcgtcgtcctcctgccccggacgcggccaagcagcaagcgcccaaaccccccaaacccaagcctctggcggcgcccgcgccaccttgaagcaagcgcccgtgcgcgattggcgggtcggagcgtttgaagcggcgcgaggagtggagatggtggcggcggcgctggacgcaatggcggggacgcggtgggggcggtggctcggcctggtgacggcggtgtgggtgcagtgcatctccggcaacaactacaccttctccaacggcctctccgtcgccaaggacgtcggcaaggcgttcggcctcctcgcggggctcgcctccgaccgcgtccccacctggctcctcctcgccatcggctccctcgagggcctcctcggctacggcgcgcagtggatggtcgtgtccgggaccgtcgcgccactcccctactggcagatgtgcgtcttcctctgcctcggcggcaacagcaccacctggatgaacaccgccgtgctcgtcacctgcatccgcaacttccgccgcagcagggggcccgtgtccggcctgctcaagggatacgtcggcctcagcaccgccgtcttcaccgacatctgctccgcgctcttcgccgacaacccggcctcgttcctcgtcatgctcgccgtcgtgccggccgcggtctgcgcgctcgccatggtgttcctccgcgagggccccgccggcggcgccgcgggcgccaccgcggacgaggcggaagacgggcgctgcttcgccgcgatcaactcgctcgccgtggccatcgctctgtacctcctcgccgcggacctcacgggcgtcggcggcggcggcggggtcgtctcgggcgtcttcgtggccgtgctcctggtcctcatcgcgtcccccggcgccgtgccggcgctcctggcgtggaaatcgtggatgaaggctcgcaaggccgcgaacgccgacctcgaggaggcggagtccctggacgccgcggccgctccgctcctcgtcgcggcgaaggcggcggggatgagcgaggaggacaaggcgcgggcgcctggtgagcggccgcggctcggggaggagcacacgatcgcggaggcgctgacgtcgctggacttctggctgatgttcgcgtccttcctgatgggcgttggcacggggctggccgtgatgaacaacctggggcagatgggcgtggccatgggctacgacgacgtttccctcttcgtctccatgaccagcatctggggattcttcggccgcatcgcatccggcaccatctccgagcacttcatcaggacaagggcgataccacgcccgctgtggaacgcggcctcgcaggtcctcatggccgtgggctacatcgtgatggccctggccatgccgggctccctcttcatcggctcggtggtcgtcggcgcctgctacggcgtccggctggcggtcacggtgccgacggcgtccgagctgttcgggctcaagtactacggcctcatctacaacatcctcatcctcaacctgcccctgggctccttcctcttctcgggcctgctggcgggcctcctgtacgacgcggaggccaccgcggtgcccggcggcggcaacacctgcgtcggcgcgcactgctaccgcctcgtgttcctgatcatggccgtcgcctgcgtagtcgggttcggcctcgacgtcctgctctgcgtcaggacgaagcgggtgtacgccaagatccacgagagcaagagggcgagcaggtcggccgcggcgcagagggtgagctagcctcgctgcttccgtggaaagcccgaggggtgagtggatcgcgccatcagcgttctggggccgcagggcctgcaaatttttgtgtgaataagggcaggggattcatgtcctgattctttggacaagatggatggatcgaattcgattgcttggcaccgccatatggaagcgtcggctggttacactggagtactggctgggggctgcaaaattttgttggttccccttacagttcgtagtggtctgtatacggtgtactgttcctgaatacacgtgtaaaactgttttttttatcgtagtatgtactgtggcacacgtgttctgataattccaatttccaaatacattttcgg

SEQ ID NO: 29335 - protein, 538 aa, Panicum virgatum
  misc_feature: Ceres CLONE 1890759
  misc_feature (16)..(250): Pfam Name: Nodulin-like Pfam Description: Nodulin-like
MVAAALDAMAGTRWGRWLGLVTAVWVQCISGNNYTFSNGLSVAKDVGKAFGLLAGLASDRVPTWLLLAIGSLEGLLGYGAQWMVVSGTVAPLPYWQMCVFLCLGGNSTTWMNTAVLVTCIRNFRRSRGPVSGLLKGYVGLSTAVFTDICSALFADNPASFLVMLAVVPAAVCALAMVFLREGPAGGAAGATADEAEDGRCFAAINSLAVAIALYLLAADLTGVGGGGGVVSGVFVAVLLVLIASPGAVPALLAWKSWMKARKAANADLEEAESLDAAAAPLLVAAKAAGMSEEDKARAPGERPRLGEEHTIAEALTSLDFWLMFASFLMGVGTGLAVMNNLGQMGVAMGYDDVSLFVSMTSIWGFFGRIASGTISEHFIRTRAIPRPLWNAASQVLMAVGYIVMALAMPGSLFIGSVVVGACYGVRLAVTVPTASELFGLKYYGLIYNILILNLPLGSFLFSGLLAGLLYDAEATAVPGGGNTCVGAHCYRLVFLIMAVACVVGFGLDVLLCVRTKRVYAKIHESKRASRSAAAQRVS

SEQ ID NO: 29336 - DNA, 597 bp, Panicum virgatum
  misc_feature: Ceres CLONE 1890772
  misc_feature: Encodes the peptide sequence at SEQ ID NO. 29337
gctctccgcagagcagaggcatggcaccaccgctcagcagcttctccgtgctccgacgaagccgagcgcaccggaagccgcggctgctcttcttcttgctcgccgtcatcaccgccggcgtcgtgccgaggagcgccaacgcgatcacccggcgcgacttccccgaggggttcgtcttcggcgcctggtcatcggctttccaggtggaaggggcagctgcagaggatggaagggcaccaagtatttgggacaccttcacccatgaaggttattcgtacgacagatccactgcagatgtttcagcagatcagtatcaccactacaaggaagacgtaaagcttatgcatgtgatgggtttagacgcctacagattctcaattgcttggcccaggcttattcctgatggaagaggagagatcaacccaaaagctttggaatactacaacaatctcatagatgaactgatactgcacgggattgagcctcatgtcaccatctaccattttgatcttcctcaggtccttcaggatgaatacggtggactcctcagccccagattcatagaagactacactgcatttgcagaggtctgcttca

SEQ ID NO: 29337 - protein, 192 aa, Panicum virgatum
  misc_feature: Ceres CLONE 1890772
  misc_feature (43)..(192): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51166
  misc_feature: Useful for making plants with altered cell wall content and/or composition
  misc_feature: Functional homolog of the protein sequence given in SEQ ID NO 50255
  misc_feature: Useful for making plants with altered carbohydrate content
  misc_feature: Functional homolog of the protein sequence given in SEQ ID NO 50615
  misc_feature: Useful for making plants with modulated biomass
MAPPLSSFSVLRRSRAHRKPRLLFFLLAVITAGVVPRSANAITRRDFPEGFVFGAWSSAFQVEGAAAEDGRAPSIWDTFTHEGYSYDRSTADVSADQYHHYKEDVKLMHVMGLDAYRFSIAWPRLIPDGRGEINPKALEYYNNLIDELILHGIEPHVTIYHFDLPQVLQDEYGGLLSPRFIEDYTAFAEVCF

SEQ ID NO: 29338 - DNA, 715 bp, Panicum virgatum
  misc_feature: Ceres CLONE 1890778
  misc_feature: Encodes the peptide sequence at SEQ ID NO. 29339
atctcaaaaaaaaacttcgtcaatgacagagagaggggggaaacgaggagccgagcaccggcgcagccaaggcgaaggcgtcagtagcttcttccggttgcctccgtcccggcggcgtcttctccggtcgggctttttgtccggcgagcctctccgccaggaagaggccgtggcgctcgagggagtgctccaggcactagatggagctcgacgtgaaaggaaagcgggcccgtgcaagaagcagcagcagcagcggcggcggcggcttgaccggcggcgaccggctgagctccctgccggattgcctcatccaccacatcatgtccttcatgaaggcccgccaggtggtgcagacctgcgtgctgtccaccaggtggaagcacctctggcgctccgtcccctgcctcgacatcgaccaagaggagttcaagactggtgaagactcggaccacgagtgggagaaatttgaggacttcaccgaccacctgcttatccctaataatatttccattgcgctcttggatacattccgtctacatgttagatcttattgggctcgtcatgcagccagatggatccgtcatggcataaagtacagcacccgggaacctggcatgcagcaccaggggattgagctcgaactcctggcgcctaagagggctatatcttaacaacttatatttggattacactttcacagagcatgttcagttcg

SEQ ID NO: 29339 - protein, 156 aa, Panicum virgatum
  misc_feature: Ceres CLONE 1890778
  misc_feature (27)..(74): Pfam Name: F-box Pfam Description: F-box domain
MELDVKGKRARARSSSSSGGGGLTGGDRLSSLPDCLIHHIMSFMKARQVVQTCVLSTRWKHLWRSVPCLDIDQEEFKTGEDSDHEWEKFEDFTDHLLIPNNISIALLDTFRLHVRSYWARHAARWIRHGIKYSTREPGMQHQGIELELLAPKRAIS

SEQ ID NO: 29340 - DNA, 3209 bp, Panicum virgatum
  misc_feature: Ceres CLONE 1890794
  misc_feature: Encodes the peptide sequence at SEQ ID NO. 29341
aaaaatagcagcactctcctactgcttccccctctctggctctctccccacgtctccgccgcgctgcgctacgccactacccccactcctccccgcaccgccccagagctgctccgcgcaaatgggcagagcgccgctgtgatccctcctcgctcgtcctcctgccccgccgcgtcgcgatggccgccgcctgcccgctcctcctgcccctcgccgcgctgctcctcgcggcggccgcgacgacgggcgcgctcaccgacgacgtgctcgcgctggtggtcttcaagacgggcgtctccgacccgtcgggccgcctcgccacgtggaccgaggacgacgaccgcccctgctcctggccgggcgtcggctgcgacgcgcgcacgggccgcgtcacctcgctcgcgctcccggcggcgtcgctctccggccgcctcccgcacgcgctgctccgcctcgacgcgctcctctccctcgcgctcccgcgcaacaacctctcggggcccgtgctccccaacctcctcgccgcgctcccgcggctccgctccctcgacctctcctccaaccgcctcgccgcgcccgtccccgcccagctcttcgcccaatgccgctccgtccgcaccatctccctcgcgcacaaccagctctccggctacatcccacccgccgtcgcgtcctgcgcctcgctcgtgtccctcaacctctcgtccaaccgcctcgccgggccaatccctgacgggctatggtcgctgccttttctccgctctctcgacctctccggcaacgagctctccgggagtgtgcccggcggattcccccgtagcagctcgctacgggacctggatttgagccgcaacctcctcgccggggagataccggcggatgtcggcgaggcggcgctgctcaagtcactggattttgggcataatttgttcacgggcggtctgccggagtcgctccggaggctgaccgggctgcggttcctcagcgccggcggcaatgcacttgcaggggagctgccggcgtggatcggcgaaatgtgggcgctggagcggcttgacttgtcgggcaaccgattcgccggcgacattccctacaccatcgcgaactgcaagaaccttgtggaggtagaccttagccgtaatgcgctcaccggcgagcttccctggtggctgttcggcctgcccctgcagcgcgtctcggtggctggcaaccagctcaacgggtgggtcaaggtgcccgaggacgctgcaatggcgcttcgtgtgctggacctgtcgagcaacgcgttctccggcgagatcccgccgcggatcactgcctttgcgggtttgcagtctctgaacctgtcgtcgaattccttgtcggggcagctgccggccggcattggcgggatgaggctgctcgaggtgctcgacatgagcgctaaccgacttgacggaaccgtgccctcggagattggcggcgcggtggcgctccgggacctccggatggggaggaattcgctcacgggtcgcatccccgcacagattgggaactgcagctccctcgtttcactggatttgtcacacaatagcctcacggggccaattcctagcaccatgggcaacctgagcagtctccaggtggtcaatctctctcagaacaagctgaaggggaccctacccgtggagttatccaatctgcctagcctccacatattcgacgtctcccacaacatgctgacaggagatctgcccaatagccgcttctttaacaacatccctgactccttcatcatggacaattctggtctctgtacctcacggaagaatgattcatgcagtgctgttttgccaaagccgattgtgctcaaccccaactcttcatcaaatccctcatcgcaggctgcacctagtgcacctagcaacactcatcacaagaaaatcatactgagcatctccaccctcgttgccattgcgggtggggctgccattgctatcggagtgatcaccatatctgtgctcaaccgccgcgtccgtgaccgtgcagcggcctcccgctcaacacctgctactgcattatctgatgattaccttagccagtccccagagaatgatgctagctccgggaagcttgtcatgtttggtaagggcagccctgagttcagcgctggtggccatgcgttgttgaataaggattgtgagcttgggcgtggaggatttggtgcagtctacaagacagttctcagagatggacagccggtagccatcaagaagcttactgtctctagcttggtcaagtcaaaggatgattttgagcggcaagtaaagatgcttagcaaggtgcggcaccacaatattgtcgcgctcagaggcttctactggacttcgtcactgcagctcctcatctatgattacctgcccggaggaaatctgcataaacacctgcatgagtgcaatgaagaaaactcactttcctggatggagaggtttgatatcatcctcggtgttgccaaagggttgacatacctgcaccagcatggggtcatccattacaatctcaagtcaagcaatgtgctgctggatagcaatggggagccaaaggtaggcgactatggcctcgccaagctgctgccaatactggacaggtacgtgctgagcagtaagatccagagcgcacttgggtacatggccccagaatttgcatgcaagacggtgaagatcaccgagaagtgtgatgtgtatggctttggggtgcttgtgctggaggtcttgacgggcaggaggcctgttgagtacttggaagacgacgtcgttgtgttatgtgatttggtcagaagcgctctggaggaaggcagaccggaagactgcatcgatccgcgactgtgcggcgaggtccccatggacgaggccctgccgatcatcaagctgggcctggtctgcacctcgcaggtgccatcgaaccggcctgccctgggcgaggtggtgagcatactcgagctggtgaggagtcctcaggatagtgccgaggatgagctggtttgagcactacccgggatctctgttctaattcgtcttgagccttttcttttttgttttgtgagatgcatatatgattgctcggtggggaagaaaggagggggatgcagactgcggtgcagcccagagagtgaaatgcttgtaatgtgttcagagttttagggatgcaaaagcccgtgtgttgcttctcag

SEQ ID NO: 29341 - protein, 947 aa, Panicum virgatum
  misc_feature: Ceres CLONE 1890794
  misc_feature (663)..(932): Pfam Name: Pkinase Pfam Description: Protein kinase domain
  misc_feature (25)..(65): Pfam Name: LRRNT_2 Pfam Description: Leucine rich repeat N-terminal domain
  misc_feature (42)..(520): SWISSPROT Homolog: EC 2.7.11.1 Non-specific serine/threonine protein kinase
  misc_feature (669)..(941): SWISSPROT Homolog: EC 2.7.10.1 Receptor protein-tyrosine kinase
MAAACPLLLPLAALLLAAAATTGALTDDVLALVVFKTGVSDPSGRLATWTEDDDRPCSWPGVGCDARTGRVTSLALPAASLSGRLPHALLRLDALLSLALPRNNLSGPVLPNLLAALPRLRSLDLSSNRLAAPVPAQLFAQCRSVRTISLAHNQLSGYIPPAVASCASLVSLNLSSNRLAGPIPDGLWSLPFLRSLDLSGNELSGSVPGGFPRSSSLRDLDLSRNLLAGEIPADVGEAALLKSLDFGHNLFTGGLPESLRRLTGLRFLSAGGNALAGELPAWIGEMWALERLDLSGNRFAGDIPYTIANCKNLVEVDLSRNALTGELPWWLFGLPLQRVSVAGNQLNGWVKVPEDAAMALRVLDLSSNAFSGEIPPRITAFAGLQSLNLSSNSLSGQLPAGIGGMRLLEVLDMSANRLDGTVPSEIGGAVALRDLRMGRNSLTGRIPAQIGNCSSLVSLDLSHNSLTGPIPSTMGNLSSLQVVNLSQNKLKGTLPVELSNLPSLHIFDVSHNMLTGDLPNSRFFNNIPDSFIMDNSGLCTSRKNDSCSAVLPKPIVLNPNSSSNPSSQAAPSAPSNTHHKKIILSISTLVAIAGGAAIAIGVITISVLNRRVRDRAAASRSTPATALSDDYLSQSPENDASSGKLVMFGKGSPEFSAGGHALLNKDCELGRGGFGAVYKTVLRDGQPVAIKKLTVSSLVKSKDDFERQVKMLSKVRHHNIVALRGFYWTSSLQLLIYDYLPGGNLHKHLHECNEENSLSWMERFDIILGVAKGLTYLHQHGVIHYNLKSSNVLLDSNGEPKVGDYGLAKLLPILDRYVLSSKIQSALGYMAPEFACKTVKITEKCDVYGFGVLVLEVLTGRRPVEYLEDDVVVLCDLVRSALEEGRPEDCIDPRLCGEVPMDEALPIIKLGLVCTSQVPSNRPALGEVVSILELVRSPQDSAEDELV

SEQ ID NO: 29342 - DNA, 550 bp, Panicum virgatum
  misc_feature: Ceres CLONE 1890815
  misc_feature: Encodes the peptide sequence at SEQ ID NO. 29343
tgatctagctagcagctagggcagctgctcgattgatcgatctccctcgcccgcctcctcctgtactcgtcaaccccgcgagatgcagggctagccattactcccctcataatctctctctccctcactcgaccattcaaagccaagcaaagcaagcaagaagattaggaagaggcaggagtatcggagcggaaagattaattaagtggccgccggtgtgtgtgtgtgtgtgatgatgaagaggatggtgatcctgcggcggtgccacccaccgccgccgccggcggcggtgctcctgggcgggtgcggtcgcggcggcgtgcggtacggtgagtgccggaggaaccacgcggcgagcatgggcgggcacgacgtggacgggtgccgcgagttcctggacgagggggaggacggcaccgccgccgcgctccgctgcgcggggagcgggtgccaccgcaacttccacgaccacgtcgagaggagctgctgctgccacgaccactacgacgcgccgacgaccggcacccagttttgatagggcagcgacggc

SEQ ID NO: 29343 - protein, 96 aa, Panicum virgatum
  misc_feature: Ceres CLONE 1890815
  misc_feature (23)..(80): Pfam Name: ZF-HD_dimer Pfam Description: ZF-HD protein dimerisation region
  misc_feature: Functional homolog of the protein sequence given in SEQ ID NO 50410
  misc_feature: Useful for making plants with modulated low light sensitivity
MVILRRCHPPPPPAAVLLGGCGRGGVRYGECRRNHAASMGGHDVDGCREFLDEGEDGTAAALRCAGSGCHRNFHDHVERSCCCHDHYDAPTTGTQF

SEQ ID NO: 29344 - DNA, 718 bp, Panicum virgatum
  misc_feature: Ceres CLONE 1890834
  misc_feature: Encodes the peptide sequence at SEQ ID NO. 29345
  misc_feature (611)..(611): n is a, c, t, g, unknown, or other
accagagaaaacagagcccccacaggcagaccggaaccccgaacccgcgaatcaatcccgaatcccgatcggccggcggcgctgggagggcgatgccggagaaggcggtcgacgacgtcatggaggcggcggtgggggcccacttcagcggcctccgccttgaggcgctccgcctctcctccccgtcctccccatcctccccttcctctgccagggcctccccggccgccgccacccactccaacggcgccgtctacgccaacggcactgccgccgcggcggcggtggagctcgcctccccgcccgccgccaggcagcccttcgtcatcggggtttccggagggacggcgtcggggaagacgacggtgtgcgacatgatcatccagcagctgcacgaccaccgcgtcgtgctcgtaaaccaggattccttctatcggggcctgactgctgaagaatctgcacgtgcccaagactacaattttgaccaccctgatgcatttgatacagaacaacttctggaatgcatgggacagctgaaacgtgctcagcctgtaaatgttcctatatatgatttcaagaagcaccgacggtgctctgaaagttttaggaanggtcacgcatcagatgtcatcattttggagggaattttagtctttcatgatcagagagttcgcaatctgatggacatgaaaatttttgtggacacagatgctgatat

SEQ ID NO: 29345 - protein, 208 aa, Panicum virgatum
  misc_feature: Ceres CLONE 1890834
  misc_feature (78)..(208): Pfam Name: PRK Pfam Description: Phosphoribulokinase / Uridine kinase family
  misc_feature: SWISSPROT Homolog: EC 2.7.1.48 Uridine kinase
  misc_feature (173)..(173): Xaa is any aa, unknown, or other
MPEKAVDDVMEAAVGAHFSGLRLEALRLSSPSSPSSPSSARASPAAATHSNGAVYANGTAAAAAVELASPPAARQPFVIGVSGGTASGKTTVCDMIIQQLHDHRVVLVNQDSFYRGLTAEESARAQDYNFDHPDAFDTEQLLECMGQLKRAQPVNVPIYDFKKHRRCSESFRXGHASDVIILEGILVFHDQRVRNLMDMKIFVDTDAD

SEQ ID NO: 29346 - DNA, 704 bp, Panicum virgatum
  misc_feature: Ceres CLONE 1890865
  misc_feature: Encodes the peptide sequence at SEQ ID NO. 29347
ttttatgaaaaggaagggcttcctgctttccccatgggcaatattgatcaaacacgtatgtggaaggtgggtgaaagggtgcgttcaaccaggccacaaggtgaccttggcccattgcatcccttcactgctggagtgtatgttgcattaatgatggctcagattgaggtccttaggaagaagggccactcttactccgagatcatcaatgagagcttgattgagtctgtggactcgctgaacccattcatgcatgctcgtggggtggccttcatggttgataactgctccacgactgctcgcttgggatcaaggaagtgggcaccgcgtttcgactacatcctgactcaacaagcttttgttactgttgataagaaggcaccaatcaaccaagacctcattagcaacttcatgtctgatcccgtccatggtgccattgaagtctgtgctcagctgaggcccaccgtcgacatatcagtacctgctgatgccgattttgtgcgcccagagctccggcagtcttcctaaagtttgtatcgatctgcagtccgcctcagtggttaggttatataaggggtactatgagtgtgggtgtttgaactcttattaggccatgtattactgctgtttgtgaaccggaaaagtaaactctgagtgtaggacaactgttgtgcgatggtactgaacttatatttggcatgaat

SEQ ID NO: 29347 - protein, 175 aa, Panicum virgatum
  misc_feature: Ceres CLONE 1890865
  misc_feature (1)..(172): Pfam Name: IlvC Pfam Description: Acetohydroxy acid isomeroreductase, catalytic domain
  misc_feature: SWISSPROT Homolog: EC 1.1.1.86 Ketol-acid reductoisomerase
FYEKEGLPAFPMGNIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTVDKKAPINQDLISNFMSDPVHGAIEVCAQLRPTVDISVPADADFVRPELRQSS

SEQ ID NO: 29348 - DNA, 523 bp, Panicum virgatum
  misc_feature: Ceres CLONE 1890869
  misc_feature: Encodes the peptide sequence at SEQ ID NO. 29349
aaaactcaaatccagaagcagaagccgataagaacttcaggcgcagtaggagtagatagaagaagagaaagaatttgaaaatcagccaacgttcgtatcagctggggccggaatggcgacgcccaagctgtccccggtctcgccggcgcggcgggacgacacgccccgcgcgcagccgccggctgccctgagggtgcaggacgcgtccgcggcggaggcgtacgagcagtacctgcgcctgccggagctgtcggcgctgcgggagcccgggcgcttcccggggtgggcgggcgaggccctcctcgcgccggcgctgcaggcgctcgagctcaccttccgcctcgcgtccctcgcgctggcggacgcgggcgggtaccccggccgccgcgagctcgcgcgccggcttgagtgcctcgcgggacgggagctcgagctggcggccgcgctgggcgagggcggcggctagcggcgcgctccactcgccgagctggcgccctccattgacgtggtcatgcgtgatctt

SEQ ID NO: 29349 - protein, 117 aa, Panicum virgatum
  misc_feature: Ceres CLONE 1890869
  misc_feature (1)..(117): Pfam Name: Hs1pro-1_N Pfam Description: Hs1pro-1 N-terminus
MATPKLSPVSPARRDDTPRAQPPAALRVQDASAAEAYEQYLRLPELSALREPGRFPGWAGEALLAPALQALELTFRLASLALADAGGYPGRRELARRLECLAGRELELAAALGEGGG

SEQ ID NO: 29350 - DNA, 575 bp, Panicum virgatum
  misc_feature: Ceres CLONE 1890882
  misc_feature: Encodes the peptide sequence at SEQ ID NO. 29351
cagtcccagccccttgccttcttcctcaacccacctctctctttcacactcgcctctccctcctcctctctctttctttctactgtgagggagccatttccgcttcctgtcgtggggggcggaaggagggagagaaaggggggctgctgctgctgctgctgtttcggtgcggcagagatgtctgaggtgtccgtgataaaccacgcggaggtggaggacgccggccaggtggacctgccgccgggcttccgcttccaccccaccgacgaggagatcatcacgcactacctcacccacaaagccctcgaccaccgctacacctccggcgtcatcggagaggtcaacctcaacaagtgcgagccgtggcacctcccaggcatggccaagatgggggagaaggactgctacttcttctgccacaaggatcgcaagtacccgagggggacccggaccaccctcgccacggagaccggctactgaaacgccaccggcgaggacaatgagatcttcgtgggtcgcggcatcctcgtcggcatgaagaagatcctcggcttctaccgcggccgcgccccacg

SEQ ID NO: 29351 - protein, 100 aa, Panicum virgatum
  misc_feature: Ceres CLONE 1890882
  misc_feature (20)..(100): Pfam Name: NAM Pfam Description: No apical meristem (NAM) protein
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Functional homolog of the protein sequence given in SEQ ID NO 50327
  misc_feature: Useful for making plants with modulated light quality sensitivity
  misc_feature: Functional homolog of the protein sequence given in SEQ ID NO 50640
  misc_feature: Useful for making plants with altered lignin content
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: Functional homolog of the protein sequence given in SEQ ID NO 50639
  misc_feature: Useful for making plants with altered terpenoid content
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 476 in the 10/666,642 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Functional homolog of the protein sequence given in SEQ ID NO 50322
  misc_feature: Useful for making plants with modulated oxidative stress sensitivity
  misc_feature: Functional homolog of the protein sequence given in SEQ ID NO 50907
  misc_feature: Useful for making plants with altered carbohydrate content
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: Functional homolog of the protein sequence given in SEQ ID NO 50323
  misc_feature: Useful for making plants with altered cell wall content and/or composition
  misc_feature: The sequence is a functional homolog of SEQ ID NO 890 in the 10/374,780 US patent application
  misc_feature: The sequence is a functional homolog of SEQ ID NO 612 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 853 in the 10/374,780 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 851 in the 10/374,780 US patent application
  misc_feature: The sequence is a functional homolog of SEQ ID NO 1012 in the 11/435,388 US patent application
MSEVSVINHAEVEDAGQVDLPPGFRFHPTDEEIITHYLTHKALDHRYTSGVIGEVNLNKCEPWHLPGMAKMGEKDCYFFCHKDRKYPRGTRTTLATETGY

SEQ ID NO: 29352 - DNA, 694 bp, Panicum virgatum
  misc_feature: Ceres CLONE 1890890
  misc_feature: Encodes the peptide sequence at SEQ ID NO. 29353
atgctcgcctccgttttcatcctcgttgcttgctgcacacaaacagtagagacaagcaagcaccatgacgatcttgtcatcttatatcagatcactccacgaacacgttctgaacactgtcattccgctcatcatcacaaccgccttcgtcctcctcgtggctgcacggtttggtttcgctgagcacacaatcttctatctccatgccacgcgacccatctactacctgctgcttgctgttgccttgctaccaccatcagctgcggcggcagttactgtcttcttccttgtgaaccgccgctcacgccgcagtgtgtatcttgtcgattattcttgcttcaagccaatttccgactgccggattcccatggccatgttcagagagtacatggcgcacttcatgccgttcctcgacgaccgcagcatccacttcatcacacgtgtgctcgacacctctggccttggtgaggagacctgcttgcccccttccctccgttacatacctccgagcttcggattcagccatgcccgagccgaggccgagctggtagtcttctcaaccatcgatgacctgttacgcaagacacgcatcagcccaactgcaatagacatactggtggtcaactgctccctgttctccccaaccccatcctacagcgacatgatcatgagcaagtaccagctccgcgacgac

SEQ ID NO: 29353 - protein, 209 aa, Panicum virgatum
  misc_feature: Ceres CLONE 1890890
  misc_feature (75)..(209): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MTILSSYIRSLHEHVLNTVIPLIITTAFVLLVAARFGFAEHTIFYLHATRPIYYLLLAVALLPPSAAAAVTVFFLVNRRSRRSVYLVDYSCFKPISDCRIPMAMFREYMAHFMPFLDDRSIHFITRVLDTSGLGEETCLPPSLRYIPPSFGFSHARAEAELVVFSTIDDLLRKTRISPTAIDILVVNCSLFSPTPSYSDMIMSKYQLRD

SEQ ID NO: 29354 - DNA, 2397 bp, Panicum virgatum
  misc_feature: Ceres CLONE 1890902
  misc_feature: Encodes the peptide sequence at SEQ ID NO. 29355
attatgcagtgttgtttagcgtcccacacctcctcagaaaacctcatgccgttgtctccatccggccacatccatggccgtggcctcctcttcatcgccatggtggcgagcctctccacggtggtgacatctcaggccagcaagtactcgtgggtggactgccaatcctcggcggcggcatctccatctcctccctcaccgtcctcctcctcctccaccaacaccactttctggtccaacgtggtggcgctactggacgcgctctcgtcgtccgctgcgccgacgggcttcgccttcctgtcccgcggcaacggcaccgaccgcgccttcgtccggggaatgtgccgtggtgacaccgcgccggaccgctgcgccacctacctccgggacgccgcgctgagcatccggagcagctgtaacagcagcagccgccgcgccgccatctggtacgacgacggctccggcgtgacgatcccggcgccgatgttctgcttcgtcagctacgcggacaccaacgcgtccaccgcctacgaggacgcgttccggcagccgttccagaacgccgacgtggtccccgacatagacgccttcgggagaagctacaacgcgctgatgagcaacctcagcgcgcgcgtcgtcgacgtcgacggcagctccggcacgccatcatcgccggcgccgatgttcgcaacgggggcggccgtgtacgacgccgctgccaccaatggcaccatgtacgggctgctgcagtgcatgagggaccggacgccggcggagtgcggccggtgcttgcaggagtcggtgcagcgactgccgagctgctgcagggggcaccggggcgggttggtgttcgcctacaactgctacctgcgcatggaggtatacccatactacaatctggccctcgatgggccgccgcttctagcgccggctccgtcgcccattttcgccggagccggagagatcccaggaaaaaaacgggtcaatgtgactctcgccgtcgccatccctgttggaacagtgctcgccgttgtcgccatagttgctgttttcctgtacaggagaaaggtcaaccggaagaaaacaggaccaggtttttctatgggagacaacagcagtatcaaagaagaagatatgggttatgctgaacccgagcaacttaatctagtggtgttaagagctgcaacaaataatttctctgaagaaaacaaacttggagagggaggttttggagtagtgttcaagggtacattacaggacggggaagaaatagctgtgaagaggctttcgcaggattcctcacaggggttccaagagcttaagaacgagctcgtgctggctgccaagctcaagcacaggaacctggtccagctcctgggagtgtccttgcaagaagaaaagctggtcatctacgagtacatgcccaatagaagcctagataccttcctttccgatccaatgagacggaagctgctggattggagcaagaggttttccatcatctctggtattgcgcggggacttctttatctccatgaggagtcccgcttaaaggtcatccacagagatttaaagccgagcaatgtgttgcttgatgtggatatgaaccccaaaatttcagattttggaattgcaagagctttcagcgtagaccaatctagagatataacaagaagacctgttggaaccctcgggtacatgtccccagagtatgcctactggggtcatgtttcgaccaagtcggacatattcagctttggtgtcatagtcctagagatggtgaccgggcgaaggaacaatagtgcatacaacaacacttcagactccatatctgttctgagccatgtttgggacaagtggagggctggttcaatggtggatgtcgtagacccattgctagctgagtctgggtacccagaaagcgaggtactaaactgcatagagatcgggcttctatgcgtccaggaaaacccggtggatcggccagacgcctcggcggtggtgcttatgctcagcagtccgaccacaacgtccgatgacagacgagccccatctcggccggccttcgtcttcagctccggcttaactgaatcagatcacccatcaagatctggcgccaggagctctgatggtgttctggttatcagcaataaacagtcttcgacgaccacggtttcagagaatgagatgtcaatctcggagcttcaaccgaggtagatatgtgttgtgtagagtgcggagcacaagctgctagctgtgttccattcggcctatgattaatctcaatgatcttaaagcataaatagctgataaagaaaaattcagaaaatattgtaagcaggttccattactcattcatctcatttggggggctgtgatggtcaccccgggttcctt

SEQ ID NO: 29355 - protein, 705 aa, Panicum virgatum
  misc_feature: Ceres CLONE 1890902
  misc_feature (366)..(638): Pfam Name: Pkinase Pfam Description: Protein kinase domain
  misc_feature: SWISSPROT Homolog: EC 2.7.11.1 Non-specific serine/threonine protein kinase
MVASLSTVVTSQASKYSWVDCQSSAAASPSPPSPSSSSSTNTTFWSNVVALLDALSSSAAPTGFAFLSRGNGTDRAFVRGMCRGDTAPDRCATYLRDAALSIRSSCNSSSRRAAIWYDDGSGVTIPAPMFCFVSYADTNASTAYEDAFRQPFQNADVVPDIDAFGRSYNALMSNLSARVVDVDGSSGTPSSPAPMFATGAAVYDAAATNGTMYGLLQCMRDRTPAECGRCLQESVQRLPSCCRGHRGGLVFAYNCYLRMEVYPYYNLALDGPPLLAPAPSPIFAGAGEIPGKKRVNVTLAVAIPVGTVLAVVAIVAVFLYRRKVNRKKTGPGFSMGDNSSIKEEDMGYAEPEQLNLVVLRAATNNFSEENKLGEGGFGVVFKGTLQDGEEIAVKRLSQDSSQGFQELKNELVLAAKLKHRNLVQLLGVSLQEEKLVIYEYMPNRSLDTFLSDPMRRKLLDWSKRFSIISGIARGLLYLHEESRLKVIHRDLKPSNVLLDVDMNPKISDFGIARAFSVDQSRDITRRPVGTLGYMSPEYAYWGHVSTKSDIFSFGVIVLEMVTGRRNNSAYNNTSDSISVLSHVWDKWRAGSMVDVVDPLLAESGYPESEVLNCIEIGLLCVQENPVDRPDASAVVLMLSSPTTTSDDRRAPSRPAFVFSSGLTESDHPSRSGARSSDGVLVISNKQSSTTTVSENEMSISELQPR

SEQ ID NO: 29356 - DNA, 1322 bp, Panicum virgatum
  misc_feature: Ceres CLONE 1890903
  misc_feature: Encodes the peptide sequence at SEQ ID NO. 29357
gcaccgcaccgcaggtccgcagtttctgcttcccgttaggcttcctgtcttcttcttctccggcgaccggcggcgatgggggtcaagaacctctggaacatcctcgactcctgcaagaagaagctcccgctccagcacctccagaacaagaaggtgtgcgtggatctttcctgctggctcgtgcagctctgcagcgcccaccgctccccagccttcctcaaggacaaggtctacctcaagaacctcttccaccgcatccgagccctcctcgccctcaattgcagcctcgtcttcgtcacagatggggcgattccgtctgtcaaattggcaacttacaggcgccgcctcggagctgctcgagaggaggacaactcacaacccctgacttctttgcgccggaacaagagctctgaattctcgcgcatgataaaagaggccaagcatcttgggatggccctgggaatcccctgcttggatggagtcgaagaagcggaagcacagtgcgcattgctcaattttgcctccttgtgcgatggctgttttacatcagattcagattcattccttttcggtgcaaggacagtttatagagatgttttcataggagagggtggctatgtaatttgctatgagatggaagacattgagaaaaagcttggttttggcaggaactcactgatatctcttgcagtacttcttggtagtgactattctaatggagttctaggcttcggcccggaagcagcatgccggcttgttaaatccgtaggggatgatgccattcttgatcagattttgtccaatggagtaaagcctacaagaaaatctaaagcaaaaaatagtggcgttaatgttgagagggttggtggcacatgcccaaaagcaagtacctgcaagcttgggatgagccaagattctggtggtgaatttcgtgatataataaatgcatatctggagccaaaatgtcatttacctgattcagaagctgtgcaaagggcatgcagccagcgtccatatcttcggttacaactgcaacagatatgtgagcagtactttgaatggagccctgagaagactgatgaatatatacttccaaagttagctgagagggagctcagaagattttcaaatcttcgctccacgtcttcatatctaggaattaaaccttcactaaatgagatgccagtaccatgccctgtattggcaattgtgaagcagcgaaaagttcatggaaatgaacattatgaggtttcatggagaaacatagatgggctccaggtttcagttgttccaggggatcttgttagaagtgcttgcccaga

SEQ ID NO: 29357 - protein, 415 aa, Panicum virgatum
  misc_feature: Ceres CLONE 1890903
  misc_feature (126)..(215): Pfam Name: XPG_I Pfam Description: XPG I-region
  misc_feature (1)..(97): Pfam Name: XPG_N Pfam Description: XPG N-terminal domain
MGVKNLWNILDSCKKKLPLQHLQNKKVCVDLSCWLVQLCSAHRSPAFLKDKVYLKNLFHRIRALLALNCSLVFVTDGAIPSVKLATYRRRLGAAREEDNSQPLTSLRRNKSSEFSRMIKEAKHLGMALGIPCLDGVEEAEAQCALLNFASLCDGCFTSDSDSFLFGARTVYRDVFIGEGGYVICYEMEDIEKKLGFGRNSLISLAVLLGSDYSNGVLGFGPEAACRLVKSVGDDAILDQILSNGVKPTRKSKAKNSGVNVERVGGTCPKASTCKLGMSQDSGGEFRDIINAYLEPKCHLPDSEAVQRACSQRPYLRLQLQQICEQYFEWSPEKTDEYILPKLAERELRRFSNLRSTSSYLGIKPSLNEMPVPCPVLAIVKQRKVHGNEHYEVSWRNIDGLQVSVVPGDLVRSACP

SEQ ID NO: 29358 - DNA, 656 bp, Panicum virgatum
  misc_feature: Ceres CLONE 1890903-R
tcccagaaagttcagtgattcagctgcaggacccatggatgggattgatctgcagagccaaagtctgctacctggaacaatggactcaaaagaaaatgcccttttgtgtgacatgcagaattcaacacaggataatgacgtgattgatttattttcaccctttcctcgagctgctcataaaccccacgccactcgaggcttgcaactctgtatggaagaaggaagaagagccctctcagatataagcaattttcctgagaaagggaacacactgggcgctctaggttacaagcttgaatgtggagcaagaggcaacgatgtgcatctggaagaagcatcatcctcaatcagccgtggcatcgaagtggcaggcaaagctgatgattgttcctggagaagcaatgctgaggacaatgtagtagcagaagttgcgaccatcgatctttcctcccctttgccagttatagggaataaaagcaagaaaaatgttgatgtaatagacatttgtgaagcaggtagtgttaggtctcctgaacatgagaggaaagccagagagctcaggtcgtttctagccagtataagaaacgagttgtattgaacattgttaaatgaaagcgatatggctaggaacaattgaattgattagggtgcaaagc

SEQ ID NO: 29359 - DNA, 698 bp, Panicum virgatum
  misc_feature: Ceres CLONE 1890904
  misc_feature: Encodes the peptide sequence at SEQ ID NO. 29360
agccgaagcggcgacagagcgcctccctctccctaccacccggtcggctcggcgctcgctcccaccacagaaatctcgccgctggtgcatcattgtagcaggtagaagaagctcgtcctgtttatcatgtcaggaggatcaggggggtcttcaccaccatcaaggcggaccagctttaattctttatctcgagacctagaccttccttcagaacaagggtgtctctctattgttgtacttggggcttctggtgaccttgccaagaagaaaactttcccagcactctaccaccttttcgatcagggatttatacagtctggcgaagtgcatatatttggttatgctagatcaaatctttctgatgacgggttaagagaacgcattcgtggatatctcaaaggagccccggaagaagatctttcagaatttttgcaattgataaaatatgtcagtggttcttatgacaatggggagggatttgagaaattgaacaaggcaatatcagagtatgaggcgtcaagcaaatcagaaagctatcgcaggctcttttatttggcattgcctccatctgtctacccttcagtgtgcaaaatgatcagaacatactgcatgaatccatcttctcaccctggatggactagagtcattgttgagaagccctttgggaaggacttggattctgcagaagaattaagtgc

SEQ ID NO: 29360 - protein, 190 aa, Panicum virgatum
  misc_feature: Ceres CLONE 1890904
  misc_feature (36)..(190): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSGGSSPPSRRTSFNSLSRDLDLPSEQGCLSIVVLGASGDLAKKKTFPALYHLFDQGFIQSGEVHIFGYARSNLSDDGLRERIRGYLKGAPEEDLSEFLQLIKYVSGSYDNGEGFEKLNKAISEYEASSKSESYRRLFYLALPPSVYPSVCKMIRTYCMNPSSHPGWTRVIVEKPFGKDLDSAEELS

SEQ ID NO: 29361 - DNA, 623 bp, Panicum virgatum
  misc_feature: Ceres CLONE 1890920-R
  misc_feature: Encodes the peptide sequence at SEQ ID NO. 29362
cagccgacctaatggatgacagcacgatgagcaaccagtacgaggagccagagcagccaatgcagagcatggatgagatcatgcagatactggccgaggcgactataccagcagctggttctagtggaatcaaccagttcttgaacgacggtcttgacctcgatgatgacatggaggaccttgactcagacgccgatctcgacctagaaagcagtggggagatcgtttatgctatgtgatgtcaccaaatactcttccactaagcaatgcgtatcatcccctgttgcttcatagattattgagaggggatgtgaactgtgggtagtagtacagtgcaagtgctgttgccggtgcagctcatgcctgatgcggtgatgcccctttcaccatccttttgttttggctgttgttttgtgcacctccagtgttgtacaacagttagcctttttggatgtgcctgtgttgccgctgctgttctcagtctcatccatctgagaagaaccctcgtctctacacaccccaactaagggacagtgttatacttgtattattcgattgtgtttgtatcatagtatgtatcttgctgtaggcaaataaagagatgctacaatttgccgttctcc

SEQ ID NO: 29362 - protein, 78 aa, Panicum virgatum
  misc_feature: Ceres CLONE 1890920-R
  misc_feature: SWISSPROT Homolog: EC 2.7.11.1 Non-specific serine/threonine protein kinase
ADLMDDSTMSNQYEEPEQPMQSMDEIMQILAEATIPAAGSSGINQFLNDGLDLDDDMEDLDSDADLDLESSGEIVYAM

SEQ ID NO: 29363 - DNA, 672 bp, Panicum virgatum
  misc_feature: Ceres CLONE 1890920
  misc_feature (571)..(571): n is a, c, t, g, unknown, or other
gagaagaaaaggctcccaagatccggacaacgctgacggcgagtcagcagcggttattggggatctagtgctcctgctcctcgacgcgggcacttttcctgctccagcatgagattgttacatgggggaaaacaggttacaccaggactcgattactccagcgtccgccctaggcaggcgccatgcccagaggcgcgcatcttcgttgcagttgcgcaagagtcgttgtaggcaaggctcggcgccgtcgaacacgacccggttgcggtgcttccaaatgttccagcagcataggaagaggaaaaccgacccgtggggattcggggcggggcttgatgctgtgagagattgtagtgtttcgacggttgcatgtgcatttagctcgaaaccaacttgtcgccagaaggccgccgccactgggcagtggaagacgatgcttttggatgttagaaggtcaaagaagatgtttggtttctccatttcgcttatcctcatcaacctagcttccatattagaacgagcagatgagaatctcctcccagctgtttacaaggaagtcagtgctgctttncatgctggtcctactgatctggggtactttacattcatgatgaactctctgaagtccatagcatctccccttggcaggtgtcccttgctcttcactatgac

SEQ ID NO: 29364 - DNA, 536 bp, Panicum virgatum
  misc_feature: Ceres CLONE 1890922
  misc_feature: Encodes the peptide sequence at SEQ ID NO. 29365
atcggccgagaaaacctcagccgcaggccgcgaccttcgcttccgtctccggtctccacccccatcttgcgggagctcccgattcgggggaggaggcaccgcaccccgccgccgccccccgcctgcggatcagcgccgtcgccgatcggaggcccctcgccttcccccggtgggcggcgcgcggtgggaggatggacggcggcgcgggggcggccgggcacggcggccccggccggaggaccatatcctccgccgccgcctccaggaggaggctcccgcccgccgagaacggccacggccacgacggcgccgcctccaggaggtcctccgcctccatctcccgggccaactccccgtcactgactggcgagagaaccgtgaaaaggctgagattgtccaaggcgctgacgataccggataacacaaccgtgcacgaggcttgtcggaggatggcctcacgcagggtcgatgccgtgttgctgactgactccaatgctttgctctgcgggatcctcactgacaaggacataaccaca

SEQ ID NO: 29365 - protein, 114 aa, Panicum virgatum
  misc_feature: Ceres CLONE 1890922
  misc_feature: SWISSPROT Homolog: EC 1.1.1.205 IMP dehydrogenase
MDGGAGAAGHGGPGRRTISSAAASRRRLPPAENGHGHDGAASRRSSASISRANSPSLTGERTVKRLRLSKALTIPDNTTVHEACRRMASRRVDAVLLTDSNALLCGILTDKDIT

SEQ ID NO: 29366 - DNA, 617 bp, Panicum virgatum
  misc_feature: Ceres CLONE 1890922-R
accaccgctggacacaagaacgccgacccctcggaagaattacgccttcatgtccaaggagcctgagaagatccaccacatccggcatggccggccgcagttacacagctggaccggagaagctcctcagcagcagcagcagcagcaggcgccgcagcagcaagtgcaccaccagcagtacctgcaactccaccagcagtactcagccggaccgcagaccttctacgagccgagctgcgaggcgacgaacgagatcgtcttcggagccgtgcaggaggcggacaccggccgccgtgctgtggagatcaaggccgtgaaccacggcgacgcgccgtcgtacgagcagaacgggctgcgctaccggagcagctacagcgtgggctaccctggccacaactagtcgaggaagatttattattgcctccgccctagtggttttggagcgtcctccgttgtactagctgtaagaaaaggagagagtagagaggaatcgacttagtaccagtctcccgattgactcgtgcaacggtaaaaagctgggttttggtagacgagcgtcgtgttcttggttcatggactctttactggcggtgacatatatagtatgtaagttgagt

SEQ ID NO: 29367 - DNA, 2523 bp, Panicum virgatum
  misc_feature: Ceres CLONE 1890928
  misc_feature: Encodes the peptide sequence at SEQ ID NO. 29368
aatccagcaaagccaacaaggcaacaaacaccgcccccctcttctcttcactccccgcctacctgcagcccacgccaagccgacaggcacgccgcgtcggtcgccgcgcgctgccgccggcggtcgatcgatcgatcatcgatcaccgaccacgcgaccagcagcaggcagaggttgacgacaccacaccagcagcatggtggtgaacaacaaggtggacagcctgtcctacgacgtcgaggcgccgccgcagggcgcctcggcggcggcggcggcgcaaccgccgacgccgccggctcggcaccacgcgcccgcgccgctcgcagcgagggagggcgcggcggcggtgctggaggtgcacaaggtgtcgctgccggagcgccggtcgacggcgcgggcgctgcggcagcgcctggcggaggtgttcttccccgacgacccgctgcaccagttcaagaaccagtcctcggcgcggcgcctggtgctggcgctccagtacttcttccccatcttccagtggggctccgcctacagcccccgcctcctccgctccgacctcgtcgccggcctcaccattgccagcctcgccatcccgcagggaatcagctacgccaagctcgccaacctgcccccaatcatcggcctatattccagcttcgtgccgccgctcatctactcgctgctggggagctcgcgggacctggcggtggggccggtgtccatcgcgtcgctggtgatggggtccatgctccgggaggccgtctcgccggacgaggagcccatcctctatctgcagctcgccttcacctccaccttcttcgccggcgtcttccaggcgtccctcggcttcctcaggctgggcttcatcgtggacttcctgtccaaggcgacgctgaccggcttcatgggcggcgctgccatcatcgtgtcgctgcaacagctcaagggcctgctcggcatcgtccacttcacctcccacatgggcttcgtcgacgtcatgcgctccgtcttcaagcgccacgacgagtgggaatggcagaccatcaccatgggcaccgccttcctcgccatcctcctcctcactcgccaaatcagtgcgaggaatccaaaacttttctggatatcagcaggtgctcccctgacctcggtgatcatctccaccatcctctccttcatctggaaatcgcatagcatcagcgttattggcatcctccccaggggagtgaaccctccttcagctaacatgctcaccttcagcggctcctacgtggcgctgacgatcaagaccgggatcatgacaggaatcctgtccctaactgaagggattgcagtaggcaggacgttcgcgtcgatcaacaactaccaggtggacggcaacaaggagatgatggccatcggcatcatgaacatggccggctcctgcgcgtcctgctacgtgaccacgggctccttctcccggtcggcggtgaactacagcgccggctgcaagacggcggtgtccaacatcgtgatggcggcggcggtgctggtgacgctgctgttcctgatgccgctgttccactacaccccgaacgtgatcctgtcggcgatcatcatcacggcggtggtcgggctcatcgacgtccgcggcgccgccaagctgtggaaggtggacaagctcgacttcctggcgtgcatggcggcgttcctcggcgtgctcctcgtgtccgtccagatggggctcgccgtcgccgtcggcatctcgctgttcaagatcctgctgcaggtgacaaggccaaacatggtggtcaagggcctcgtccccgggacgcagagctaccgcagcgtggcgcagtacagggaggccgtccgggtgccggcgttcctcgtcgtcggcgtcgagtcggcgatctacttcgccaactccatgtacctcgtcgagagggtcatgcgcttcctccgggacgaggaggagagggcgctcaaggccaaccagagctccatcagatgcgtcgtcctcgacatgagcgccgtcgcggcgatcgacaccagcggtctcgacgcgctgtcggagctgaagaaagtcctggaaaaaagaaacatcgagctggtgcttgccaacccggtcgggtccgttgccgagaggatgttcaactcggcggtgggcgagctgttcgggtcggagcgcctgttcttcagcgtggcggaggccgtctcggcgggggcgtgcaaagcgcagccctgacggaggtgccggcggtagcaggtgccccgcgccatagatgatgcgtggggcacgggtcctctgaccagcagaagcagtagaaacaggtgcttctcggaggaggctaattaaactagttgtgttcttgtgttggataattggattaggggagattgagacgtaagggcaggaataacgtgacgccggcttgatgatgtgatggcctcttccgatcgaggggaagagtttttgaagggtgaatgtgtagctgttgctgtagttcctctcaagtaatggaaaaagaatatggttcgatctct

SEQ ID NO: 29368 - protein, 675 aa, Panicum virgatum
  misc_feature: Ceres CLONE 1890928
  misc_feature (216)..(524): Pfam Name: Sulfate_transp Pfam Description: Sulfate transporter family
  misc_feature (547)..(665): Pfam Name: STAS Pfam Description: STAS domain
MVVNNKVDSLSYDVEAPPQGASAAAAAQPPTPPARHHAPAPLAAREGAAAVLEVHKVSLPERRSTARALRQRLAEVFFPDDPLHQFKNQSSARRLVLALQYFFPIFQWGSAYSPRLLRSDLVAGLTIASLAIPQGISYAKLANLPPIIGLYSSFVPPLIYSLLGSSRDLAVGPVSIASLVMGSMLREAVSPDEEPILYLQLAFTSTFFAGVFQASLGFLRLGFIVDFLSKATLTGFMGGAAIIVSLQQLKGLLGIVHFTSHMGFVDVMRSVFKRHDEWEWQTITMGTAFLAILLLTRQISARNPKLFWISAGAPLTSVIISTILSFIWKSHSISVIGILPRGVNPPSANMLTFSGSYVALTIKTGIMTGILSLTEGIAVGRTFASINNYQVDGNKEMMAIGIMNMAGSCASCYVTTGSFSRSAVNYSAGCKTAVSNIVMAAAVLVTLLFLMPLFHYTPNVILSAIIITAVVGLIDVRGAAKLWKVDKLDFLACMAAFLGVLLVSVQMGLAVAVGISLFKILLQVTRPNMVVKGLVPGTQSYRSVAQYREAVRVPAFLVVGVESAIYFANSMYLVERVMRFLRDEEERALKANQSSIRCVVLDMSAVAAIDTSGLDALSELKKVLEKRNIELVLANPVGSVAERMFNSAVGELFGSERLFFSVAEAVSAGACKAQP

SEQ ID NO: 29369 - DNA, 2366 bp, Panicum virgatum
  misc_feature: Ceres CLONE 1890931
  misc_feature: Encodes the peptide sequence at SEQ ID NO. 29370
ccatcgtctctcctgctgctaccctgccctgcccttgccggcgtatctgcgtccgcgtctcctccctccctcctcctgcaagcagcaagcgcgcgggcaagagcaagacgaggtgagcaaagcatttccaccaccctcttctcttcttctgagccggcgatgggggcgctaccgctgccgcccaccactacgtacagaaataaatggcgcctcctgtgcagtgaagtgatttccctttgtcctcttccccgtccccggcttgtatttttgtttctcgagctgttcctgcttggtgccacctccatggcctttccattttggcgcttcttctcctttatttatccctactagtactagcactgtttacgagtttcgtttcgttgttcaatccgtccattttttttcctatctaaaataaaattaataaaagctgcctctgtttattggtgctggattcgctcatcttgctctgtctccttcctcacaccgtttctctccgcatgcaggtgccgccgcaggctttgccaggccgcctactcccactgactttacccgcttggcttggcttggcagccatcaattaatttgttccttcctcagccataccatttacgtcgtataaatccacaggaatcagcaccaaagctccaagcttttgccccgcgctggtgggtggtgccgctgcttcttctgcttgtgcttgcttgataaaagttggagggacgcagctccaagcaagctggcgaggctcgggctcgggctcgggctcatggtccaggacgaagcctcctcgtcgtccgtcacatcctccccgctccacaacttgtcgtcccacaccatgcctctccacccggccgccgccccgacgccgccctggctgctgcgggagctccgctccgacgagcgcggcctctgcctcatccacctcctcctcaactgcgccgccgccgccgccgccggccgcctcgacgccgccaacgccgcgctcgagcacatcgcctcgctcgccgcccccgacggcgacgccatgcagcgcgtcgccgccgccttcgccgaggccctggcgcgccgcgcgctccgggcctggccgggcctctgccgggcgctgctcctgccccgcgccgcgcccgccgccgccgagctcgccgccgcgcgccgccacttcctcgacctctgccccttcctccgcctcgcgggcgcagccgccaaccagtccatcctggaggccatggagtcggagaagatggtgcacgtcgtcgacctcggcggcgccgacgccacccagtggctggagctcctccacctcctggccgcgcgccccgagggcccgccgcacctccgcctcacggccgtccacgagcacaaggacgtgctcacccagacggccatggtgctcgccaaggaggccgagcgcctggacgtgcccttccagttcaaccccgtggtgtgccggctggaggcgctggacgtggagtctctccgggtgaagaccggcgaggcgctggccgtcacctccagcctgcagctgcactgcctgctcgcctccgacgacgactccaatggcagcaaggacagcagcagcaacgataaaggagagcggcgggtcaaatacaggagcagccccgagtccgggtccggggtgtcgccgtcgacgtcgcgcgcggacgcgttcctgggcgcgctgtggggcctgtcgcccaaggtgatggtggtgacggagcaggaggcgagccacaacgcggcggcgctgacggagcgcttcgtcgaggcgctcaactactacgcggcgctcttcgactgcctggaggtggtggcggcgcgcgggtcggtggagcgcgcgcgcgtggagcggtggctcctgggcgaggagatcaagaacatcgtggcgtgcgagggcggcgagcggcgggagcggcacgagcgcctggagcggtgggcggcgaggatggagggcgccggcttcgcccgcgtgccgctcagctactacgcgctgctgcaggcaaggcgggcggcgcaggggctctgctgcgacggcttcaaggtgcgcgaggacaagggctccttcttcctctgctggcaggaccgcgccatcttctccgtctccgcctggcgcggccgccgcttggactgaccctccctgagcttctgagtccttcccgtattttgtgggaaggagacgtagattcgctggtgcctggtggtgcctcgtgttacttcttaggggtgctcaggtcaggccatgtcttgttttgttttgttcatagtgatgaatgtatcctccctctccgtttgggatgcaagcatactttcctagtcctagggatgatcgatctaatctaaacaaaaattctgttaatttctccccc

SEQ ID NO: 29370 - protein, 430 aa, Panicum virgatum
  misc_feature: Ceres CLONE 1890931
  misc_feature (1)..(334): Pfam Name: GRAS Pfam Description: GRAS family transcription factor
  misc_feature: The sequence is a functional homolog of SEQ ID NO 1257 in the 10/374,780 US patent application
  misc_feature: The sequence is a functional homolog of SEQ ID NO 216 in the 10/714,887 US patent application
  misc_feature: The sequence is a functional homolog of SEQ ID NO 216 in the 11/435,388 US patent application
  misc_feature: The sequence is a functional homolog of SEQ ID NO 1255 in the 10/374,780 US patent application
  misc_feature: The sequence is a functional homolog of SEQ ID NO 110 in the 10/225,068 US patent application
  misc_feature: The sequence is a functional homolog of SEQ ID NO 190 in the 10/374,780 US patent application
  misc_feature: The sequence is a functional homolog of SEQ ID NO 220 in the 10/225,066 US patent application
  misc_feature: The sequence is a functional homolog of SEQ ID NO 4 in the 10/714,887 US patent application
  misc_feature: The sequence is a functional homolog of SEQ ID NO 4 in the 11/435,388 US patent application
  misc_feature: The sequence is a functional homolog of SEQ ID NO 212 in the 10/714,887 US patent application
  misc_feature: The sequence is a functional homolog of SEQ ID NO 212 in the 11/435,388 US patent application
  misc_feature: The sequence is a functional homolog of SEQ ID NO 214 in the 10/714,887 US patent application
  misc_feature: The sequence is a functional homolog of SEQ ID NO 214 in the 11/435,388 US patent application
MPLHPAAAPTPPWLLRELRSDERGLCLIHLLLNCAAAAAAGRLDAANAALEHIASLAAPDGDAMQRVAAAFAEALARRALRAWPGLCRALLLPRAAPAAAELAAARRHFLDLCPFLRLAGAAANQSILEAMESEKMVHVVDLGGADATQWLELLHLLAARPEGPPHLRLTAVHEHKDVLTQTAMVLAKEAERLDVPFQFNPVVCRLEALDVESLRVKTGEALAVTSSLQLHCLLASDDDSNGSKDSSSNDKGERRVKYRSSPESGSGVSPSTSRADAFLGALWGLSPKVMVVTEQEASHNAAALTERFVEALNYYAALFDCLEVVAARGSVERARVERWLLGEEIKNIVACEGGERRERHERLERWAARMEGAGFARVPLSYYALLQARRAAQGLCCDGFKVREDKGSFFLCWQDRAIFSVSAWRGRRLD

SEQ ID NO: 29371 - DNA, 594 bp, Panicum virgatum
  misc_feature: Ceres CLONE 1890960
  misc_feature: Encodes the peptide sequence at SEQ ID NO. 29372
tctacatacgactgaagcttgcggagggtatgcagccacagcctagctaggccgatggcctattgccggtggctggggactgaacggatcatttttgccgccacttcccacaagaatggcttgacaatctctgcaggttgactttgtaccaaaccttgataactcacagaaggagccatctctgctgccagctcgtatttcatctctattgttgaatgattcttctgggattgcggtcggaatggcaacaaacattcctcctcataatctgggggagcttgttgatgcactttctgttataattcaaaaccctgaagccacagaaggaaatctccatcccggagatgttcaagagcacgtgtatgacaatatgatgatgaaggaacattccactacatggacctgcaattctttgtaagcacagagtcgttcgatatacattcttttcttggacatatcatattgttctcacttgatatggaatctcgaactgtatctatattggacccaatgcccatacctcacaattttaagttgtgattttactctatggatgtgtttgtgtaatcaacataataactttgtcctttgtgg

SEQ ID NO: 29372 - protein, 58 aa, Panicum virgatum
  misc_feature: Ceres CLONE 1890960
  misc_feature: SWISSPROT Homolog: EC 5.99.1.3 DNA topoisomerase (ATP-hydrolyzing)
MATNIPPHNLGELVDALSVIIQNPEATEGNLHPGDVQEHVYDNMMMKEHSTTWTCNSL

SEQ ID NO: 29373 - DNA, 2499 bp, Panicum virgatum
  misc_feature: Ceres CLONE 1890974
  misc_feature: Encodes the peptide sequence at SEQ ID NO. 29374
acagcaggaaaaaaaccccagtcacccacgaaaggaacgcgcccaatctggtctggtcctgctgctgctgcggtggtggaggtggtggtggttcccggcagcctccagggcatcgcgccggccccgacccggccagcgcccgccgctgccacccgccgacgccaccgtcggagccagggccgcccacgccatggcgggctccatggtggaccgggccaccagcgacatgctcatcggcccggactgggccaagaacatggagatctgcgacatctgcaaccgcgaccccggacaatcaaaagatgttgtgaaggcgctaaaaaaacgaattgggcacaaaaatccgaaagtccaactccttgcactgaccctgttggaaactgttatcaagaactgtggtgatatactccacatgcatgttgcagagagagatatattgcatgagatggtgaagatagtgaagaagaagtctgatcctcgtgtcaaagagaaggtattggtgctaatagatacatggcaggaagcttttggggggccacgtgcaagatatccgcaatactatgcggcgtaccatgagttggtgcgagctggagctgaatttcccaagagatccgagaaacctgcaccattgtttaacggtcagtctcaagcagcaaggaatatgcgtagtccggatcaacaagatgaagctgaatcttctgctgccaatgattttcctgctttgagcatgtcagagattcagaatgctcgtggtatcatggatgtgctagcagagatgctgaatgctttagacccaggaaacagagagggactaaggcaggaggtaattgtggagcttgtggatcaatgtcgcacttacaagcagagagtggtgcagctagttaatacttccacggatgaggaacttatgtcgcaggggcttgcactgaatgatgatttgcagcgtgttcttgcgaagcatgatgcaatagcggcaggcattgcagtccgagtggagaaaaaaccaaagtctctgcaagcacttgttgatactgaggactctgccaaccaggacgctaacaaagacaaagaaaaagaaaaaggactcatagatattgaggaacccacaaaccaagattctaaaaatgagccaaatcaaagtacaagtgaccaatctccttttgagcaattagcacttccagcgccaccagtttcaaatggcacagcaacctctgcaccaaaatctgatcttggcattgatcttctcagctgggacgatacccctactacagcagaaaatccgcttgcgcttgttccagtcactgatcctcttgctgactctactccatcaaatcaaaatgcgctagcaatcgtcgatgcgttttcacaaaataacactgctaacagcaacactcatccagctgatccctttggtctcagttcaagctccactattccgggatcacagccatacaatactccagtacagcatcctttacagtcacaacagcctcagcaggcggcgccgctgtatccaaacgggggtgctgtgaatgctgggacatcatacgaccaggcaccccagtttaataacatgagttctggttggaatggtcatgttgccagtcctttggcgcccccaccacagcaagcacagagctatgatgatcaaagtggatcccttccaccacctccttgggaagctcagtcagcagcaagcaatgaattgccaaatggccaattgggcggaggtatgcaacctatccctgctctgccagcaggccagatcagcagcatgcagcagccacagcaaccacagatcaaccacatgggagtcccgcaaacccagccaatgtacagccaacaaggagcctcgttgcctcaagcgatgcaacctggccaagctgccgtagcacagatgcagccaggcttcgggaaccagcaatttggtttgctacctccagcgtccatgccaggcatgcaattccccggcatgcaacctccacaaatgtatggcggatcgcaggcagccatgatgtacccacaacagatgccaggggcacagtacggagcaatgcctcaacagcaacccatgtatggtggccggttggcggggtacatgcagcatcccgcggtggctgctgcacactactacaaccagggaacgccgggaatgtatgggtaccctggtgcgaacgacctgtctcagaggatgtatggcctctcagtgcaggacaactcgtacctgggaatgagctcgtcctaccagacggcatcctcccctgcaccctccacggggcaacctatgcggccgacaaagcctgaagacaagctttttggtgacctacttagcattgccaagacgaagaaagcttcatgagagaatgagcgagagcgcgggcggtctaatatgttgtttccctatttttgcgatttttcatgcttgatgatcttattgtaacattatttgaatgtataagcttctggtttttttttttttgttcacgctgtgatgtgatc

SEQ ID NO: 29374 - protein, 722 aa, Panicum virgatum
  misc_feature: Ceres CLONE 1890974
  misc_feature (1)..(134): Pfam Name: VHS Pfam Description: VHS domain
  misc_feature (173)..(271): Pfam Name: GAT Pfam Description: GAT domain
MAGSMVDRATSDMLIGPDWAKNMEICDICNRDPGQSKDVVKALKKRIGHKNPKVQLLALTLLETVIKNCGDILHMHVAERDILHEMVKIVKKKSDPRVKEKVLVLIDTWQEAFGGPRARYPQYYAAYHELVRAGAEFPKRSEKPAPLFNGQSQAARNMRSPDQQDEAESSAANDFPALSMSEIQNARGIMDVLAEMLNALDPGNREGLRQEVIVELVDQCRTYKQRVVQLVNTSTDEELMSQGLALNDDLQRVLAKHDAIAAGIAVRVEKKPKSLQALVDTEDSANQDANKDKEKEKGLIDIEEPTNQDSKNEPNQSTSDQSPFEQLALPAPPVSNGTATSAPKSDLGIDLLSWDDTPTTAENPLALVPVTDPLADSTPSNQNALAIVDAFSQNNTANSNTHPADPFGLSSSSTIPGSQPYNTPVQHPLQSQQPQQAAPLYPNGGAVNAGTSYDQAPQFNNMSSGWNGHVASPLAPPPQQAQSYDDQSGSLPPPPWEAQSAASNELPNGQLGGGMQPIPALPAGQISSMQQPQQPQINHMGVPQTQPMYSQQGASLPQAMQPGQAAVAQMQPGFGNQQFGLLPPASMPGMQFPGMQPPQMYGGSQAAMMYPQQMPGAQYGAMPQQQPMYGGRLAGYMQHPAVAAAHYYNQGTPGMYGYPGANDLSQRMYGLSVQDNSYLGMSSSYQTASSPAPSTGQPMRPTKPEDKLFGDLLSIAKTKKAS

SEQ ID NO: 29375 - DNA, 2050 bp, Panicum virgatum
  misc_feature: Ceres CLONE 1890982
  misc_feature: Encodes the peptide sequence at SEQ ID NO. 29376
aaggaccagcccagatatatcgccgcatccccgctgcctcccgtctgctcgcaaaagcgctttgcggagacgacgacgagtcgacgaagcgagaagacgaggtgccgtgccgctgctacgaccgagcttccggaggccttggccccgccctgccgcagggtttgattgtgatctagatctagcctgtactggtcggtagctgagcgcgaatcgacgatgagcgtggtggggttcgaccttggcaatgagagctgcatcgtcgccgtcgcgcggcagcgcggcatcgatgtggtcctcaacgaggagtcgaagcgggagaccccagccatcgtctgcttcggggacaagcagcggttcatcggcaccgccggctccgcgtcctctaccatgaaccccaagaactcaatctcgcagatcaagcgattgctgggacgcaagttctctgaccctgagctgcaaaatgatctcgccgccttcccgttccgtgtcacggagggccccgacgggtttcccctggtccatgtgcggttcctgggcgaggagcggacgttcacccccacccagctgcttgccatggtgctgtcgaatctgaagggcattgctgagggtaacttgaatgctgcggttgtggactgctgcatcggtatcccagtgtacttcagtgatcttcagcgcagggctgttctggatgctgccactattgcgggtctccgtccattgcggttgttccatgagacaactgccacagcattggcttatggtatttacaagactgatctcccagagcatgaccagctcaacgttgcatttgttgatgtcggtcatgctagcatgcaggtcagcattgtcggttacaagaagggacaactcaagatgatgtcccatacgtatgaccggtcccttggtgggagggactttgatgaggccctctttaagcactttgcagccaagttcaaagaggagtacaagatcgatgtgtaccagaatgcccgtgcatgccttagattgcgtgtagcgtgtgagaagctgaagaagatgctcagcgccaaccctgaggcaccattgaatatagagtgtttgatggacgagaaggatgtgcgggggttcatcaagagggaggagtttgaacagattagtgccccggtgctggaacgtgtgaaggggccattggagaaggcactggctgaagctggcttgacaacagaaaatgttcactttgttgaagttgttggttctggttctcgtgttccagccataatcaagataattacagaattttttgggaaggagccaaggaggactatgaatgctagtgagtgtgttgcacgaggatgtgctcttcagtgtgctattctcagccccacttttaaagtgcgggagtttcaggttaatgatgggtttcctttctcaattgcattgtcatggaagccagattcccagaacagtgcaccccagcataccgttgtattcccaaaggggaatgctattcccagcgttaaagctctgaccttctatagatcaagtacatttgaagttgatgttttgtacgttgacacgggcgactcacaaattcaacaaaaaataagcacttacacaattggccctttccaaccctccaaaggtgagaaggctaaactgaaagttaaagttcgtctcaacatccatgggattgtaacagttgattcagtaatgatgctggaggaggatgtggaagttccagtttcatctgtgaatgaagctctgaaggatgccacaaagatggacacagatgatgcaccaagtgatccttctggaacggacatgaatatgcaggagcctaaaagtgctgataccactgaggggggcgctactgcagctgagaatggagcacaagatcctgaggaaaaatctgtcccaatggaaactgatgcaaaggttgagccatcgaaaaagaaagttaagaaaatttctgttccagtcaatgagttggtctatggtgcattgcccgctgctgaactggaaaaggctgtagagaaggagtatgagatggctcttcaggacagggtaatgg

SEQ ID NO: 29376 - protein, 611 aa, Panicum virgatum
  misc_feature: Ceres CLONE 1890982
  misc_feature (3)..(607): Pfam Name: HSP70 Pfam Description: Hsp70 protein
MSVVGFDLGNESCIVAVARQRGIDVVLNEESKRETPAIVCFGDKQRFIGTAGSASSTMNPKNSISQIKRLLGRKFSDPELQNDLAAFPFRVTEGPDGFPLVHVRFLGEERTFTPTQLLAMVLSNLKGIAEGNLNAAVVDCCIGIPVYFSDLQRRAVLDAATIAGLRPLRLFHETTATALAYGIYKTDLPEHDQLNVAFVDVGHASMQVSIVGYKKGQLKMMSHTYDRSLGGRDFDEALFKHFAAKFKEEYKIDVYQNARACLRLRVACEKLKKMLSANPEAPLNIECLMDEKDVRGFIKREEFEQISAPVLERVKGPLEKALAEAGLTTENVHFVEVVGSGSRVPAIIKIITEFFGKEPRRTMNASECVARGCALQCAILSPTFKVREFQVNDGFPFSIALSWKPDSQNSAPQHTVVFPKGNAIPSVKALTFYRSSTFEVDVLYVDTGDSQIQQKISTYTIGPFQPSKGEKAKLKVKVRLNIHGIVTVDSVMMLEEDVEVPVSSVNEALKDATKMDTDDAPSDPSGTDMNMQEPKSADTTEGGATAAENGAQDPEEKSVPMETDAKVEPSKKKVKKISVPVNELVYGALPAAELEKAVEKEYEMALQDRVM

SEQ ID NO: 29377 - DNA, 2429 bp, Panicum virgatum
  misc_feature: Ceres CLONE 1890990
  misc_feature: Encodes the peptide sequence at SEQ ID NO. 29378
acaattccccaccctcacccaccagatcgattccaccgcggtaccgtagcggcggcgcgatccgtactccaggtcttcctgccgatgagaaagcagcggggatcttcctccggagagcggtcagtggaacccgactcaaggacggtgacgaggtcccggtcgagggcggctggatctgtcacctcgccccagccagagatggcgccgaccgccacgcaggaggaggcgtcggggtccccatcgacggccagcaagaggctacgtctctcctctgcaccacgccgtgggcatcgtggcttcactggcgaggtcacagctgatggcggcgcacaggtggtgacttcagctttaactgtcggagtggaagaggtggaggtcgtgccgaggtcagttgctcccgtggcaagtgactccatggaggctactgcctttgtacccaactctcccatccgtatgccgattatggtggagtatgattcgaaaggacggcaactctccgaaccatcgagttggccggccccagagttatccaaagcctacctaaaggcgaaccaacaatacctcgagaagttaggtcaaatcttgaagcttccgacattggatgatgatacctgttttgagtcaatacctattcaagaaagtgcagcagacacaatcctgaaagcttcaaagtttattttggggctctctgcatatattggtacataagattcttgtatttagttgtgctacagaatctgttgttgtttcctatcacatggcatatgcagatggtgtgttactaagacaaagctcaggaattttgatggagtggaatgaggacaaaggaaccattttaacaaccgcggaactctttagctcaaagtctccaaatgtggatgtgtggttaggtggacaagaatatgctcgagatgctgaggtccttgttcagctattgcatatcgatgatattgaagtgccgggtgaaatgatttatttagatgagcaatatgaatttgctctgatcagtgtacctatggatccaccagaaacgttaccccatttttgcaatgaactgatgttttctgaggacgttttcgtactcggaagagacaagtgggttttgcagatagggaatggcaaagtgatgaacaaaggtgcaggctcgtatatacgtcaccattacatgttctttgatgctgatatctcaccgtgtggttttggaggggcagtcatcaacttggaaggagatgttattggactgataaccggttccatgtcatttataccttcttcaaccattctcaaatgcttgcatctttggaggacattcaattgtatacctcgtatccatcttgggatgaagttgcttggcatcaaatgtctgaaccttatgagtaaagagaagatatctcgaaagtatcatattgatgctggtcttatcgtcgtagaggtgtcaggaggatcgaatgccgagagtcatggtattaggattggtgatattattcaagctgtgaacagagaacgcattgctactgcaattgagttggagaatatgttgctggatacatgcaagggctatttggaaaagggagttggctgtggttcctacaaggatgtagtgttagtacttgacgtgttcaacaccaccaaacgcctccctggcagaatacagttagctgcaaaactctctcatggtgttgaaatcattgaaagaggcaaatacgaagtttctatgaaaaaaggctctacctcgatttgacaaagctggtccaggcgatgatgaacttggtgaaaaatgaagaaggctgcttagtagtatccttgaagacctgcacttgtccatctatgggtgtcgctattttgtttgatagtagtctccttgaagacttgcacttctccatctatgggtgtagtacatacaatggatgaatggcactttcttccctccgaaaagatgttagggctctcttaatcgaagatttgtcatcaaatcctataagctacggttggactctctgggctagagatggcgttctctcttagggaatgaggatcgagaacgacatgaagctcagatggaggcgattcaaaagtgggtgaaagcttttgctgataacaagagcaacgaggctgaagatgggtggactttggaccagggcccttagcaccccttggcggttggctcttctctaggagtagggtctttttctttctagtctgagggagtttttcatcatttttcctgtggcgttttgcctgttggactcctcttgttcgctggtttccccagctgggttgacgttggtctgtactaaacctattttgctttaacattaattttaaaaacaatttgaaaccttttcttatcgtcaggaaattattcgtgtctctagaaatttgatgaatttttggaggcacagtttaaggggaaatgccaccatattgcc

SEQ ID NO: 29378 - protein, 327 aa, Panicum virgatum
  misc_feature: Ceres CLONE 1890990
  misc_feature: SWISSPROT Homolog: EC 3.4.21.108 HtrA2 peptidase
MAYADGVLLRQSSGILMEWNEDKGTILTTAELFSSKSPNVDVWLGGQEYARDAEVLVQLLHIDDIEVPGEMIYLDEQYEFALISVPMDPPETLPHFCNELMFSEDVFVLGRDKWVLQIGNGKVMNKGAGSYIRHHYMFFDADISPCGFGGAVINLEGDVIGLITGSMSFIPSSTILKCLHLWRTFNCIPRIHLGMKLLGIKCLNLMSKEKISRKYHIDAGLIVVEVSGGSNAESHGIRIGDIIQAVNRERIATAIELENMLLDTCKGYLEKGVGCGSYKDVVLVLDVFNTTKRLPGRIQLAAKLSHGVEIIERGKYEVSMKKGSTSI

SEQ ID NO: 29379 - DNA, 725 bp, Panicum virgatum
  misc_feature: Ceres CLONE 1890999
  misc_feature: Encodes the peptide sequence at SEQ ID NO. 29380
gagagcagccctcgcttctcagcccgtcagctcagaaaaagaaagagctagcgcatcgcaccggcgtctgagaaatggcgcgcggggcccacctcgccggcgcctgccgcgcgctcctcctcgccgggctcctcgcgtccttccttccggcagccgagccgtcctgcccccgagacacttcgctggtgaaggacgtcggccggatgcaccagagcagctacgggatcgacggcttctcgcacataaccgtcgccggcgcgctcgctcatgggctcaaggaggtggaggtgtggcttcaaactatagttccaggcgaaaggacgccgatccaccggcactcctgcgaggaggtcttcgtagtcctcaaagggaaaggcacgctcctgctgggctcaagcacgctcaagtacccagggcagccccaggagatccccatcttccagaacagcacgtttacggtccccgtgaacgatccgcaccaggtagtgaattctgacgagcatgaagatctgcaagttcttgtggtcatttcgcgcccaccggtaaagatatttctatacgatgattggagtatgcctcatacagcagcgaagctgaagttccccttcgtctgggatgaggactgcttgccagctcctaaagatgaactctaggtccaaaagcgtttcatccattttaatcagcttcatccatgatcctgctagaacgaaggccacacctatgtg

SEQ ID NO: 29380 - protein, 192 aa, Panicum virgatum
  misc_feature: Ceres CLONE 1890999
  misc_feature (27)..(192): Pfam Name: Auxin_BP Pfam Description: Auxin binding protein
MARGAHLAGACRALLLAGLLASFLPAAEPSCPRDTSLVKDVGRMHQSSYGIDGFSHITVAGALAHGLKEVEVWLQTIVPGERTPIHRHSCEEVFVVLKGKGTLLLGSSTLKYPGQPQEIPIFQNSTFTVPVNDPHQVVNSDEHEDLQVLVVISRPPVKIFLYDDWSMPHTAAKLKFPFVWDEDCLPAPKDEL

SEQ ID NO: 29381 - DNA, 632 bp, Panicum virgatum
  misc_feature: Ceres CLONE 1891013
  misc_feature: Encodes the peptide sequence at SEQ ID NO. 29382
gacagccctcccgctcagagggctcagccgctcagtggcctcaagttcatctcctccctcccttctctcggactctctcctccctttgctcttccttccctgccggcggcgactgggcaagcggcggcgccatttgtcctgtcttcgcccagccctttgccggcgacgagcgcatcctccagaatcatcgggtgtacaagtgtacacccatgtcctatgctgggtcagcccctgcggaatgggcaaccaaggtgccctgcctcatgggaggtgccctgcctcatggggatcgacgaggctggccgtggccctgtccttggtccaatggtgtatggatgcatgtactgcgcgcggtcttacaacaatactcttgccaccctcaaattcgcagattcaaagaccttgaaggaggaacaaagggaggagctatttgaaagtttaaaggtcaatagctctattgggtgggaagtggatgtcatatgtccaaaggatctatctgctaaaatgttaaaaaggtatgtctagtaacctttgtacctagtgaactgcaaaattgatcttttaccttaattaatagtctcattgtttcagatcgaaagtaaatctaaatgaaatatcacataactctgcca

SEQ ID NO: 29382 - protein, 102 aa, Panicum virgatum
  misc_feature: Ceres CLONE 1891013
  misc_feature: SWISSPROT Homolog: EC 3.1.26.4 Ribonuclease H
MLGQPLRNGQPRCPASWEVPCLMGIDEAGRGPVLGPMVYGCMYCARSYNNTLATLKFADSKTLKEEQREELFESLKVNSSIGWEVDVICPKDLSAKMLKRYV

SEQ ID NO: 29383 - DNA, 626 bp, Panicum virgatum
  misc_feature: Ceres CLONE 1891033
  misc_feature: Encodes the peptide sequence at SEQ ID NO. 29384
atccattcgcaaagctccaacagcaatcaagctagcgagaagctacgacaagaagccagcaagcggcgagatcactcggatcaaagtgatccatggcgccgaggaggtcgacttcgccggccgggagcagcggcagcagcgggggcagcggcgcggagcagcagccgaggctgcgcggcgtgcggaagcggccgtggggccggtacgcggcggagatccgggaccccgtgcgcaaggcgcgcgtgtggctcggcaccttcaacacgcccgaggaggcggcgcgcgcctacgacgccgccgcgcgcaggctccgcgggcccggcgccgccacgaactaccccgcccagggagcaaaggcgccggccgcgagcgcgagcgggagcatcgggttgaccgaggacgcctcgacgtcctgctcctcccgggactcgccgcgggcggtgaccgcgtccgccgcgccgcccccgccgctggacctgaacctggcgctcccggccatggcgaccgccccgacgtcgcaccacgtgttcatggacccggcctcgacgatggtggccgtggcgccggccctgctgcagttcctgccgtctaatagcgatgaagagcaaagcttgccccggtcgtcg

SEQ ID NO: 29384 - protein, 177 aa, Panicum virgatum
  misc_feature: Ceres CLONE 1891033
  misc_feature (25)..(76): Pfam Name: AP2 Pfam Description: AP2 domain
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MAPRRSTSPAGSSGSSGGSGAEQQPRLRGVRKRPWGRYAAEIRDPVRKARVWLGTFNTPEEAARAYDAAARRLRGPGAATNYPAQGAKAPAASASGSIGLTEDASTSCSSRDSPRAVTASAAPPPPLDLNLALPAMATAPTSHHVFMDPASTMVAVAPALLQFLPSNSDEEQSLPRS

SEQ ID NO: 29385 - DNA, 697 bp, Panicum virgatum
  misc_feature: Ceres CLONE 1891038
  misc_feature: Encodes the peptide sequence at SEQ ID NO. 29386
atccctcgcatggcgcgcaccaaccctccctccctcttctgatcttctcctactgccctctgcctgcttgccttcaaaagctccgacgacgcacccttcctagcacgccgcagcacggcagcaggcagacaagacgcccccactactagtagcagctaggccacaacaatcgccggccagccatggccatggcgctcgtctccgcctccggcacggcggccccgctgcagctcctgctcctcgcgctgctgctactcgccgcgtcggccgcggccttgccggccaggtggcaggtagacagggtcagccggcgaggcccctccctgggcctcgtcatgtcctacgtcgacgaggccaccgcgctgcaggcctccggctacttcacgccctggcgcgtcctcccgttcattgacctctacggacgacggtttcacatcggtagcattcgtggcgtgaatgttatatacgcactgacaggacaacgcaggttgaatgcagctgtcactgtacagactctcatcgatgtctttagcgtgtctggcattgttcattacggcacagcagggagttctaatgattccatgtcatttggcgacgtcagtgtccccaagcttgttgcttacacaggtgcctggacatgggagaagttcagatcaccaaaagagtcatcagcagaactcagctttgggagaatata

SEQ ID NO: 29386 - protein, 171 aa, Panicum virgatum
  misc_feature: Ceres CLONE 1891038
  misc_feature: SWISSPROT Homolog: EC 3.2.2.9 Adenosylhomocysteine nucleosidase
MAMALVSASGTAAPLQLLLLALLLLAASAAALPARWQVDRVSRRGPSLGLVMSYVDEATALQASGYFTPWRVLPFIDLYGRRFHIGSIRGVNVIYALTGQRRLNAAVTVQTLIDVFSVSGIVHYGTAGSSNDSMSFGDVSVPKLVAYTGAWTWEKFRSPKESSAELSFGRI

SEQ ID NO: 29387 - DNA, 647 bp, Panicum virgatum
  misc_feature: Ceres CLONE 1891038-R
  misc_feature: Encodes the peptide sequence at SEQ ID NO. 29388
cagcaattagtaaacaacttaaagctcgcatgactggtcatcagaagcttgtgaaccatgtgtacttttcacctgatgggcaatggttagccagtgcctcctttgataaatctgtcaagttgtggaacggtatcacaggaaagtttgttgcagctttcagggggcatgttgcagatgtctaccagatcagctggtctgctgacagtaggcttctgctaagtggaagcaaggattcaaccctaaaggtttgggatattcgaacgcacaagttgaaacaggacctaccgggccacgcggatgaggtgtatgccgtggattggagccctgacggtgaaaaggtggcatctggtgggaaggatcgggtcctcaagctttggatgtgactgaccaagctgttacggtttgaagtctggatacgctacaaatacaagaagagtgatggaactcctgtgataaaaatagttttggtttaggaaccttatgtttagcgagttaatgtggtgagatttcaagctatttctgtttgtatttatttgtgtggtatctggagctagcatcgacatatccatccatgcaaagaaaaacataatggatttgtacaagcacctgattattgcatcaataggtatcagtacttgcaacatccc

SEQ ID NO: 29388 - protein, 126 aa, Panicum virgatum
  misc_feature: Ceres CLONE 1891038-R
  misc_feature (4)..(42): Pfam Name: WD40 Pfam Description: WD domain, G-beta repeat
  misc_feature (46)..(84): Pfam Name: WD40 Pfam Description: WD domain, G-beta repeat
  misc_feature (88)..(126): Pfam Name: WD40 Pfam Description: WD domain, G-beta repeat
  misc_feature: SWISSPROT Homolog: EC 2.7.11.7 [Myosin heavy-chain] kinase
AISKQLKARMTGHQKLVNHVYFSPDGQWLASASFDKSVKLWNGITGKFVAAFRGHVADVYQISWSADSRLLLSGSKDSTLKVWDIRTHKLKQDLPGHADEVYAVDWSPDGEKVASGGKDRVLKLWM

SEQ ID NO: 29389 - DNA, 653 bp, Panicum virgatum
  misc_feature: Ceres CLONE 1891039
  misc_feature: Encodes the peptide sequence at SEQ ID NO. 29390
attttctccctcctctccacctgccggggcctgccttctccctctttctatttgattgtcttgcagcttctttatttgctccaccaccacctacaaggctaaggctccaagctagctaggaactcaaaatactaacaatggcctccctctcctctgccgccgtcaccgccccttccttcgccgcggctgcccggcccgcccccaggcgctctgctgctttcaccgtgcgcgcctcgctcggcaaggccgccggcaccgccgccgtggccgtggccgccagcgccctgctcgcaggcggcgccgccatggcccaggaggtgctgctgggcgccaacggaggcgtcctcgtcttcgagcccagcgagttcaccgtcaaggccggcgaggccatcaccttcaagaacaacgccgggtacccccacaacgtggtcttcgacgaggacgaggtgcccagcggcgtcgacgctgccaagatctcgcaggaggagtacctcaacgcgcccggcgagacctactccgtcacgctcaccgtgccggggacctacggattctactgcgagccgcaccaaggagccggaatggtcggcaaggtcaccgtcaactgatgcatgctgcgatatatctatcatctgcgcatgcatctactgcgtgct

SEQ ID NO: 29390 - protein, 155 aa, Panicum virgatum; identical to SEQ ID NO: 10141
  misc_feature: Ceres CLONE 1891039
  misc_feature (59)..(155): Pfam Name: Copper-bind Pfam Description: Copper binding proteins, plastocyanin/azurin family
  misc_feature: Functional homolog of the protein sequence given in SEQ ID NO 50157
  misc_feature: Useful for making plants with modulated nitrogen use efficiency

SEQ ID NO: 29391 - DNA, 718 bp, Panicum virgatum
  misc_feature: Ceres CLONE 1891047
  misc_feature: Encodes the peptide sequence at SEQ ID NO. 29392
cttcgtataaaactgcagcgtcactttcctccccgtggttccggcggcggcgcgctagcgatcttgagaggggcggaagcagaaggacgcgccggtcacatcgcttcgcccccgccatgtcgaagaggaagaccagggagcccaaggaggagactgtaactcttggacccactgtccgtgaaggggagcatgtcttcggagtagctcatgtctttgcatccttcaatgacacattcatccatgtcactgatttgtctgggagggagacacttgttcgtatcactggtggcatgaaggtcaaagctgatcgtgacgaatcatctccatatgccgctatgcttgcttctcaggatgtggcccagcgttgcaaggagcttggtattactgctttgcacattaagctccgcgccactgggggcaacaagaccaagacacctggacctggtgctcagtctgctctcagggcactcgctcgatctggcatgaaaatcggacgcattgaggatgtgaccccggttcccactgacagcactcgcagaaagggtggcaggagaggaaggaggctgtagatgtttttttttcctgtcatttttgtggagaatcctctatttaaatattcttatatagcttacatgttccggtgaagcttgggttttgttttgctcagtgttctggattattgactgtctgccaatttggcgattcttttggttaagaa

SEQ ID NO: 29392 - protein, 150 aa, Panicum virgatum
  misc_feature: Ceres CLONE 1891047
  misc_feature (28)..(146): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass
MSKRKTREPKEETVTLGPTVREGEHVFGVAHVFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 29393 - DNA, 734 bp, Panicum virgatum
  misc_feature: Ceres CLONE 1891097
  misc_feature: Encodes the peptide sequence at SEQ ID NO. 29394
ccgccagagcagagcaggggagcagaccccgccatggccgccgccgacctctcccgaccgctctgcgccgccgtcatcaaatcctccttccgcccccacctcccgctcctcgccgccgctcccgcactccttcaacgcctctccccgctcccttccgccgcgctcgccttcttccgcgccctgccgccgccgcacccgctcgacgcctccctcgcgctcctccgcctcctcgcgccgcacccgcgccaccaccccgctgcccgcgccctcctccgcgacctcgccttgcgccacccgctatcctccccgctcatgcttccctccctcctcgccgaccaccacccccacgtccccagctggctcctcctcctcctctcccagtccgcacgccccgacgacgccgtccgggtgttcgaccagatgcgcgcccggggcctcgcccccgacgcccacgcctgcaccgcgctcctcaccgcgctcgccagggcccggatgacggccaccgcgcgcagggtgttcgacgaaatggccagggccggcgtcgccatcaacacccacgtctgcaacgccatgctgcacgtctgcctcaaggctggggacgccgcgcgcgccgaggcgctcatcaccaggatggacgcggctgccgtgcccttggaccgcttctctttcacaccatcatcgccctctactgcaggaaggggatgaggtacgaggtcatgtgcgtgcgggagcgc

SEQ ID NO: 29394 - protein, 223 aa, Panicum virgatum
  misc_feature: Ceres CLONE 1891097
  misc_feature (140)..(174): Pfam Name: PPR Pfam Description: PPR repeat
MAAADLSRPLCAAVIKSSFRPHLPLLAAAPALLQRLSPLPSAALAFFRALPPPHPLDASLALLRLLAPHPRHHPAARALLRDLALRHPLSSPLMLPSLLADHHPHVPSWLLLLLSQSARPDDAVRVFDQMRARGLAPDAHACTALLTALARARMTATARRVFDEMARAGVAINTHVCNAMLHVCLKAGDAARAEALITRMDAAAVPLDRFSFTPSSPSTAGRG

SEQ ID NO: 29395 - DNA, 577 bp, Panicum virgatum
  misc_feature: Ceres CLONE 1891097-R
  misc_feature: Encodes the peptide sequence at SEQ ID NO. 29396
gaagttggcgcccatcttggaggaggcagccaccacacttcaaagtgatgaggaagttgtgattgctaagatggatgccaccgcgaacgacgtgcccagcgagtttgacgtccagggctacccaaccatgtacttcgtgacccccggcgggaaggtcacctcctacgatgctggcaggacggctgatgagatcatcgatttcatcaagaagaacaaggagacgtccggcgcgaccccggcgtccgagaaggcagcggaggcagccccgccctccgaacctatgaaggacgagctgtaaaacccaacgttttgggatgcttgcggctgtgagcatgggagagtagagggaaaaccgggcgccactaacatgtttgacagttcaaacgccagattttgcgagggttagagagagagagagagaggggggggggggcaaagagagagaaaggggatccgcggttcccatgacggatgattctgtacaatcacagtaccttttagttgattctgagaagtgacactagaaatacatggattgtgatcaggctgaatgaataaatggcggttctgccttgcc

SEQ ID NO: 29396 - protein, 98 aa, Panicum virgatum
  misc_feature: Ceres CLONE 1891097-R
  misc_feature (1)..(71): Pfam Name: Thioredoxin Pfam Description: Thioredoxin
  misc_feature: SWISSPROT Homolog: EC 5.3.4.1 Protein disulfide-isomerase
KLAPILEEAATTLQSDEEVVIAKMDATANDVPSEFDVQGYPTMYFVTPGGKVTSYDAGRTADEIIDFIKKNKETSGATPASEKAAEAAPPSEPMKDEL

SEQ ID NO: 29397 - DNA, 2474 bp, Panicum virgatum
  misc_feature: Ceres CLONE 1891099
  misc_feature: Encodes the peptide sequence at SEQ ID NO. 29398
cccgcgttccggtcttcgctccgccggtggtgtgcgggtccggtcgtagtctgcccacaccgggagacgaaattgcaccagcgcgccggcggaagcgagaggtgacgccatgtccgctccggcgccgtcgtcgccggccacgccggtgaacccgcctgcaccggtgccgccaactcccgcgccggtgccgcccacgccatcgccggtgccgcccactccagcaccggtgctgcccacgccatcgccgttgccgcccacgccatcgccggtgccccccacgccatcgccgctgccgccctcgcctacccctacgccgtcgcccccaccgccggtggtgacaccgtccccacctccgccagtgcccgtcgtcccgacgccatctcctcctccaccggcgaccgtgccaacggcatctcctcctccaccggcgaccgttccgacaccatctcctcctccaccggcgaccgttccgacaccatctcctcctccaccggcgaccgctccgacaccatctcctcctccgcctgtacgccggcctcctcctcctcctagtgacgtccccacttctccgccaccccctaccggcgtcccagcgtcacccgcgcctcctccgccgtcgcatctgtccctgcctccacctccgccgccctcgtcgccaggaacgccaccgacttcgtccccctccaagtcgacagtcaacggcactgcggtgggcataggcgtggccgtcggggcggtggtcctcctcggcctcgctgccgggctcatctacttcttcgtaggaaggaagcgccgccgccgcccgccgccgtcgcaggggtacccagccgagttctacgacccgcggcggccggtgacgacgccgccgcacatgtcgcacgcgccctcgacgacgccgtcgtcctcgacgccgccgctgatgcactcgtggcagagcagccgcgggccgtccgagcccttgatgccgccgctgaacccgtcgccggcgatgaccggcggcacgttcgcgtacgacgacctggcggcggccacggacgggttctcggacgcgaacctgctcgggcagggcgggttcgggcacgtgtaccgcggcacgctgggcgggcaggaggtggccatcaagaagctgcgcgccgggagcgggcagggcgaccgcgagttccgcgccgaggtggagatcatcagccgcgtccaccacaagaacctcgtctccctcgtcggctactgcctctatggcgagcagcggctgctcgtctacgagtacgtccccaacaagaccctggagttccatctccacgggagtggcaggccgacgctggactggccgcggcggtggaagatcgccgtcggctcggcgaaggggctcgcctatctgcacgaggattgtcatccaaagattatccatcgtgacatcaaggcggcgaacatccttctggattacaactacgagccgaaggttgcagattttgggttggccaaataccaagcagctgaggtgacagctgtttctacgcgcgtaatgggaactttcggatatttggcgccagagtacgctgccacaggcaaagtgagcgaccggtccgacgtcttctccttcggcgtgatgcttctggaactgatcacagggaggaaacctatcatgacatcttcagcttatcagcctgagacgttagtttcctgggctaggcccttgctgacaagagctgtggaggaggaaaactacgacgagctgatcgacccgaggctggagaccaactacgacgcgtacgacatggcgcggctgatcgcgtgcgccgcggccgccgtgcgccagaccgcgcgatcacgcccgcggatgagccagatcgtccggtacctggagggcgagctgtcggtggaggacctgaacgccggcgtgagaccgggacagagcgcgatgcagcggtcgggcggcgacacgacggaccagatcggccggctgcggcggatggcgttcgggccgggcgccggcgggagcacaaccggcaccggcgccggcaccatcacggagtacgcgagcagcgagttcagcgaccccaccagcgagtacgggctgaacccgtccagcgagtacacggccagcagcggcggcgacacgggcgaggtgcctccggcggcgcagggccagggccagcagtggcccggcaggcgcgcggccggcgacaccgagaggatgagccggcgcaccatcggcagacgcggccagacgtgacaccgagcattccttggcgccccgtcagcttacgaagggacggtgaactcactgttcgtgtacatgcagccgctgtgggattgaattttgcttctcgttttgttttgttctcttttttctcaggtttctgattcatgattttttttcgggcgggtgtgggtgggaggtttaagttgtaaatcgtacgcactgtgtcgccactcgcccagtgaataaaaaggtccaagatttgagttgctcatgc

SEQ ID NO: 29398 - protein, 413 aa, Panicum virgatum
  misc_feature: Ceres CLONE 1891099
  misc_feature (18)..(290): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
MTGGTFAYDDLAAATDGFSDANLLGQGGFGHVYRGTLGGQEVAIKKLRAGSGQGDREFRAEVEIISRVHHKNLVSLVGYCLYGEQRLLVYEYVPNKTLEFHLHGSGRPTLDWPRRWKIAVGSAKGLAYLHEDCHPKIIHRDIKAANILLDYNYEPKVADFGLAKYQAAEVTAVSTRVMGTFGYLAPEYAATGKVSDRSDVFSFGVMLLELITGRKPIMTSSAYQPETLVSWARPLLTRAVEEENYDELIDPRLETNYDAYDMARLIACAAAAVRQTARSRPRMSQIVRYLEGELSVEDLNAGVRPGQSAMQRSGGDTTDQIGRLRRMAFGPGAGGSTTGTGAGTITEYASSEFSDPTSEYGLNPSSEYTASSGGDTGEVPPAAQGQGQQWPGRRAAGDTERMSRRTIGRRGQT

SEQ ID NO: 29399 - DNA, 787 bp, Panicum virgatum
  misc_feature: Ceres CLONE 1891103-R
  misc_feature: Encodes the peptide sequence at SEQ ID NO. 29400
gttctgaagaaaatgacggacagttaggatctcctaaagccattcctgtggcaagtatgttgctcgaggatgttcatggtgatagtgcaaaaactgcaaagaaagatggcttgaaagccaatgactcagataaagataggtctggtaacagtgctagtgtatcaatacaagacagcaacatgaaagaaccaattacacaaacaagtggtggagcagaatcaaatgtgtcgtcacaggcaaaaccttcatcgaagaaacctgcagtacggaaaaaggttcctttcgagaagggctatagccaaatggattggctaaagctgacacgaacacatcctgatctagctgggctcaaggggcagtcaaatcgaaggttaatttctttggaagaagttaagcagcataaaactggagattgcatttggacagttctcaaaggccgtgtttataatatcgctccatacatgaaatttcatcctggaggagttgatatgcttatgaaagctgctggaaaggactgcactgctttgttcaataaataccatgcttgggtaaatgcagagttccttttggagaagtgccttgtcgggttccttgatcccaacgagtagatctcaaggttcaagccaatgtggcattttatcacttttgcactactggactatttgtataagcacactagtagatgaattaaagaatgtaactgttctattgtatcacaatgagaaaacaataattcatttcgtcctaaaaagaaagagagaaataagcttagtgtctgttcgtcctt

SEQ ID NO: 29400 - protein, 201 aa, Panicum virgatum
  misc_feature: Ceres CLONE 1891103-R
  misc_feature (124)..(198): Pfam Name: Cyt-b5 Pfam Description: Cytochrome b5-like Heme/Steroid binding domain
  misc_feature: SWISSPROT Homolog: EC 1.6.2.2 Cytochrome-b5 reductase
SEENDGQLGSPKAIPVASMLLEDVHGDSAKTAKKDGLKANDSDKDRSGNSASVSIQDSNMKEPITQTSGGAESNVSSQAKPSSKKPAVRKKVPFEKGYSQMDWLKLTRTHPDLAGLKGQSNRRLISLEEVKQHKTGDCIWTVLKGRVYNIAPYMKFHPGGVDMLMKAAGKDCTALFNKYHAWVNAEFLLEKCLVGFLDPNE

SEQ ID NO: 29401 - DNA, 2302 bp, Panicum virgatum
  misc_feature: Ceres CLONE 1891103
acatagacaaaagttgcaaaactctacagcttcattgaaccaaagtccaaaaaaactcgaccacaggaggtgacgtccccttggtttgtcttagaggcgagtacctaacccttttaggaagctactcacacaacctgcgagcgcacaggttgagcccaggtcagcagcctctcaactggaggctctagccatcacttgcaaacattgtcaaatactttatgttccaaaaagatgagcgctcaaataatgctactgaacagttatatgatggtccctaagaaagtatatgcctatattcacagaaatgtgtataaaacaaagttgatggctgctgccataccgaacaagtaggatgtgttcagcccaacatttctatgttgcaatatttgtgtgcttagtggtaaccactatttttaagtggagcaggaaagcaagtactggcaatgtgcttatattatcatattatatgcttatttcggaagagatcttgctccatccttggttgaaaaataatgtaggttaagtaccataaatggctaaattggcaccgatggttgttgatgtgagacttgcttgctctgcactattggaaaactacaggatggcatggcatggcatgccaagcaggtttccgacaaattaatttcaggtctgtgttggactgttgataggttggcaacttcgtgtctacatttcattcttttatccatagatatgacatgccacatgtaaatattcttgtgttggtttttgatcagtgacatgccacgtgtagatatgacaaagtaatttcatatctgtgttggttttactacatggagaggtattctgctgagcccgcctattggatagtaattattcatcagggttattagtaaatctggaagaaaagtttactagagcacatacattacaactggactatcttagccttgcagtttgttatttacttattttaaagctttaactcaaactgtatctgaactgatagtatcatagccacctttatgaattaaagaaggaaaatttgtacctgaacattaccctttgatttgacgcagtaactgtactagatttttttcttgcttgactatcgtagcctgccacttgagaaggttttgtatactttaaactgatagtattaactcgaagtatccggttgcatactttaatgcaaaacttctaacctgtccaatatagtcatgaagcatgctcctgctttgaatccattctgggacaatgcctcttatgttcaatatgggttataaagctccagttatgttttcctcaaaaagaaacaagtgtttctgtccttgatccaattcatgttctttgcacttgcctttttattttggctcgtcgccgtgcatcgccatgcaattggaaaattagtaaagagtagtccaattactaatgcctgaagctaacaaagttatagtcgtaaagggattaatgcactgcaagttgtcatctagatcatagacagagtgaaggaacaaattgtagtattgtaccatgtgtgctttatgtaaactgtaacaagttatgtgaatgcaagtgaccaaaccaagcaagtccataatagagtactattgtatccatacagcaacctagcatgacaagcatgctgcttaattgatgtacaagcctttctgagaatagttgctgacaagaaagctgtcaaggctctcaataaattatgcggtctacattctgtcaattaagtggtctcttgcagcaatcaaattttttgctctaattactcttgcagcacttgaatttttggctctaaatgaagcagcatgtttaacaattttggattgatatgcccaaatggctcctctactggtcagatcattctcctttagcctaccatcggtaccactgtaccagtgatggcattgctgttgagctgacaagttcaacaagttgtgttagacctttcctttcatcatattttagctcactttcaatctttaattgttctttcaccgttctgtttttcttcaatcataagagaagcctgagatacaaaaaaaaaacatttttcttgattttctggggcttcttgctgccttagccatttcctcaagatgctcttgcacagcatgaccattttttctgtagcagtttctctttcttcccagaccattatgttatttgttggcagatttgcatctttttacacttgaattttagctcccgtagcaacgcacgggcattttactagtccctcctgaatttcgatggggtttctgaaatcatctagtattttacacatcctgccttatgaacatgaacc

SEQ ID NO: 29402 - DNA, 571 bp, Panicum virgatum
  misc_feature: Ceres CLONE 1891105
  misc_feature: Encodes the peptide sequence at SEQ ID NO. 29403
ctcttctccctctcctctcgtctcggcctcaggatcatcagcggcaatggcgatggcgtcgtcgagcgggctccggagctgcagcgccgtcgtcgtcgcgcgccgggcggctgccgttctgtgccagcgccaccacctccggccgcgtcatcatgtccgccgagtggatgcccggccagccccgccccgcccacctcgacggctcctcccccggggacttcggcttcgaccccctcggcctcgccaccgtgccggagaacttcgagcggttcaaggagtcggaggtgtaccactgccgctgggccatgctcgccgtgcccgggatcttggtgccggaggcgctggggctcggcaactgggtgaaggcgcaggagtgggcggcggtgcccggcgggcaggccacgtacctgggcaacccggtgccgtggggcacgctgcccaccatcctggtgatcgagttcgtggccatcgccttcgcggagcaccagcgcaccatggagaaggaccccgagaagaagaagtaccccggcagcgccttcgacccgctcggcttctccaaggaccccgtcaa

SEQ ID NO: 29403 - protein, 189 aa, Panicum virgatum
  misc_feature: Ceres CLONE 1891105
  misc_feature (60)..(186): Pfam Name: Chloroa_b-bind Pfam Description: Chlorophyll A-B binding protein
LLPLLSSRPQDHQRQWRWRRRAGSGAAAPSSSRAGRLPFCASATTSGRVIMSAEWMPGQPRPAHLDGSSPGDFGFDPLGLATVPENFERFKESEVYHCRWAMLAVPGILVPEALGLGNWVKAQEWAAVPGGQATYLGNPVPWGTLPTILVIEFVAIAFAEHQRTMEKDPEKKKYPGSAFDPLGFSKDPV

SEQ ID NO: 29404 - DNA, 628 bp, Panicum virgatum
  misc_feature: Ceres CLONE 1891108
  misc_feature: Encodes the peptide sequence at SEQ ID NO. 29405
acaatcatttcggccgctgcgtcgcgttgggagcagtactccgctttgcttgcgtcccgacaagcggaaagaagaggcgagggaggtagaaaggggggaagagccgtagaggaagggggaagcaaatctttgaggggagtcgagagattcctgtggcggaggaggagaagcgcgagcggagcgtagggaggtagctcaatagatctacgacagcttatgtgagttgatgcaaagctgagttggcattggtgtagccctgtcttcttgagcaatggcatcagcaggtgtagctccggctgggtacaagaacagcagcagcacaagcattggtgctgataagttgcaggatcacatgaacgagctaaagattagagatgataaggaagttgaagcaaccataattaatgggaaaggtacagaaactgggcacataattgtgacaactactggtggaaagaatggtcaaccaaaacagacagtgagctacatggctgaacgcattgtaggtcaaggttcttttgggattgtcttccaggctaaatgcttggagacgggtgagactgttgccataaagaaggtccttcaggataaacgttacaagaaccgtgagctgcaaaccatgcgcctt

SEQ ID NO: 29405 - protein, 118 aa, Panicum virgatum
  misc_feature: Ceres CLONE 1891108
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
MASAGVAPAGYKNSSSTSIGADKLQDHMNELKIRDDKEVEATIINGKGTETGHIIVTTTGGKNGQPKQTVSYMAERIVGQGSFGIVFQAKCLETGETVAIKKVLQDKRYKNRELQTMR

SEQ ID NO: 29406 - DNA, 2906 bp, Panicum virgatum
  misc_feature: Ceres CLONE 1891119
  misc_feature: Encodes the peptide sequence at SEQ ID NO. 29407
atcgctgccgagcgctccccgctgctgccgctttctcccacttctagctcctcctctgctctgctctgctctgctcccccactcggccactccaccccccgcggccactcctcgccgccgcttcggcaaaaaccctagcgaatcctcgcgccccgccgcgctcgtcgaggcgggagcaccgccggtccgcggccccgggccccgccgcccggactcagtgatgccggctcttcacccggggaagccgcgtctccggtcgccgagcgccaggcgcccaccggcgctgacttgaaatgcaacagccgttgtgcggcctcccgcccagatgaaggtgcggctcccggagcaggagagagccaaggggatggcttccgcggggtgctcggagatagtcgagctggtggacgaacccaagggtgcgtgcccgggcggggtcacccacctgagggtcagggtcaagcctgtggggcaggagcatggggcgcggtcgtgcgcggtggaggatgacctcgaccggctcatcaggtcgatcaacgtgcgcacctcggcgcgggcctccgggcagacgagcacggacaggaggctcatcgcgctcgggaagtcgccggtgtcgagctcggagattgtggagtccgtcagcctcaagcaggccctgcggaagatgtgcatctcccaggcgtccgagatggctgccacgaagaggctgtccaagccgccgggggtgtcgacgcccccggattccggggcgatcaagaagctatatggatcggcggcggttcagaccaaagaggagaaagatgaaaataataaggttgcgaaagtttctgtgctgccagacaaggctgcggggagttcgtcgggtaagccagctgaaaccagcaaggggcagagcaagagctcgaccaagaagagttcgcgatcagcatctccaaccacagccaagatccagaaaaccaggatccaagatgtgatcagtaataaatcatcagaggcagctgatgatcctcctgcaggaacaacactggcaaagcagagaaagggaaaatctgcgaaagcatctagcccccgcgctgttccagtaggtggttcacgactggtgaagccattgtttcggaataaaacctcaacgaaaaagaaggttaaacccgaaccagctgctgtggccacagcacacaagcattatgaggcaaaaggttctaattctcacactggtaaacaggaggcccttcaggatgaacccagaaccccagcacctactaacaagaaggctgctatcagctctacatgcgttgaaggagctggttttggcaccaaaagttgtggtgttggtgcaatccatggttcaagggccggtgagttgtcaagatcgaaggaaaagggtgaatgctcccaaagctcaaagagtagcattggtgattatagcaccagcacgagcatcagtgaggatagttatggcagtttcagtgccaatggaagcaggccacacatgtcaaaagatgtgagatggggagccatcaggcgtatggctattcaacaagggagcttgggattggagaacttcaagcttctgaaacaacttggttgtggggatattggcactgtttatttggctgagttggtgggctctgactgcatgtttgcattgaaggttatggacattgaatacctgataagcagaaagaagatgctcagagcacaaactgagagggagatactgcaaatgctcgaccacccattccttccaactctgtattctcatttcacgacagacaacctatcttgcctggtaatggagttttgcccaggtggtgacctgcatgttcttaggcagaaacaacctaccagaaccttttcagaagcagctgcaaggttctatgtcgccgaagtcctcttagccttggagtacctccacatgttgggggtcatatatcgtgatctgaagccagagaacatacttgttcgtgaagatgggcacatcatgctctcagactttgatctgtctctaaggtgctcagtgagtccaatgcttgtgagaacatcatcagtaggcagagatgagcccagtaggccttctggtccctgtgcacaaagctgcattgatccattatgtatccagccatcctggaacaattcatcttgcttcacgccccggctggtttcatctacaccgtcaaggacatggaagcctagagctgaacccctgaagaaaccatcacttccacagctcgttgttgagcccactgatgcaagatcaaattcgtttgtggggacccatgaatacctggccccagagatcattcgaggagatggccatggcagctcggttgattggtggactcttggcatcttcctctatgaattgctctacggcaagacaccatttaggggaactggcaatgaggagacactctccaatgtgatatcgcagggcctgaagttccctgataaccctgcggtcagcttccatgcgcgagatctgataagaggcctgcttataaaggagccagagcatcggcttggctcatcgagaggagctgctgagatcaagaggcacccgttctttgaaggcctgaactgggccttgatccgttggaccgcaccgccagagactccgaaaggctttgacactgctgcagcaaccgtcgcaacgactcgcaagaaaaaggaaggcaagtgtctggagtttcgcttgaacggtgatgacatcgagtttgagctcttttagatttggcgacgatggaggtgtcagatggctggtgtgcctggtgttcacagagaaggaaacatacttgctcggtgacagttgacatgggcagttgccctacacgtgtccttcgcgtatgttctagtatctgtactcttcgttgtaggttttccttactgtttaaatgcagatgagtacttac

SEQ ID NO: 29407 - protein, 799 aa, Panicum virgatum
  misc_feature: Ceres CLONE 1891119
  misc_feature (412)..(746): Pfam Name: Pkinase Pfam Description: Protein kinase domain
  misc_feature: SWISSPROT Homolog: EC 2.7.11.1 Non-specific serine/threonine protein kinase
MKVRLPEQERAKGMASAGCSEIVELVDEPKGACPGGVTHLRVRVKPVGQEHGARSCAVEDDLDRLIRSINVRTSARASGQTSTDRRLIALGKSPVSSSEIVESVSLKQALRKMCISQASEMAATKRLSKPPGVSTPPDSGAIKKLYGSAAVQTKEEKDENNKVAKVSVLPDKAAGSSSGKPAETSKGQSKSSTKKSSRSASPTTAKIQKTRIQDVISNKSSEAADDPPAGTTLAKQRKGKSAKASSPRAVPVGGSRLVKPLFRNKTSTKKKVKPEPAAVATAHKHYEAKGSNSHTGKQEALQDEPRTPAPTNKKAAISSTCVEGAGFGTKSCGVGAIHGSRAGELSRSKEKGECSQSSKSSIGDYSTSTSISEDSYGSFSANGSRPHMSKDVRWGAIRRMAIQQGSLGLENFKLLKQLGCGDIGTVYLAELVGSDCMFALKVMDIEYLISRKKMLRAQTEREILQMLDHPFLPTLYSHFTTDNLSCLVMEFCPGGDLHVLRQKQPTRTFSEAAARFYVAEVLLALEYLHMLGVIYRDLKPENILVREDGHIMLSDFDLSLRCSVSPMLVRTSSVGRDEPSRPSGPCAQSCIDPLCIQPSWNNSSCFTPRLVSSTPSRTWKPRAEPLKKPSLPQLVVEPTDARSNSFVGTHEYLAPEIIRGDGHGSSVDWWTLGIFLYELLYGKTPFRGTGNEETLSNVISQGLKFPDNPAVSFHARDLIRGLLIKEPEHRLGSSRGAAEIKRHPFFEGLNWALIRWTAPPETPKGFDTAAATVATTRKKKEGKCLEFRLNGDDIEFELF

SEQ ID NO: 29408 - DNA, 711 bp, Panicum virgatum
  misc_feature: Ceres CLONE 1891127
  misc_feature: Encodes the peptide sequence at SEQ ID NO. 29409
ggccaagcaaagcgttttgcatgtgttcatgtgtgttcggccgtcgtcgtctgaatttttgctgaagtttttgtctgaatgaaatcatataggtacgggctgccgttcgtgtccccgaacaacatcctggtgacgacgatcaacgggacggggtcgctgatcgaggccatctacgtggtgatcttcctcatcttcgcggagcggcggatccggctgcggatgctgggcctgctgggcgtcgtcacctccatcttcgccgcggtggtgctcatctcgctgctggccctccacggcaacggccgcaagatcttctgcggcctcgccgccaccgtcttctccatctgcatgtacgcctcgccgctctccatcatgaggctggtgatcaagaccaagagcgtggagttcatgccgttcctgctctccctgtccgtgttcctctgcggcacctcctggttcatctacggcctcctcggccgcgaccccttcatcatcatccccaacgggtgcgggagcttcctgggcctggcgcagctgatcctgtacgccatctaccggaacaacaagggcgccgccgcgccggccggcaagggggaggccgccgcggaggtggaggacgcgaagaaggtggccgccacagtggagctggccgacgccacgaccaacaatgtcgccagccaggtgtagactgcgggttctgtacccaaggcttgc

SEQ ID NO: 29409 - protein, 201 aa, Panicum virgatum
  misc_feature: Ceres CLONE 1891127
  misc_feature (77)..(163): Pfam Name: MtN3_slv Pfam Description: MtN3/saliva family
MKSYRYGLPFVSPNNILVTTINGTGSLIEAIYVVIFLIFAERRIRLRMLGLLGVVTSIFAAVVLISLLALHGNGRKIFCGLAATVFSICMYASPLSIMRLVIKTKSVEFMPFLLSLSVFLCGTSWFIYGLLGRDPFIIIPNGCGSFLGLAQLILYAIYRNNKGAAAPAGKGEAAAEVEDAKKVAATVELADATTNNVASQV

SEQ ID NO: 29410 - DNA, 668 bp, Panicum virgatum
  misc_feature: Ceres CLONE 1891142
  misc_feature: Encodes the peptide sequence at SEQ ID NO. 29411
ggacggccgcggggcggcgccgcgcgcgcgcctggcggacttcgggtccgcggcgtgggtgggcgcggggggcctgggccgcgcggaggggctggtggggacgccccactacgtggcccccgaggtggtggccggcggcgagtacggcgccaaggccgacctgtggagcgccggggtggtgatgtacgcgctgctgtccggcggcgcgctccccttcatcggcgagagcgccgcggaggtgctggcggccgtgatgcgcggcagcgtgcggttcccgcccaggctgttcggcggcgtgtccccggcggccaaggacctgatgcggcgcatgatctgccgcgacgagtggaggaggttcaccgccgagcaggtcctcgctcacccgtggatcgtgaccggcggcggagcccgggcaatggagcagccgacctgaggagacatacccccccaccggcggaccatggccagcgggcgggcgtgtatcgccgtacagataagatacggcgacgaataccgacgttgtgtatacggttttgtacgtacggactacggagcagggatgtacgctgccgccggctgcagagtagcatcgcgtcccggtgccgccgcagcagagcaggtcgatcggcgacgaagcttccaggcttctggttctcttcgcccggttt

SEQ ID NO: 29411 - protein, 143 aa, Panicum virgatum
  misc_feature: Ceres CLONE 1891142
  misc_feature (1)..(130): Pfam Name: Pkinase Pfam Description: Protein kinase domain
  misc_feature: SWISSPROT Homolog: EC 2.7.11.1 Non-specific serine/threonine protein kinase
DGRGAAPRARLADFGSAAWVGAGGLGRAEGLVGTPHYVAPEVVAGGEYGAKADLWSAGVVMYALLSGGALPFIGESAAEVLAAVMRGSVRFPPRLFGGVSPAAKDLMRRMICRDEWRRFTAEQVLAHPWIVTGGGARAMEQPT

SEQ ID NO: 29412 - DNA, 703 bp, Panicum virgatum
  misc_feature: Ceres CLONE 1891144
  misc_feature: Encodes the peptide sequence at SEQ ID NO. 29413
aacacggcacgccaaaccaaaaccacacaggacgccaggagctccgcgtcccaaatttcttcttctgcaggagtagcccgcccaagaggagttcgttcccggaatctctcgctcgcgtgcgcgtgatttcatccccaacaacccaagtccctctccctctcgctccggcggtcggttccttcgatcccaaatcgtgatccaactcgatggcggccaccgccggcggcaacaagatccgcaacgccaagctggttcttctcggggatgtgagcgccggcaagtccagcctggttctccggtttgtcaaaggccagttcgttgaattccaggaatcgaccatcggggcggctttcttctcgcagaccttggcagtgaacgatgagacagtcaagtttgagatatgggacacggcagggcaggagaggtatcacagcttggctcccatgtattaccggggcgctgctgctgcgatagttgtctacgacatcacaaatgcggcctctttcacacgtgcaaagaaatgggttcaagaacttcaagcgcaaggtaacccaaatacaataatggctcttgctgggaacaaggctgatttggtagaggcgaggcaggtgccagcagaagaagcaaaggcatatgctcaagagaatggtctcttcttcatggaaacatctgctaaaacggcgatcaatgtggaatgacgtgt

SEQ ID NO: 29413 - protein, 163 aa, Panicum virgatum
  misc_feature: Ceres CLONE 1891144
  misc_feature (14)..(163): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
MAATAGGNKIRNAKLVLLGDVSAGKSSLVLRFVKGQFVEFQESTIGAAFFSQTLAVNDETVKFEIWDTAGQERYHSLAPMYYRGAAAAIVVYDITNAASFTRAKKWVQELQAQGNPNTIMALAGNKADLVEARQVPAEEAKAYAQENGLFFMETSAKTAINVE

SEQ ID NO: 29414 - DNA, 713 bp, Panicum virgatum
  misc_feature: Ceres CLONE 1891153
  misc_feature: Encodes the peptide sequence at SEQ ID NO. 29415
atcttactttatgtctcctcgatcgctccggccggctataagcaagactgacgatcgagacactccagctaccagcagctcgctcagtcccaagcaatggcccccagcagctcctccgcaaagcagctcgtcgccgtcgccgtcgtggctttcctgctcgccgccggcgccgcgtccggccgccggcagccggtgcacctgcggctgtacatgcacgacgtgatgcgcgggccggggacgacggccgtccacctcatccacggcgtcgggccgccgcacaacatcgagcggggcggctacttcggcgacacggcggcgatcgacgatgtggtgacggaggagcccgacgccggctcgcgggccgtcggccgggcgcagggcacctacatgctggcctcccagcacgaggaggtgctcgtggtcgccgtcaccgtcgcgctcaccgcggggccgtacaacgacagcaccttctccgtggccggccgcgtcagggtctacgacgacaaggcggaggccgcggtggtcggcggcacgggccggctccagcacgctgccggctacctgacgtggaggatggtcgagctggtggtgtccgaggggtagtaatggtggagctggacgtgcacatgtccgtgccgccggtgagcgccgccggtggcatcaattggtggtcatcttctgttgcgatcgagtaattaatatatagcacaatt

SEQ ID NO: 29415 - protein, 168 aa, Panicum virgatum
  misc_feature: Ceres CLONE 1891153
  misc_feature (17)..(167): Pfam Name: Dirigent Pfam Description: Dirigent-like protein
MAPSSSSAKQLVAVAVVAFLLAAGAASGRRQPVHLRLYMHDVMRGPGTTAVHLIHGVGPPHNIERGGYFGDTAAIDDVVTEEPDAGSRAVGRAQGTYMLASQHEEVLVVAVTVALTAGPYNDSTFSVAGRVRVYDDKAEAAVVGGTGRLQHAAGYLTWRMVELVVSEG

SEQ ID NO: 29416 - DNA, 606 bp, Panicum virgatum
  misc_feature: Ceres CLONE 1891180
  misc_feature: Encodes the peptide sequence at SEQ ID NO. 29417
tgtaaccgcgcagcgctgcaccaccactccgctccattccccttacttaccctttttctcctcgtcttcccccgcccgcccgctctcctcccctgcgcgcgtgcgagagcaccggcaggttccgattccaattccgccgcgcctctcccccattggctcgccgtcgcagcggccgcggccgcctcgcctcacccgtcgccaccggcctcgtcacctcctgttctgctccgtgccatcggggcctgacagggacagcctaccggcacagcggaggacggcgtcaggacaagcgctctccccgagcaacaagtatcccggcagcgcggcttcgctgccgctcggcgctcgagctccacacacaccgccaccagcacgccagcacgagcgggagcgggagggcgcgctacctgcttgattcggtcaactcctgcgcgcccgcggcaggatcaagaccaatggggcgggagcggaggccgggggcggggcggcggcccgccgccgccgctcttcttctcgtcgcctcctgcgtcgccgcggcgccgctgctgcagcagcaccagcgcggcaggatctcaggggacgccggcggcgtgctggacgacaacc

SEQ ID NO: 29417 - protein, 50 aa, Panicum virgatum
  misc_feature: Ceres CLONE 1891180
  misc_feature: Functional homolog of the protein sequence given in SEQ ID NO 50681
  misc_feature: Useful for making plants with altered carbohydrate content
MGRERRPGAGRRPAAAALLLVASCVAAAPLLQQHQRGRISGDAGGVLDDN

SEQ ID NO: 29418 - DNA, 713 bp, Panicum virgatum
  misc_feature: Ceres CLONE 1891190
  misc_feature: Encodes the peptide sequence at SEQ ID NO. 29419
gcgaaaatcacaaatcaagatgtgggggaaggggaagaagcgcttcggcggcggaggcgggggcgagccggcggccaagcgccaggccgccggggacgaggggccctctgaatccgccgaagacggcaccgtcgtggccgagatatcgaagaacaggaaggtgtccgtgaggagctggaagggcaaggtctacgtcgacatgcgcgagttctacgtcaaggacggcaagaccctcccttcccgcaaaggtatatcactacaactggatcagtggaagatactgagggacaatattaaagccatagatgaggccatcaaggaaaatgcatgacaggagccttgagatggatcacataggggcaatcttttgcgtactcttcagacccctgatgtacgctagtaggccctcaggatcataggggcaatcttttgcgtattctcttcagacccctgatgtacgctagcctgggcgttcgggtaattcgggtatttcgggtcgggtaattcgggtaatcaaaaattcaggtaataaaaaatgctacccgaaatttatccgaaaaaaagaatacccgaaaattcgggttcgggtatcgggtaatccagatgccgggatcacatcttattgggtatacatctaattttccactagcattcatctttgtatgtaaattctagaagtacacttatttttttgtgacagagggagtgagatg

SEQ ID NO: 29419 - protein, 103 aa, Panicum virgatum
  misc_feature: Ceres CLONE 1891190
  misc_feature (12)..(99): Pfam Name: PC4 Pfam Description: Transcriptional Coactivator p15 (PC4)
  misc_feature: Functional homolog of the protein sequence given in SEQ ID NO 51314
  misc_feature: Useful for making plants with altered lignin content
MWGKGKKRFGGGGGGEPAAKRQAAGDEGPSESAEDGTVVAEISKNRKVSVRSWKGKVYVDMREFYVKDGKTLPSRKGISLQLDQWKILRDNIKAIDEAIKENA

SEQ ID NO: 29420 - DNA, 657 bp, Panicum virgatum
  misc_feature: Ceres CLONE 1891200
  misc_feature: Encodes the peptide sequence at SEQ ID NO. 29421
tggaatacgcaatggttcggctgatgcaaaaccctggcctcatggacaagctccaagccgaggtgagaagcactgtaggcaaagcacgcaaggataaagacgacgacgacatggtggttaccgaggatgagctcaacgacaacatcaacaatctagcctacctcaaggccgtcatcaaagagacgctccgactccacatgccggcgccactcctggtgccgcacctctccatggccgactgcgacatcgagggctacacgataccggcggggacgcgcgccatcgtcaacggctgggctcttgccagggacccaagctactgggagaaggcggaggagttcatgccggagcggttcatggaaggcggcagcgctgcggccatggagtacaaggggaacgacttcctctacctgccattcggggcagggcggaggatctgccctggcatcaactttgcgacctccaccatcctagtcatgcttgcaaaccttgtgtaccacttcaactgggagctgccacctgaatcggcggagaaaggcatcgacatgaccgagtcattcggggtcactgtgcaccggaaagagaagctcctccttgtccccgtactgcctccatcatatcattagtcctttattcatgagctgcatgcggatcgat

SEQ ID NO: 29421 - protein, 207 aa, Panicum virgatum
  misc_feature: Ceres CLONE 1891200
  misc_feature (1)..(199): Pfam Name: p450 Pfam Description: Cytochrome P450
  misc_feature: SWISSPROT Homolog: EC 1.14.13.21 Flavonoid 3'-monooxygenase
EYAMVRLMQNPGLMDKLQAEVRSTVGKARKDKDDDDMVVTEDELNDNINNLAYLKAVIKETLRLHMPAPLLVPHLSMADCDIEGYTIPAGTRAIVNGWALARDPSYWEKAEEFMPERFMEGGSAAAMEYKGNDFLYLPFGAGRRICPGINFATSTILVMLANLVYHFNWELPPESAEKGIDMTESFGVTVHRKEKLLLVPVLPPSYH

SEQ ID NO: 29422 - DNA, 291 bp, Panicum virgatum
  misc_feature: Ceres CLONE 1891202
  misc_feature: Encodes the peptide sequence at SEQ ID NO. 29423
tagcctacctcaaggacgtcatcaaacatacactccgactgcacatggccgcgccactcctggtgccggacctctccgtggcctactgctacatcgagggctacacgattccgtcgggcacgcgcgccatcgccgccggctgggctcttgccacggacccaagctactggtagaacgcggaggagctcatgccggagcggttcatggaatgtgacatcgctgcggtcctggagttccaggtgaacgacttccactagatgccattcccgggcagggcggaggatctgccct

SEQ ID NO: 29423 - protein, 56 aa, Panicum virgatum
  misc_feature: Ceres CLONE 1891202
  misc_feature: SWISSPROT Homolog: EC 1.14.13.11 Trans-cinnamate 4-monooxygenase
AYLKDVIKHTLRLHMAAPLLVPDLSVAYCYIEGYTIPSGTRAIAAGWALATDPSYW

SEQ ID NO: 29424 - DNA, 593 bp, Panicum virgatum
  misc_feature: Ceres CLONE 1891211
  misc_feature: Encodes the peptide sequence at SEQ ID NO. 29425
ttcactttgatgattgaaagcagtgcccgtggcgatgagtatgaaggggtcatgtattcacagctcaatttgatagatctagctggatctgagagctctaagacagagactacagggttacgaagaagggaaggcgcatatattaacaagagtcttttaactcttggaactgtcattggcaagctcagtgaagggagggcaacacatataccctatcgtgattctaagttgacccgtctgctacagtcatcattaagcggccatggtcatgtctcactaatttgtacaatcaccccagcatccagtaacatggaagaaacacataatacattgaaatttgcaagcagagcaaaacgcgttgaaatttacgcctctcgcaaccggataattgatgagaagtctttgatcaagaagtatcagagagaaatatcctctctaaagcaagaactcgatcagctaaggagaggaatgattggcggtgctagtcaggaagaaattatgagtttacgtcagcagttggaggagggtcaggtaaagatgcagtccccgtctggaggaggaagaggaagcgaaagctgctctaatgagcagga

SEQ ID NO: 29425 - protein, 197 aa, Panicum virgatum
  misc_feature: Ceres CLONE 1891211
  misc_feature (1)..(121): Pfam Name: Kinesin Pfam Description: Kinesin motor domain
FTLMIESSARGDEYEGVMYSQLNLIDLAGSESSKTETTGLRRREGAYINKSLLTLGTVIGKLSEGRATHIPYRDSKLTRLLQSSLSGHGHVSLICTITPASSNMEETHNTLKFASRAKRVEIYASRNRIIDEKSLIKKYQREISSLKQELDQLRRGMIGGASQEEIMSLRQQLEEGQVKMQSPSGGGRGSESCSNEQ

SEQ ID NO: 29426 - DNA, 609 bp, Panicum virgatum
  misc_feature: Ceres CLONE 1891212
  misc_feature: Encodes the peptide sequence at SEQ ID NO. 29427
catgaagcaaaaagtgtacggggatggtattcgactccagcagatcctctctgacttcctatttgtttcggtgaagttctctcctgttggaggttctgttgatatctcttccaaactgactaagaacagcattggggaaaacctccatctcatagacctggagcttaggatcaagcaccagggaacaggtgttccagcagaaatactatcacaaatgtatgaggaggacaataaggaacagtcagaagagggcttgagccttctagtttctagaaaccttctgaggctcatgaatggtgacattcgtcacatgagggaagctggcatgtcaaccttcatccttaccgcggaacttgcctctgctcctgccgccagtggacattgaagccaacactgcaactagtggtttcaaatgctcattttcagttcattcggaaaaccagatggttcgtggagaatgggaacgctgcagtctgtagggccacaacgcataaataagtttgacttgtatggttgtttgtcgggggaaaaaggtagtacgggcatagtaggctctgtacttctaccctgtttctacctgttatccaactttgtaatttttttcctttc

SEQ ID NO: 29427 - protein, 127 aa, Panicum virgatum
  misc_feature: Ceres CLONE 1891212
  misc_feature (7)..(119): Pfam Name: HATPase_c Pfam Description: Histidine kinase-, DNA gyrase B-, and HSP90-like ATPase
  misc_feature: SWISSPROT Homolog: EC 2.7.13.3 Histidine kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
MKQKVYGDGIRLQQILSDFLFVSVKFSPVGGSVDISSKLTKNSIGENLHLIDLELRIKHQGTGVPAEILSQMYEEDNKEQSEEGLSLLVSRNLLRLMNGDIRHMREAGMSTFILTAELASAPAASGH

SEQ ID NO: 29428 - DNA, 1330 bp, Panicum virgatum
  misc_feature: Ceres CLONE 1891222
  misc_feature: Encodes the peptide sequence at SEQ ID NO. 29429
gagcgagttccagcgagcgagttccagctcacgcccgcacccccggcccccgagaataggcgagcggctggtccaggaacccaggagcgagccccggcctgcgccgcgcgtccgtcggggtcctccctaaatccggccacgcccgccggggagggggtcagaccgtcagagaggcgaccgttgatcagccggtccgggatcatggaggatcgatcgcccccggacgaataactagttctactagctttcctcgggggtcgcctcgcctgccttccccccttcgctgcccccccccccccccccctcgtcgttgctgctcagttcgatctggtccgcggatcagagcaatttcgcccgccggctgctatccgtctccgtcgcccgtatcgccgcgccgccgccgcccgcggctggttgcaatccggcgtccctcccgtccccttcggtctctgctactcggcgatcttcctctccgcgtgctctgcttcagcttgcctccggcgagcgagggttgagtggagccggaccatggctgaggtagaagacgcggtgggcgcgccgccaacgacggagtccgagggcaccaccacagacgacgagcatctctcgccgacctgcgcctgcggcggcgggggccgacgcggaggccgcatcaagatcctctgcagcttcggcggccgcatcgtgccccgcccacacgacggcgtcctcaagtacgtcggcggggagacccgcgtcctcgccgtgccccgatccacccccttccgcgagatgaagaagaaggttgaggagatgttcaagacggaggtggccgcgatcaagtaccagctcctctccctcgccgaggacctcgacgtgctcgtctccgtcacctgcgacgaggacctggtccacatgctggaggagtacgaccgcctcgaggccaagcggtcgccgaccgcgtccccgcgcttccgcgtctacgtctccgcgccgcagcccgcggggccgctcctgtcggccgccgcgcctgcccgccacgccggcctgtcgcgcctccacccgcagcatcagcaccaccaccagcatcagcaccaccacttccagacggagcgctacgtggccaccgtgcccgtctcgccggacgggagcccgccgttcccggcccagccgcacggcgccgtctccgcggggaactcgccgcgcgccaacgccgtttacggcgcggagccgcccgccgtcttcggcctcggcatgcagcgcgtgcggagcacgccgaccctcggcgccctggatgcggccgcgcagcacctgcagcagcacgcggcggacggcggcggcgtgccgggct

SEQ ID NO: 29429 - protein, 267 aa, Panicum virgatum
  misc_feature: Ceres CLONE 1891222
  misc_feature (56)..(149): Pfam Name: PB1 Pfam Description: PB1 domain
MAEVEDAVGAPPTTESEGTTTDDEHLSPTCACGGGGRRGGRIKILCSFGGRIVPRPHDGVLKYVGGETRVLAVPRSTPFREMKKKVEEMFKTEVAAIKYQLLSLAEDLDVLVSVTCDEDLVHMLEEYDRLEAKRSPTASPRFRVYVSAPQPAGPLLSAAAPARHAGLSRLHPQHQHHHQHQHHHFQTERYVATVPVSPDGSPPFPAQPHGAVSAGNSPRANAVYGAEPPAVFGLGMQRVRSTPTLGALDAAAQHLQQHAADGGGVPG

SEQ ID NO: 29430 - DNA, 652 bp, Panicum virgatum
  misc_feature: Ceres CLONE 1891222-R
  misc_feature: Encodes the peptide sequence at SEQ ID NO. 29431
cggcgggatggcgtggtctctgtaccccgaggggtccgtgcggccgccggcgtggctgtttctccagtggaggtgcctggcggcggacgccggcgggcgggtggcggtgaggttctgcgacgggtccggctcggcctgcgagcgctgggtgttccgcagcgatggcaccgtgctcaacaccggcaccgggatggtcctggacgcgaggccgtcggccggcaagagcggccgctacgacgtcgtcgtgtcgccggccaccggcagcgccacccagcagtgggcactcatgctgtgagctctgatggctgatccgatccgtctgcaacagggctagacagtgtgtcgtgtacaataaagtcgtgtgttgcatggttgctgaataaagtctagctctacaagtacattgctacatgtcagcgatctcatagctcgtctcatgcaatgccatgtaagatttttgatgatgtggaagcgagagcgaggtgagagaatgaggtcgttgtttcacgagacaaccaccttataagctaaattttaggactatgagacaactagaccaccattgtatgagttttagttgtcatgcaacttacaacattcctttttatttacacaaattaaaaaattaaagagttgctatgagacaacctac

SEQ ID NO: 29431 - protein, 97 aa, Panicum virgatum
  misc_feature: Ceres CLONE 1891222-R
  misc_feature: SWISSPROT Homolog: EC 3.2.2.22 rRNA N-glycosylase
GGMAWSLYPEGSVRPPAWLFLQWRCLAADAGGRVAVRFCDGSGSACERWVFRSDGTVLNTGTGMVLDARPSAGKSGRYDVVVSPATGSATQQWALML

SEQ ID NO: 29432 - DNA, 695 bp, Panicum virgatum
  misc_feature: Ceres CLONE 1891231
  misc_feature: Encodes the peptide sequence at SEQ ID NO. 29433
aaccagcaggggttggatcatcgtggcctgagcctgaccccgtccatcctctcctctcttccccggccggcgagatcccatggcgggctccaccttcagcggcgatgagaccgcccccttcttcggcttcctcggcgccgccgccgcgctcatcttctcctgcatgggcgccgcctacgggacggccaagagcggtgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccctactacctcttcgacggctacgcgcacctctcctccggactcgcctgcggcctcgccggcctcgccgccgggatggccatcggcatcgtcggagacgccggcgtcaggtaccatttccatttccatttccttcccttgcggttcatggatcaaggatcgtgtggatcatggatgctgctgctaatttagggagctctcattgtagttgagatccattgtgcacgttttatctggtttgattacaacatacagcgtctttgtgactgattcgggcttgataaattgttaccaacctaagatctgtaatgtaggatcgagcatggtagctcaaagcctaattgatgaaaacgagtag

SEQ ID NO: 29433 - protein, 149 aa, Panicum virgatum
  misc_feature: Ceres CLONE 1891231
  misc_feature (15)..(80): Pfam Name: ATP-synt_C Pfam Description: ATP synthase subunit C
  misc_feature: SWISSPROT Homolog: EC 3.6.3.14 H(+)-transporting two-sector ATPase
MAGSTFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRYHFHFHFLPLRFMDQGSCGSWMLLLI

SEQ ID NO: 29434 - DNA, 2333 bp, Panicum virgatum
  misc_feature: Ceres CLONE 1891249
  misc_feature: Encodes the peptide sequence at SEQ ID NO. 29435
aatctcgtccgccctcccacctccgccagtcagctacctctacctcccgcatgggcatggcatcggcattggcatgcgccccccacctcagctaccaccccctccctgctgcttccacaaactaacaggagcatccctttcattccttgccatatagatagatgcctgctctgcatccatcctcagatcccctcgcctcctaataatagtagtcttcgatctgcttggattcctttagctggcgtagcttgttgcagacacgcaccaccaccaaagctagctctagccaacatggagaacagcaagagcactagtagtagcagcagcagcaggggaggagaggagtccaacaaggtgcccctgctccaaccgagagcggcagacgaccaccatggaggcagcagaagcttcatcagcaaggatgatgatgaacagcaggtggaagaagagtcgtcgtcgctggagcggcgcgcgtgggaggagaacaagaagctgtgggtggtggcggggccctccatcttcacccgcttctcctccttcggcctcaccgtcatcagccaggccttcgtcggccacatcggctccaccgagctcgctgcatacgccctcgtctcaaccgtcctcatgcgattcagcaacggcatcctgctgggcatggcgagcgcgctggagacgctgtgcggccagtcctacggcgccaagcagtaccacatgctcggcatctacctgcagcgctcctggatcatcctcttcgcctgctccgtcgtcctgctccccgtctacctcttcaccgagcccatgctcgtcgccctgggccaggaccccaagatctccgccgtcgccggcaccatctccctctggtacatccctgtcatgttctcctacgtctggtccttcacgctccagatgtacctccaggcgcagagcaagaacatgatcatcacctaccttgccatgctcaacctcgccctccatctcaccctctcctggctcatgaccgtcaagttccagctcggcctggcaggggtcatgggctccatgatcatcgccatgtggatccccgtgtttggccagcttgcctttgtcttcttcgggggttgccctctcacatggaccgggttctcgtctgctgcgttcactgacctcggtgccatcatcaagctctcgctatcttctggtgtcatgctctgtttggaattgtggtacaacaccatattggtgctcctcacagggtatatgaagaatgcagaggttgcacttgacgccctttcaatatgccttaatatcaatggttgggagatgatgatttctgtcggctttttggctgcaacaggagtgcgagtggcaaatgagcttggagctggaagtgcaagaagggccaagtttgcgatatacaatgtcgtcatcacgtctttcttgattggatttgtgttatttgtgctcttccttttcttccgtggaagccttgcctacatttttactgagagtcgagcagtggccgatgctgttgctgacctctcgcctctgctagccttctccatattgttaaacagtgttcaaccagtgctatcaggtgttgctgttggtgctggctggcaaagtgtagttgcctacgttaacattacatcatactacttgattggcatccctcttggaggagtcctaggctatgtagtgggacttcatgtaaagggcatttggattggcatgctgctcggaacactggtccaaactattgtgcttctgttcataacattaaagaccgactgggaaaaacaggtggcgaatgctcaagagagattgaagagatggtacatggaagagaacagaaggctgcagggctcaaggggaaatccttgaaccggaagtggacctttgtgggttctccaaaaaaatatttgaagggcatcgagacccaatggcacacaaacataccttctcagttctcacatctcaagaacgaaatgagggaactttagcctatccagaaaatgtgttcacctcctcaaaccaagaacgaaatccattgttagcagtagcgaacatcgagtagaaacgcactgcatcaattgccaacaggatggcatatgtacgtgagcctgcgttggctggccgtgagtttggcgagactgtttctctgcatcgattttggatttttgggggtatgctaatgtcggtcccatcaaagccctgtttggacctttggggcatttgtgctgattttgtgtgtaaatttgcgcatataactagttccagatgtgcacctattgggttcttgtcgatctatcatgttgaatatactacggagttcggcaaaataaaatagattaggc

SEQ ID NO: 29435 - protein, 522 aa, Panicum virgatum
  misc_feature: Ceres CLONE 1891249
  misc_feature (294)..(457): Pfam Name: MatE Pfam Description: MatE
  misc_feature (74)..(234): Pfam Name: MatE Pfam Description: MatE
MENSKSTSSSSSSRGGEESNKVPLLQPRAADDHHGGSRSFISKDDDEQQVEEESSSLERRAWEENKKLWVVAGPSIFTRFSSFGLTVISQAFVGHIGSTELAAYALVSTVLMRFSNGILLGMASALETLCGQSYGAKQYHMLGIYLQRSWIILFACSVVLLPVYLFTEPMLVALGQDPKISAVAGTISLWYIPVMFSYVWSFTLQMYLQAQSKNMIITYLAMLNLALHLTLSWLMTVKFQLGLAGVMGSMIIAMWIPVFGQLAFVFFGGCPLTWTGFSSAAFTDLGAIIKLSLSSGVMLCLELWYNTILVLLTGYMKNAEVALDALSICLNINGWEMMISVGFLAATGVRVANELGAGSARRAKFAIYNVVITSFLIGFVLFVLFLFFRGSLAYIFTESRAVADAVADLSPLLAFSILLNSVQPVLSGVAVGAGWQSVVAYVNITSYYLIGIPLGGVLGYVVGLHVKGIWIGMLLGTLVQTIVLLFITLKTDWEKQVANAQERLKRWYMEENRRLQGSRGNP

SEQ ID NO: 29436 - DNA, 636 bp, Panicum virgatum
  misc_feature: Ceres CLONE 1891267-R
  misc_feature: Encodes the peptide sequence at SEQ ID NO. 29437
ccaacatcctcctcagccggtcggtggacgcgcgcgtggccgaccacggcatggcgcacctcgtcggccccgcgggcgcgccggcgacccgcgtcgcggggtaccgcgcgcccgaggtcgtggcggacccgcgccgggtgtcgcagaaggccgacgtgtacagcttcggcgtgctgctgctggagctgctgaccgggaaggcgccgacgcacgccgtgctgcacgacgagggcgtggacctcccgcggtgggcgcgctccgtggtcaaggaggagtggacggccgaggtgttcgacacggagctgctccggcacccgggcgccgaggaggagatggtggagatgctgcggctggccatggactgcaccgtgcccgccccggaccagcggccggcgatgcccgagatcgtggcgcgcatccaggagatcggcgccgcggggtcggcgtcgacggcgcggactggccggagcgcgtccatggacgaggccgacgaccggccgctgagacccaccggatcgatccgtcagagctgaggtccgtccgcccggtcactcgtgttcttttcaggctgcagcgtagcgatgatttggtgactcatggaaggttctgaaggaaaaaaaagagatctttttgttc

SEQ ID NO: 29437 - protein, 176 aa, Panicum virgatum
  misc_feature: Ceres CLONE 1891267-R
  misc_feature: SWISSPROT Homolog: EC 2.7.11.1 Non-specific serine/threonine protein kinase
NILLSRSVDARVADHGMAHLVGPAGAPATRVAGYRAPEVVADPRRVSQKADVYSFGVLLLELLTGKAPTHAVLHDEGVDLPRWARSVVKEEWTAEVFDTELLRHPGAEEEMVEMLRLAMDCTVPAPDQRPAMPEIVARIQEIGAAGSASTARTGRSASMDEADDRPLRPTGSIRQS

SEQ ID NO: 29438 - DNA, 371 bp, Panicum virgatum
  misc_feature: Ceres CLONE 1891267
ctcttgcttgctctcccccctcccctccacaccgcgcaatgccttggcgtcggcagagcgcgcgtccatccaggccgtagcgtgcgtgtcctacccgtccgtcccctgggcgcggcccagaatgggcgcgcccgtgcagctgctgctggtgctggccgccgtcgcctgcgcggccgcggagccgccgcagcaggagcggtcggcgctgctggcgttcctcgcgggcacgccccacgaccgcgcgctggactggaacgggcccgtgctctcctgcggctggacggacgtcgagagcgacgatgcaaagccgctcctcgtgtagctcaaccgcgggggcatctgcttcttcatcggcggggcggcgggggagc

SEQ ID NO: 29439 - DNA, 1375 bp, Panicum virgatum
  misc_feature: Ceres CLONE 1891283
  misc_feature: Encodes the peptide sequence at SEQ ID NO. 29440
gaggctcacatggtcgtcggctcggatccacaccgaagctccgccaggacatgcaaaatgccgccttggcagccggggccgaggcggcgcggccgagggccatggtggcagcggccaccgcggccagcgaccactacgcgcggctcctgcagctctgccagaccgcggtgaagccttccgcaggccgggccatccacgcgcacgccatcaaggcgggcctcctcgtcagcgcctacctctgcaacaacctcctctcgtactacgccggcgccagcgtgagtggtgggtccttccgcgacgcgcggaacctgttcgacgagatcccgcccgtgcggcagaacgtgttcacctggaacacgcttctgtcgatgtatgccaagtccggccgcctcgctgacgcccgggccgtgtttgacgaaatgcctgagcgggacgccgtgtcctggaccgtcatgatcgtcgggctcaaccgcacgggccgcttccgggaggccgtgaagacgtttgtggacatggttggtgaggggctggcaccgacgcagttcacgctcaccaatgtgctctcagcgtgtgccgcaacggaggcctgcgggattgggaggaaggtccactcctttgtcgtcaagctcggtctgagtagctgcgtgcccgtggccaactcggtgctcaacatgtacggcaagtttggggatgctgagacagcaacggctgtgtttgagaggatgccagtgcgtagtggatcaagctggaatgccatggtgtcattgtacgcccgccagggtaggatggaccttgctgtgtccttgtttgataacatggtagaacgaagcattgtctcttggaacgctgtcatagcagggtacaaccagaatgggctcgatgacatggcattgaagttcttctcacgaatgctgagtgattctttcatggagccagatgcattcacagtaaccagtgtcttatcagcttgtgctaaccttcgcatgttgaagacgggaaaacaaatgcactcttatatcttgagaaaaagaatgccacacagcagtcagatcataaatgctctcatctcaacttatgcaaagtccggaagtgttgagactgcaaggaaaatcatggatcaggcagtgatttccgatctgaatgttatttccttcactgctctcctggaaggctatgtcaagctcagggatatgaagcaggcaagggaaatcttcgaagttatgaacaatcgggatgtcattgcctggaccgcaatgattgttggctaccagcagaatgggcaaaatgatgaggccgtgaagctcttcagatcaatgatcaaaagtgggccagaaacaaacagctatacgcttgctgctattcttagtgcctgtgc

SEQ ID NO: 29440 - protein, 441 aa, Panicum virgatum
  misc_feature: Ceres CLONE 1891283
  misc_feature (397)..(431): Pfam Name: PPR Pfam Description: PPR repeat
  misc_feature (130)..(164): Pfam Name: PPR Pfam Description: PPR repeat
  misc_feature (262)..(296): Pfam Name: PPR Pfam Description: PPR repeat
MQNAALAAGAEAARPRAMVAAATAASDHYARLLQLCQTAVKPSAGRAIHAHAIKAGLLVSAYLCNNLLSYYAGASVSGGSFRDARNLFDEIPPVRQNVFTWNTLLSMYAKSGRLADARAVFDEMPERDAVSWTVMIVGLNRTGRFREAVKTFVDMVGEGLAPTQFTLTNVLSACAATEACGIGRKVHSFVVKLGLSSCVPVANSVLNMYGKFGDAETATAVFERMPVRSGSSWNAMVSLYARQGRMDLAVSLFDNMVERSIVSWNAVIAGYNQNGLDDMALKFFSRMLSDSFMEPDAFTVTSVLSACANLRMLKTGKQMHSYILRKRMPHSSQIINALISTYAKSGSVETARKIMDQAVISDLNVISFTALLEGYVKLRDMKQAREIFEVMNNRDVIAWTAMIVGYQQNGQNDEAVKLFRSMIKSGPETNSYTLAAILSAC

SEQ ID NO: 29441 - DNA, 699 bp, Panicum virgatum
  misc_feature: Ceres CLONE 1891283-R
cccgcggagaagctgtttgtaattgatcctgataacagtggtgcttactcttctcttgccaatgtctattctgcctgtgggaggtggaatgatgcggcaaggatctggaagctgatgaaggacaaggcagtgaagaaggagactggtttcagctggactcatgttcacaacaaggttcacgtctttggagcagatgatgtactgcatccacaaagggatgcaatctacaagaaggctgctgaaatgtgggaggagatcaagaaggcaggatttgtctccaacctgaactccgttctgcacgatgtcgatgatgagctgaaggaggaattgctgagccgccacagcgagaagctagccattgcattcggtctcatcaacaccccggagaagacgaccctgcggatcatgaagaacctacgagtgtgcaatgactgccacgcagcaatcaagttcatctccaaggttgcggacagggagattatagtgagagatgctactaggtttcatcatttcagagatggattctgctcatgtaaagattattggtaggaaaccttcgtcgcaagttgaatgagaaagaagtgttcctttttctctttggttcttatatgctatagggtgtgtgcaagaaactctgcagtcaatgatcgatatttgtaacttgtaagctatttagtttagatgactaatttagtttgt

SEQ ID NO: 29442 - DNA, 747 bp, Panicum virgatum
  misc_feature: Ceres CLONE 1891294-R
  misc_feature: Encodes the peptide sequence at SEQ ID NO. 29443
cggcgtccgcctccgcggcgacgcggcgcggctcaacttccccgacaacgcggcgtcgagggcgccgctggaccccgccgtggacgccaagctgcaggccatctgcgccaccatcgccgccgcgtcggcgtcgggcaagggcggcagggccaagagcagggccacgcccatcaacgcgcccgtcgcggaggcggaggcggggtcccagagcaacagctcctccgacgaggcctcggggtccgggtcggacgacgagatgtcgtccgccccggcggcagcggcggcgccggcggcgcagcagccgctggcggagatggggcagctcaagttcggcgaggagccgtgggacgaggccgagagcttcgtgctccgcaagtacccgtcctacgagatcgactgggacgccctgctcgccaactagctagcagcttccgtgattgttcatccagtgattgtaatttagtagcttggtcatccgccatggccgcggccggtgcagatgaggttttaagcaatctgcacggcgcggcccgcccctgtgtagcagcaagtacaagtaggcttctgttgttcttgttctgttggtccccggacctcgccgccggcgtttttgtgaccggcgtcctgctccggatgtttgctgtaaaatgttagtgggtgcacagcattggtgtactggtctgtctgtaaaaaaaaatggatctttagtagggtgtgtaatcaactgctgtccttggttgtaatgct

SEQ ID NO: 29443 - protein, 139 aa, Panicum virgatum
  misc_feature: Ceres CLONE 1891294-R
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
GVRLRGDAARLNFPDNAASRAPLDPAVDAKLQAICATIAAASASGKGGRAKSRATPINAPVAEAEAGSQSNSSSDEASGSGSDDEMSSAPAAAAAPAAQQPLAEMGQLKFGEEPWDEAESFVLRKYPSYEIDWDALLAN

SEQ ID NO: 29444 - DNA, 687 bp, Panicum virgatum
  misc_feature: Ceres CLONE 1891294
gccacatgattcttcttctccccaatgaaaacacaaaattttccccgcagacgcgcggcggccgaaacactccgcgtctccggctctccgccgatccgaaatttcaaaaccaaaacaggagacgccgtcgcctcccaatctcccatagtcccatttcgacttcccaccgaaccgaaatgttcctcagattcctccgcgctctggccctccaacagttcgcgaaaatttttcgagctcgcgagatctttaaacccgtcttccctctgggccgaattcccgcgccagaaaagtcttctcctcaccccaaatctctaatcttgacctcatccgtctcgccgccggccgtccatggagatcgccgagaacggctttccgagcggcagcgcccgtgacctgccgccctcgaagcgattcaagtacgtcggcgcccagcacgggtcggctccgtgcgtgctactgccggccaagaagcgcgtgttcccgccgccgcctccgccgccgccggaggaggaggccgccgcctccgtttgcctcccggtaaagaagaggaccgttgtggcgcggccaccggaggagccggcggcggctgtcccgttctgcctcccggcgaagaagagagccattgtggcgccgccgccggaggacgccggccccggtgtgcctccccgccaagaagcgcgctacgcc

SEQ ID NO: 29445 - DNA, 1820 bp, Panicum virgatum
  misc_feature: Ceres CLONE 1891321
  misc_feature: Encodes the peptide sequence at SEQ ID NO. 29446
accagtgcagtgaagcctgctcccccagacccccactccccgtttggccgcggagcccggcggcgactcggattccatcggatccttcctcggctggcgtccagcgcgcgacgaccggccggccaatggcagctgcgcggcggccggcggcgggggcgaaggcgaggggcggcggcggaggcgcggggaggaggagcgcgtggctggccgcggacgggagcaaacgctggggggaggccttcttcctgctctacacgcccttctggctcacgctctgcctcggcgtcatcgtccccttcaagctctacgaggtactcctcccggttgacctgacgccgcattcttggtttggttatcggttcatggttcaccctcggtcgggtcctcaatccgatctgtcggatctcggatgtggctagtggagtgggtgagcggatcaattattaaattactccctccttccctgtttataaggcatacacgtatatcaagattcaaaccttgtcatctttgaccaataatttgactattaaatttttatttttataatgcaaatttcatatgattggattcataatcaaatatattttacaatgattataagtttataatcaaaagtgatataatatatgataaataaatggtcaaagtgttgtttagaagaccgtgtcatgttccaccatgccttataaacggggaaggagggagtatctaaggccttcttgtgccatgtgcagaggttcacggagctggagtacctgattctcggattggtgtccaccgtgccggcgttcctcatccccctcttcctcgtagggaaggcagatagtgtgagaagtttgaaagatcgatactgggtcaaggctaatatctagattataatttttagctatgttggtaactacttctggacacattacttcttcacgattcttggtgcttcgtatacttttccctcatggcggatgaataatgtgccccacacgacgtttctcctgactcatgcttgtttcctgttctatcatatggcatcaaatatgacacttcgcagattacatcactctacagctcacttaccacagtctattcgatggttatttgatgccacatggattttggcactttcatacttcatcgcatacttggagaccctagccattgcaaatttcccgtattatgaatttgttgatcgggatataatgtacaaagtaggttcattgttctacgcaatatatttcattgtcagcttcccaatgttttcaaggatcgacgagaaagatgagaagtggaacctgtccagggtagctgttgactctttgggcgcagccatgctcgttacgataatactggacctctggcgcatatttctggggccaatagtacccatccccgagtccaggcggtacggtcagccggggctcgcgtggttccatgcgcagaactaaagcatctgacccggcgaagctgcaatgatcctgtgtttccgcgagcattattggagactgataaaatcctcttctcccgtcggctgaggctgaaccagaggcatgatgtgaagtgcagagcggctttgtcatcgtgaatatttgcgtgttgtcgtcttgtaatgttatgtatcaggtccatgccatattggtactggtactctgctgaattctgcttggtctttgctaggatgcgtcagccacaggtgaagctagtagtgaataaagcttcgcacagagcagtaatttgcatgtctgtggtctatctgtacgatgtagcttcgccttcccgtggtccgcaacattgttgtagaaaggagagtgattttttttttt

SEQ ID NO: 29446 - protein, 159 aa, Panicum virgatum
  misc_feature: Ceres CLONE 1891321
  misc_feature: SWISSPROT Homolog: EC 5.5.1.9 Cycloeucalenol cycloisomerase
  misc_feature: Functional homolog of the protein sequence given in SEQ ID NO 51088
  misc_feature: Useful for making plants with altered sterol content
MNNVPHTTFLLTHACFLFYHMASNMTLRRLHHSTAHLPQSIRWLFDATWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRRYGQPGLAWFHAQN

SEQ ID NO: 29447 - DNA, 614 bp, Panicum virgatum
  misc_feature: Ceres CLONE 1891361
  misc_feature: Encodes the peptide sequence at SEQ ID NO. 29448
accacagccgcggacccacggttcacgcctcctgcctcccctccctctcctctctccccaacctcgccgcgatccggttgtggatgcagcagcgcggccgctccttcaaccgccggtcccggagcttctcccgcgcccgcctcgccatcgagggatcttaatctcgagggcctcctccccctgaccggtcccctcggttcctgaatttccgcccgaccaacgaacgaacgaacgcgcgcacgcatcgacctgcccgtacgtgatggacgccgccgctgttgtttctcttaacgggaagatggaggtggaggagaggcatgcacagaagagctactgggaagagcactccaaggacctcaccgtcgaggccatgatgctcgactcccgcgccgccgatctcgacaaggaggagcgccccgagatcctgtctttacttcctccatatgaaggaaaatcagtgctggagcttggtgctggaataggtcgttttaccggagaacttgctaaaacagctgggaatgttcttgctctggattttatcgaaagtgcgattaagaagaatcaaagcatcaatggtcactacaagaacacatcctttatgtgtgctgatgtga

SEQ ID NO: 29448 - protein, 117 aa, Panicum virgatum
  misc_feature: Ceres CLONE 1891361
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MDAAAVVSLNGKMEVEERHAQKSYWEEHSKDLTVEAMMLDSRAADLDKEERPEILSLLPPYEGKSVLELGAGIGRFTGELAKTAGNVLALDFIESAIKKNQSINGHYKNTSFMCADV

SEQ ID NO: 29449 - DNA, 2300 bp, Panicum virgatum
  misc_feature: Ceres CLONE 1891364
  misc_feature: Encodes the peptide sequence at SEQ ID NO. 29450
aaacagcaaccagatatggccgctaacctcctgcacccttatcctccggggctgcctccctctcgcgccgattccaatcccgcctcccaccaacccactcgcctcagatggggcctcggccgccggcgccggcgacgccacatcctccggtgcgtcaccgccgccgcctctacggccaccttgcagcgagaactcctcgtgctgcccagtccaagaacggagcagagccctgtcccggcgaacccgcgtaacctgttcgacagaatgtcggataggagcgtcgcgacggttccgggcgcggctaacctgcttgacgaaaggaccaggaggaagggcaagggcgcagaagagcggaatcgcagcggagcgcccaagggcggcgagaagagcagaagcggggcggtcgtggctctgactcatgccggcaggcacgaggaggtcgtcgagcacttccgcaggatgcggagggagggggttcccgtgagcaggttcgtgctcccgagcgtgttcagagcttgcgccagcttatgggacagcaggatgctccgagccgtgcacggcctggtcatcaagtgctcgttgtgccagcatgtcgtcgtgggtacggcattggtcgacgcgtacattgattttggactcctggatgacgcgaagaaggtgttcgatgagataagggagcccaatgtggtctcttggagtgtgatcattggtggatattcccgttcttctcagtggtacgaagcctgggttgcattctcggccatgcagcattctggcgtccttcccaatgtttctgctcttgtaatggcaattcaggcatccggtgcattgcgctgtctggtccgcggaaagcagatgcacgctatggcagttgtccttgggtttggaatgaatgccaccgtatggaactgcctcattgacatgtatggaaagtgtggcagcatggagagttgcaggatggtatttgacacaatgatcagcagggatcaagtgagttggaatacaatcatctcaagctatgttcatcttggactttgtgaagaggcgctagacatgattgttaaaatgcaagagtctggtttcactattgatcgtttcacccttggcagcggagttgcagcatgtgcccacttgggtgacacatatagtggccgttcattccatggttatttgattagaagagcattggatactgatgtcatccgtggcactgcacttgttgacatgtatggtaaaagcagcaatatggaacatgctcgcttggtatttgacaggatggatgagaggaattatgtatcatgggatgcgctcttgtctggatatgtcgaaaatgggctggttgattcagcacttgatactttcagaaaaatggagtccgcaaatataaagcctaaccaacatacttttgcgaaccttctgaggctctgtggtgatagaaggtataaagaatatggaaggcaaatccatggccatgccattaaggtcataaaacagatgaatgttgtactggaaactgaacttatcgacatgtatgcaaaatgtggttacattgaagtctcccagttactgtttctcaggatgaatgaggggaacttgatatcatggaacacattgctttcaggttatgtgggtgataggcaatcagtggcaacaataaacatttaccgtcaaatggagcttgcctgtgttaggcctgaccattacactttggcggggcttttaaacctgtgccggttccaagggcttctgcactatggaaggcaaatacatgctcgtctaatcaagacaggctctgaaatgaatgttgtattgcaaactttgcttgttcatatgtatttcaagtgcagacgatggcgggatgctcacaatgtttgcactttgatcagagagaggaattcccgtgtgcatgaagcatttttcaaggtctatggagacgactacttgatctaagaacaatagaatcgctcagtttgcatcaaagttacaataagcgagaatgctgttgtcactgtggatacacatcttagatgcagatattgttgactaaacaggattggtagtagtgttctttctcactaacttcagtgacttgtatgttgtattgtaattgttctaacttctaacttcagaaaagagaagtacattttccatgaatattgcttgtaaagttctgtgatcatactggtttgctgacattctgtaagcacctgtatctatatccttttagacgtgagcatctgtgttccttttaggtgagtagatcattgcttaatagtacttcaactttaaaattttatctc

SEQ ID NO: 29450 - protein, 644 aa, Panicum virgatum
  misc_feature: Ceres CLONE 1891364
  misc_feature (326)..(360): Pfam Name: PPR Pfam Description: PPR repeat
  misc_feature (427)..(461): Pfam Name: PPR Pfam Description: PPR repeat
  misc_feature (225)..(259): Pfam Name: PPR Pfam Description: PPR repeat
MAANLLHPYPPGLPPSRADSNPASHQPTRLRWGLGRRRRRRHILRCVTAAASTATLQRELLVLPSPRTEQSPVPANPRNLFDRMSDRSVATVPGAANLLDERTRRKGKGAEERNRSGAPKGGEKSRSGAVVALTHAGRHEEVVEHFRRMRREGVPVSRFVLPSVFRACASLWDSRMLRAVHGLVIKCSLCQHVVVGTALVDAYIDFGLLDDAKKVFDEIREPNVVSWSVIIGGYSRSSQWYEAWVAFSAMQHSGVLPNVSALVMAIQASGALRCLVRGKQMHAMAVVLGFGMNATVWNCLIDMYGKCGSMESCRMVFDTMISRDQVSWNTIISSYVHLGLCEEALDMIVKMQESGFTIDRFTLGSGVAACAHLGDTYSGRSFHGYLIRRALDTDVIRGTALVDMYGKSSNMEHARLVFDRMDERNYVSWDALLSGYVENGLVDSALDTFRKMESANIKPNQHTFANLLRLCGDRRYKEYGRQIHGHAIKVIKQMNVVLETELIDMYAKCGYIEVSQLLFLRMNEGNLISWNTLLSGYVGDRQSVATINIYRQMELACVRPDHYTLAGLLNLCRFQGLLHYGRQIHARLIKTGSEMNVVLQTLLVHMYFKCRRWRDAHNVCTLIRERNSRVHEAFFKVYGDDYLI

SEQ ID NO: 29451 - DNA, 1426 bp, Panicum virgatum
  misc_feature: Ceres CLONE 1891368
  misc_feature: Encodes the peptide sequence at SEQ ID NO. 29452
ttcgccgctggcctcgcttcgcttcctccttccccttgccctcgccgattgcaccccgcgattggccgcgcccgccgccgcagtataaatccgcccgagcgagccctccgcgccgtccccaccccgctccgaccacaaccctagcggcgcgcgccggcatgggctagggttcccccgcggccgcgatggagtgggacagcgactccgacggcggcggcggcggcggcggtgacgacgaggaggaagaggaggaggaggaggtccaggccgggcccgggcccccggggttctcgctggccatcgagggcgtgctgggcgcgtgcgggatcgtggtctccgacgcgctcgagcccgacttccccatcatctacgtcaaccgcgggttcgaggacgccaccgggtaccgcgccgaggaggtgctcgggaggaactgccggtttttgcaatgcagaggaccatttgctcagaggagacatccccttgttgatgctgcagtagttactgggattcggagatgtttagaggatgggaccgaattccagggtgatctgttgaattttagaaaagatggttctccatacatggcaaagctgcgactaacaccaatatatggagacgatgacacaataacacactatatgggcattcagtttttcaatgattccaatgttgatttggggccatcgcctggctctgtaacaaaggaacttgcgagatctacatggattgcaccagataacacacccccaccatcttcggtgggcaaggctaacttatgggaatattctagtatcttcctgctgagtgatgaggtactgtgccaaaagatcttctcaaaactgtcgcccagggatatagcctctgtaaactctgtttgtaagagactgtatcacttgacaaaaaatgaagacctttggaggatggtttgtcagaatgcatggggcagtgaagctactcggacccttgagagtgtggcaggatcaagaagtttagcatggggacggctagctcgagagttgaccaccctggaagctgttgcctggaggaaattgacaatcggtggtgcggtggagccatctcgctgcaacttcagtgcctgtgctgtagggaaccgtgttgtcctttttggtggagaaggtgttaacatgcagccgatgaatgatacatttgtgctggatttgagtgccagcaagccagaatggaggcatgtcaatgtgagctcggctcctcctggtcgctggggccataccttatcatgcctaaatggatcacggctggttctgttcggtggctgtggggggcaggggctactgaatgatgtcttcattttggatctggatgcacaacatccaacttggcgcgagattcctggccttgcaccgccagtgccacggtcctggcatagctcttgcacagtggatggtac

SEQ ID NO: 29452 - protein, 413 aa, Panicum virgatum
  misc_feature: Ceres CLONE 1891368
  misc_feature (351)..(398): Pfam Name: Kelch_2 Pfam Description: Kelch motif
  misc_feature (201)..(249): Pfam Name: F-box Pfam Description: F-box domain
  misc_feature (49)..(177): SWISSPROT Homolog: EC 2.7.11.1 Non-specific serine/threonine protein kinase
  misc_feature (253)..(413): SWISSPROT Homolog: EC 3.1.3.16 Phosphoprotein phosphatase
MEWDSDSDGGGGGGGDDEEEEEEEEVQAGPGPPGFSLAIEGVLGACGIVVSDALEPDFPIIYVNRGFEDATGYRAEEVLGRNCRFLQCRGPFAQRRHPLVDAAVVTGIRRCLEDGTEFQGDLLNFRKDGSPYMAKLRLTPIYGDDDTITHYMGIQFFNDSNVDLGPSPGSVTKELARSTWIAPDNTPPPSSVGKANLWEYSSIFLLSDEVLCQKIFSKLSPRDIASVNSVCKRLYHLTKNEDLWRMVCQNAWGSEATRTLESVAGSRSLAWGRLARELTTLEAVAWRKLTIGGAVEPSRCNFSACAVGNRVVLFGGEGVNMQPMNDTFVLDLSASKPEWRHVNVSSAPPGRWGHTLSCLNGSRLVLFGGCGGQGLLNDVFILDLDAQHPTWREIPGLAPPVPRSWHSSCTVDG

SEQ ID NO: 29453 - DNA, 719 bp, Panicum virgatum
  misc_feature: Ceres CLONE 1891368-R
  misc_feature: Encodes the peptide sequence at SEQ ID NO. 29454
tggtcttgccaaaagtggccctctacggctcaggtccagcgatgtattcactctagatttaagtgaagacaagccatgctggcggtgcatcactggctgcgggatgccaggagctggtaatcctgctggagttggcccacctcctcgccttgatcacgttgcagtgagccttcctggaggtagagttttgatatttggtgggtctgtggcgggtcttcactcagcctcacagctttacctcctggatccagctgaagagaaaccgacctggaggattctgaatgttccagggcggcctccacggtttgcttggggccacagcacctgcgtcgtgggaggaacaaaggctatagttcttggaggacaaaccggagaagagtggacactcactgaaatgcatgagctttctctgctaagctcattagtttgaagatgaaaagcttccttgaagagacatctctggtgaacagctacttgttcgtgtgagtgtgactcaggctgaaacaattttttccaacagtggggctaggggtggcgaagtgattttactgtcatatcagggtaattgtggagtagcccctgaagtggatcgaatcttactactcgatctatgtctgggagtcgcctcatctagaagtaggaataagttacctctgctgttgctgttgttgtttgtatggtctacgctgcaataacatacataagctaatctcagttct

SEQ ID NO: 29454 - protein, 142 aa, Panicum virgatum
  misc_feature: Ceres CLONE 1891368-R
  misc_feature (49)..(97): Pfam Name: Kelch_2 Pfam Description: Kelch motif
  misc_feature: SWISSPROT Homolog: EC 3.1.3.16 Phosphoprotein phosphatase
GLAKSGPLRLRSSDVFTLDLSEDKPCWRCITGCGMPGAGNPAGVGPPPRLDHVAVSLPGGRVLIFGGSVAGLHSASQLYLLDPAEEKPTWRILNVPGRPPRFAWGHSTCVVGGTKAIVLGGQTGEEWTLTEMHELSLLSSLV

SEQ ID NO: 29455 - DNA, 1492 bp, Panicum virgatum
  misc_feature: Ceres CLONE 1891390
  misc_feature: Encodes the peptide sequence at SEQ ID NO. 29456
ggggttaacctgcctgagcatatccctcccccatctgaaaacaaacccagagcccttctttcgtattcctccgcctgcgcctcgctccgccgccaacctcctcctcgctggcgtcgcctccgacgccggcgaggaccgccctcccccccccccccccaccacccccctccctctccccttcctcttccccctcccttttggatgagctcccccgcctccgccccgccgaaatcctaacttccccttccaccttccccaactctccgtctcaactttccccttcggcgactgcgcggatggcccttccgcatgttcaagctcaagttttgcgtcgatatctccagagcgaggagtcgatgggcatctgccctggtgtgtccgaaagattgacaccgacaggaaccgagtgcaccataaatggccgccggtggacctttggggtcacctctcgcggcggcgccatgatcctggcgctgaggggtttgggccttgccccccacgaatttggcgtcatgcacgtcaggctcgtcgatcgccgcaagagcccgcctgtggcacacagccccatgcgctgcattgttcatcatgggcaggcttcccttttgcagctgcctacggttgcggaaatggtggagaacggttccattatcaatggctccctagcaatcacactcagcgcttatgccctcccctcccctcccaagaagcagtcacttctcagtaaagatttcggccatatcctggagagcggagatggaagcgacgtgagcttccgtgttggagatgaagatttccccgcacacagactcgtcatccaagctcgctcgccagcattggcagcggagatccctgctgctccaggggcatccatcgcaatcggaggagatattgatccaaaggcctttggtgccttcctcaagttcttgtacaccgaggacctgccgggggcagaggagatactgggagaagagtacagcaaggaaagtggctgccaaatgagagaatcactgtttcatgtggctgagaggtttaaccatgaggaaatgaaggggattctggaggagcagatgcttgcaaaactagatgcatctacagctgcacggactttgtcatttgcagaacagcatggtcgccaacaactgcaagagacttgctgccgaatggtggtatcaaaagggtggttgcaagaagttattcagtctgatgggtggtttgggcatctcatgccaagcagcaattacccgacggtcgccaaagatgcattactattggaagcaagccgagcacttaagaaacccagaggaccagttcctaatgcaggtgcataggatgttgaaatccttgcttttctgtcactactgtgtactagttggtaatgatcattcgcttaattggtagttggataattgcactgtccctaaatgttcactagtgatatgcacgaattatctgtggtacactggtactgatgtctatgcaatttatccggatc

SEQ ID NO: 29456 - protein, 323 aa, Panicum virgatum
  misc_feature: Ceres CLONE 1891390
  misc_feature (125)..(242): Pfam Name: BTB Pfam Description: BTB/POZ domain
MGICPGVSERLTPTGTECTINGRRWTFGVTSRGGAMILALRGLGLAPHEFGVMHVRLVDRRKSPPVAHSPMRCIVHHGQASLLQLPTVAEMVENGSIINGSLAITLSAYALPSPPKKQSLLSKDFGHILESGDGSDVSFRVGDEDFPAHRLVIQARSPALAAEIPAAPGASIAIGGDIDPKAFGAFLKFLYTEDLPGAEEILGEEYSKESGCQMRESLFHVAERFNHEEMKGILEEQMLAKLDASTAARTLSFAEQHGRQQLQETCCRMVVSKGWLQEVIQSDGWFGHLMPSSNYPTVAKDALLLEASRALKKPRGPVPNAGA

SEQ ID NO: 29457 - DNA, 643 bp, Panicum virgatum
  misc_feature: Ceres CLONE 1891391-R
  misc_feature: Encodes the peptide sequence at SEQ ID NO. 29458
gattgtgaggctgcgccacaatgtcattcgaactggacttcgcaacatcagcatttcatactcaaggatctcccttgctgatattgccaagaagctcagactagactccgagaatcctgttgctgatgccgagagcattgtagccaaggccataagagatggtgcaattgacgccaccatagatcatgcgaatggctggatggtgtcaaaggaaactggtgatgtctactcgacgaatgagccgcagatcgcattcaactcaaggattgctttctgcctgaacatgcacaatgaggcggtcaaggcgatgaggttcccccctaattctcacaaggaaaaggagagcgcggagaagcgtcgtgagaggcttcagcaggaggaagaattggcaaaacacatggccgaggaggatgatgacgatttctaagttagctgcctttgagcagacaatgtgtggctgctcgattagggatggccaaggttgaaagcatttcctccgactccagtcatgcagacattaaagtttgaatccatctgctgtaacttttatggtgaccagattttgtattaactccatgaatgcctctgctaggccatttacgtttcgccctcccagaactgttggaatggagaatttgcctac

SEQ ID NO: 29458 - protein, 141 aa, Panicum virgatum
  misc_feature: Ceres CLONE 1891391-R
  misc_feature (74)..(140): Pfam Name: Rpn3_C Pfam Description: Proteasome regulatory subunit C-terminal
  misc_feature (2)..(71): Pfam Name: PCI Pfam Description: PCI domain
IVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 29459 - DNA, 678 bp, Panicum virgatum
  misc_feature: Ceres CLONE 1891391
  misc_feature (570)..(570): n is a, c, t, g, unknown, or other
ggaatccgtaacccgaacgcggaagcggaaactcacgtcaagtgctcttcgccgtcgcttcttccgccggcgatggggggcgggccgcgcaccttcccgggcgggctgtccaagtggcagtacaagcggatgcacgagaagctggcgcggcagaagcagcgcggcctcctccgccatgagaagcagctctacctccgttccgagattcgcgccctcgccgatcgattcagcaagcccggcgccgaggacctctggaacgaggacgacgggcccctccaccgcaccaagcggccgccgggtggccagcagcagctggagtctgggaggccccggggtgaagcgaattggaaggattgggatgatctgtctctggagcagccgaggactctggccaggggaaaggggccgagcttggctgccttcaatcccgagagggagtaccgagcaatggcgccctggtggccgccttctctcggtttcattgcttccaagaggtggtattcggtgatgtctcacccaagcacggtgacttggcagttggggccattgggtgctcgcggccttgataangcaagagaggagacggcattaccactgcttaatcaggagagattgtactcggtggctgcgagacgttttggtagaaatggagaccggattcatcggatgaggatgagg

SEQ ID NO: 29460 - DNA, 1856 bp, Panicum virgatum
  misc_feature: Ceres CLONE 1891405
  misc_feature: Encodes the peptide sequence at SEQ ID NO. 29461
tctctctctctctctctctctcctcttccctccctaccttgtcgcctaggggttcacgccgtcgtcagcggctgcggcggcgaagccggaagctacagccctccccggcgtcggctcgtcgtcggccaggaagatggctggcggctttagagtactacatctggtcaggccctttctggctttcttgccagaggtgcagagtgctgataggaaaataccattcagagaaaaagtgatctacactgttatttctctcttcattttcctggtgtgcagccagctcccactctatggcattcattcgactactggagctgatcctttctactggatgcgtgttatccttgcatcaaaccgtggtactgtcatggagttgggtattactccaattgtgacatctggaatggtaatgcaacttcttgtgggatcaaagatcattgaagttgacaacagtgtgagggaggatcgtgctctgctgaatggtgcacaaaagttgcttggtatcctgatcactattggggaagctgtggcatatgttctatctggaatgtatggcagtgtaagccaacttggaacagggaatgctattctcattatacttcagcttttctttgctggcatcattgtcatctgtctggacgaacttctccagaaaggttatggtctgggatctggcatttcgttgttcattgctaccaatatctgtgagaatatcatctggaaggcgtttagccccacaaccatcaacagtggccgtggcgctgaatttgaaggggctgtcattgcattgttccatctgttgattacaagaactgataaagtccgtgctcttcgtgaagctttctaccgccagaatcttccaaatgtgaccaatttgcttgctaccgtcttggtcttcctcatagttatctatttccaaggcttccgtgttgtgcttccagtgagatcaaagaatgctcgtgggcagcaaggatcgtatccaatcaagctgttctacacttcaaatatgcccattattctgcactctgcactgattaccaacctctatttcatatcccagcttctctacaggaagtacagtggaaatttccttgttaaccttcttgggatatggaaggagtctgagtactctggccattctattcctgttggtggtcttgcttactatgtaactgccccatcaagtttggctgatgtccttgcaaatccgttccatgcactgttttatgtggtcttcatgctgtcagcttgtgcactgttctcaaagacatggattgaagtttctggttcatcagcaaaggatgttgctaagcagctaaaggaacaacaaatggtgatgccaggccatcgtgagtccaacttgcagaaagaactgaaccgatatatcccaactgctgctgcgtttggtggagtatgcatcggtgcattgactgtccttgcggatttcatgggtgcgattggttctggaactggtatacttcttgctgttacaatcatataccaatattttgagacctttgagaaggaaagggcgacagagctcggtttctttggtttttgatctgtagctgtgaaatcgtgtcttggctagagctgaatcgtcttgtaagtcacagtactgcttggccagcggttatggttgtaacttgagaggctacattctgtttaggttgcctttttgggtcgcaatgacagtcatgttgcagactctgcgtgtgttttcagttcggtgtggtggcatgtgcatttgcctatgtaaaacaggcatgctcatccatcctccgtggctacatcagtcccctgcggtctgctcatgccctgacaatcggatgttttgcgatcaattggttactttg

SEQ ID NO: 29461 - protein, 475 aa, Panicum virgatum
  misc_feature: Ceres CLONE 1891405
  misc_feature (77)..(461): Pfam Name: SecY Pfam Description: eubacterial secY protein
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILITIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGIWKESEYSGHSIPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 29462 - DNA, 1871 bp, Panicum virgatum
  misc_feature: Ceres CLONE 1891412
  misc_feature: Encodes the peptide sequence at SEQ ID NO. 29463
aattcgcttccgccgccgccgccgccgccagtctcttttgctagtccatcatcttcggcgaggcgacaggggacagaagcaagcagcttgtctggtctcggcggcgccgccctcctcctcccttctatctaccgtaacaggccccggagtatagccggagttcgtcggattggatggacagccaggctcctcctcccgctgccgccaccgatgccaacaccagcgtcatgtgccagctggtcagccccgaaggagaccatctcggtgcagcgctctatctaccgcagaacgtcgggcccccgcagctccaggagattgtcaatcacctcctccacaatgaggacaagctgccctatgcattttacattggagatgaagagctctctgtccagctgggcacttacatgcagcaaaagaacgccaatgttgaggttacactgcgcatagtatatcaaccacaagcactttttcggatcaggccagtcaaccgctgctcggctacaattgctggtcacacagaagctgtacttgctgtttcttttagccctgatgggaaatgtttggcgagtggttcaggtgacaccagtgttcgcttttgggaccttgatacacagactccattattcacatgcaaaggacacaaaaactgggttctctgcattgcgtggtcgcctgatgggaaacatcttgttagtggaagcaagtcaggagaacttatattatgggaccccaaaactgggaagcaattgggctttccacttatgggacacaggaaatggattactgctgtatcttgggagccagcccatttgcaagctccatgccgccgctttgtaagtgcaagcaaggatggtgatgctcgcatttgggatatcaccacgaggaaatgtgttatttcccttacaggtcacactaattcagtgacctatgtcaagtggggtggtgatggtttgatttatacaggttctgaagattgtttgatcaaagtatgggaaacatctcagggaaagttggtcaaaacattgcagggtcatgggcactgggtgaattcgcttgccttgagcacggaatatgttctccgcactggaccatatgaccatactggcaagacatattcaaccgcagaggaaatgaaagaggcagctcttgcgagatacaagaagatgaggggtaatgctcctgagagactagtttctggttctgatgattttacgatgtttctttgggaaccaacaattagtaaacaacctaaagctcgcatgactggtcatcagaagcttgtgaaccatgtgtacttttcacctgatgggcaatggttggcaagtgcctcctttgataaatctgtcaagttgtggaacggtatcacaggaaagtttgttgcagctttcagagggcatgttgcagatgtctaccagatcagctggtctgctgacagtaggcttctgctaagtggaagcaaggattcaaccctaaaggtttgggatattcgaacgcacaagttgaaacaggacctaccgggccacgcggatgaggtgtacgccgtggattggagccctgacggcgaaaaggtggcatctggtgggaaggatcgggtcctcaagctttggatgaattgactgaccaagctgctacggattgaaggctgcatacgctataaatataagaagaatgatggagctcctgtgacaaaaacaattttggttttggaaccttgtaccgtggatgatatatgtttagcgagttaatgtggtgggatttcaagctatttctgtttgtatttatttgtgtggtagctggagctagtatcgacatatccatccatggatttgtacaagcacctgattattgcatcaataggtaccagtacttgc

SEQ ID NO: 29463 - protein, 480 aa, Panicum virgatum
  misc_feature: Ceres CLONE 1891412
  misc_feature (105)..(143): Pfam Name: WD40 Pfam Description: WD domain, G-beta repeat
  misc_feature (357)..(395): Pfam Name: WD40 Pfam Description: WD domain, G-beta repeat
  misc_feature (147)..(185): Pfam Name: WD40 Pfam Description: WD domain, G-beta repeat
  misc_feature (399)..(437): Pfam Name: WD40 Pfam Description: WD domain, G-beta repeat
  misc_feature (441)..(479): Pfam Name: WD40 Pfam Description: WD domain, G-beta repeat
  misc_feature (237)..(274): Pfam Name: WD40 Pfam Description: WD domain, G-beta repeat
  misc_feature (190)..(233): Pfam Name: WD40 Pfam Description: WD domain, G-beta repeat
  misc_feature (278)..(352): Pfam Name: WD40 Pfam Description: WD domain, G-beta repeat
  misc_feature (17)..(78): Pfam Name: NLE Pfam Description: NLE (NUC135) domain
  misc_feature: SWISSPROT Homolog: EC 2.7.11.7 [Myosin heavy-chain] kinase
MDSQAPPPAAATDANTSVMCQLVSPEGDHLGAALYLPQNVGPPQLQEIVNHLLHNEDKLPYAFYIGDEELSVQLGTYMQQKNANVEVTLRIVYQPQALFRIRPVNRCSATIAGHTEAVLAVSFSPDGKCLASGSGDTSVRFWDLDTQTPLFTCKGHKNWVLCIAWSPDGKHLVSGSKSGELILWDPKTGKQLGFPLMGHRKWITAVSWEPAHLQAPCRRFVSASKDGDARIWDITTRKCVISLTGHTNSVTYVKWGGDGLIYTGSEDCLIKVWETSQGKLVKTLQGHGHWVNSLALSTEYVLRTGPYDHTGKTYSTAEEMKEAALARYKKMRGNAPERLVSGSDDFTMFLWEPTISKQPKARMTGHQKLVNHVYFSPDGQWLASASFDKSVKLWNGITGKFVAAFRGHVADVYQISWSADSRLLLSGSKDSTLKVWDIRTHKLKQDLPGHADEVYAVDWSPDGEKVASGGKDRVLKLWMN

SEQ ID NO: 29464 - DNA, 2006 bp, Panicum virgatum
  misc_feature: Ceres CLONE 1891414
  misc_feature: Encodes the peptide sequence at SEQ ID NO. 29465
gcgaggtgaccaacccccaaagccagccagaacaaaaccaccaccacctcctctttctcctctcgcccctgctccgctactcgggcaagccaagccaggggaaccggaacccaaccccccacacaccgcaggcgagcccacgcagacgcggccgcggctcaagccaccccgtgggctccgatgggctgctgccgctcctcgctgcggacggggacgctcccggtgaagaagccgccggggagggcggcgggggcgctcccccagcaccgcccctccctctcgctgaaccagcaccaggcgcggccgccctccgcggcgcgcgcgggcgccgccggccgcgaggtgccggcggtcaaggagttctcgctggaggagctgcgcgccgccacgggcggcttcgcgccggagaacatcgtctccgagagcggcgacaaggcgccgaatttcgtgtacaagggccgcctcgaggccagccgccgcgcgatcgccgtcaagaagttcaccaagatggcctggcccgatgccaagcagttcgcggaggaggccaagggggtcggcaagctgcgacactgccggatggccaacctgatcggctactgctgcgacggggacgagcgcctgctcgtcgccgagttcatgcccaacgacacgctcgccaagcacctcttccactgggaaaaccagacacttgaatgggctatgcgtctaagagttgcatactacatcgctgaagcactggagtattgcagctctgagggaaggcctttgtatcacgatctaaattcatacagggttctctttgatgagaatggtgatcctcgtctttcatgctttggcctcatgaaaaacagcagggacgggaaaagttatagcacaaatcttgcatacacacctccagaatatttaagaaatggaagagttacatcggaaagtatcatatacagttatggcactatacttctggatctcctcagtgggaaacgtatacctccttcccgtgcttgtgagatgataaaaggcaacaatctccaagtactgatggactcacatttggagggaaactacccaacagaagaagcgaccacaatggttgatctggtctctcagtgcttacagtatgaacctagggatcgccccaacaccaaaaagttggtttctgttctcgagcccatgcaaataaaatcagaggtaccatcctatgagatgcttggcattccaaagcatgaagaagaagaagcgcctcccactccccctccgcagccacagcaccctctttctcccatgggtgaggcctgttctaggatggatttgacggctatccatcagattctagtgaatacacattacagggatgatgaagggactaatgagctgtcgttccaggaatggacacagcagatgagggacatgttggaggctaggaaacgtggagactttgcttttcgtgataaagatttcaaggcagccatagactgttatacacaatttgttgatgtggggacgatggtatcaccaacagtgttcgcgaggcggagcctgtgccacctcatgtccgaccagcctgatgccgccctccgtgatgcaatgcaggcgcaatgcgtgtaccctgattggcccaccgcgttctacatgcaggccgtcgccctctcgaagctgaacatgcagagcgacgccatggacatgctgaatgaggcttcgcagctcgaagagaagcggcagaagaacaccaaaccttgaaagtccagtcagctcggcgtccctcctccggctccataggtggtttatgttgagacatgctactcggtgcttcctaaaagttgtggttagctcctgttccctgggtttggggatgtaattggatggatggtgtgctgtagagttagtcctgtgattgttaatacccggtttggcatttctctgctgcatttttttttgggcccgtgtacatcttacattgacaagaatcgaaacaggcggaatgcaaaggggatttacttgtggtcgct

SEQ ID NO: 29465 - protein, 518 aa, Panicum virgatum
  misc_feature: Ceres CLONE 1891414
  misc_feature (90)..(328): Pfam Name: Pkinase Pfam Description: Protein kinase domain
  misc_feature: SWISSPROT Homolog: EC 2.7.11.1 Non-specific serine/threonine protein kinase
MGCCRSSLRTGTLPVKKPPGRAAGALPQHRPSLSLNQHQARPPSAARAGAAGREVPAVKEFSLEELRAATGGFAPENIVSESGDKAPNFVYKGRLEASRRAIAVKKFTKMAWPDAKQFAEEAKGVGKLRHCRMANLIGYCCDGDERLLVAEFMPNDTLAKHLFHWENQTLEWAMRLRVAYYIAEALEYCSSEGRPLYHDLNSYRVLFDENGDPRLSCFGLMKNSRDGKSYSTNLAYTPPEYLRNGRVTSESIIYSYGTILLDLLSGKRIPPSRACEMIKGNNLQVLMDSHLEGNYPTEEATTMVDLVSQCLQYEPRDRPNTKKLVSVLEPMQIKSEVPSYEMLGIPKHEEEEAPPTPPPQPQHPLSPMGEACSRMDLTAIHQILVNTHYRDDEGTNELSFQEWTQQMRDMLEARKRGDFAFRDKDFKAAIDCYTQFVDVGTMVSPTVFARRSLCHLMSDQPDAALRDAMQAQCVYPDWPTAFYMQAVALSKLNMQSDAMDMLNEASQLEEKRQKNTKP

SEQ ID NO: 29466 - DNA, 650 bp, Panicum virgatum
  misc_feature: Ceres CLONE 1891415
  misc_feature: Encodes the peptide sequence at SEQ ID NO. 29467
gctgcgccgccatcacacaaatcctccgccctctccctccttcgtaaaccctctctcgcttcctcggccggcctgctcctgcaatccgcgctgcagatcggccgaaatggcgctggtattgtattctggacctggaaacaagaatgccttcaaggcacttattgctgcagaatacagtggtgtcaaggttgagttgaccaagaattttgagatgggtgtcaccaacaagacccctgagtttctgaagatgaacccccttgggaaggtgcctgttctggagactcctgaaggtgctgtttttgagagcaatgctattgcacgctatgttgctcgcttcaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcgttgaagagagcgctcggttctctgaacacgcaccttgcctcaaagacattccttgttgggcattctgtcactctagctgacattgtattgacatgcaacctctaccatggatttgcacggatcttgaccaagagcttcacatccg

SEQ ID NO: 29467 - protein, 181 aa, Panicum virgatum
  misc_feature: Ceres CLONE 1891415
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLYSGPGNKNAFKALIAAEYSGVKVELTKNFEMGVTNKTPEFLKMNPLGKVPVLETPEGAVFESNAIARYVARFNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTS

SEQ ID NO: 29468 - DNA, 665 bp, Panicum virgatum
  misc_feature: Ceres CLONE 1891458
  misc_feature: Encodes the peptide sequence at SEQ ID NO. 29469
ccgccacttcgcatcacgcaacgcccccaggcactcgtcacgcacacatccaaacccacttcccgatccgacccggaggcactgcgagttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggtgacaagtggaagtccctgtccgatgctgagaaagctcccttcgtgtccaaggccgagaagctcaaagctgagtacaccaagaagatggacgcctacagtaacaagacggctggaggccctacagcttctggtgactctgacaagtccaagtccgaggtgaacgacgaggatgaggagggtgacgagtgatgcatccatgtctctccagccaagtcgtcgcagtcagtagtagggaagtcttcgtcgtcggcctaaccgggcattgctgctccttatcctctggatgctgtcggtctctctagatgtagcagtagtagctgtccactctcgagttggtagttgcaagtgtcgtccctgaagtgaagcagtttag

SEQ ID NO: 29469 - protein, 126 aa, Panicum virgatum
  misc_feature: Ceres CLONE 1891458
  misc_feature (28)..(97): Pfam Name: HMG_box Pfam Description: HMG (high mobility group) box
  misc_feature: Functional homolog of the protein sequence given in SEQ ID NO 50397
  misc_feature: Useful for making plants with altered lignin content
  misc_feature: Useful for making plants with altered terpenoid content
  misc_feature: Functional homolog of the protein sequence given in SEQ ID NO 50396
  misc_feature: Useful for making plants with altered alkaloid content
MKSRARSSGADSRLSVRKSKAEKDPNKPKRPPSAFFVFMEEFRKDYKEKHPNVKQVSVIGKAGGDKWKSLSDAEKAPFVSKAEKLKAEYTKKMDAYSNKTAGGPTASGDSDKSKSEVNDEDEEGDE

SEQ ID NO: 29470 - DNA, 673 bp, Panicum virgatum
  misc_feature: Ceres CLONE 1891464
  misc_feature: Encodes the peptide sequence at SEQ ID NO. 29471
atttgtctaattcgtcctcttctcctttcccctcgacccgacgccagcccagtcgacgcctctccccttctgctcagtccgccggcctcaagccatcaccgaaccatcgcccttccctcggtaaggaacacctacctcgatccgtctcagctccgcaagaatacctcttttccgcgccgggagcatttagatcgggggtcgttcttgcggggatccatcggagatccattctttttttcctcctcttcttggagcgccccaatctcgctcactcggatcttggttcttggttcgtggcagaggatggattggcaggggcagaagctcgcggagatgctgatgcaggtgctgcttgtggcgtcggccgtggcggcgttcctggcgggctacgtgcgcggggacttccagctcatgctgctcgtctacgccgccggcgtcgtgctcacggcgctcgtcaccgtccccaactggcccttcttcaaccgcaacccgctcaagtggctcgacgccgccgaggccgagcgccacccgcgcccgcaggtcagcgccgccggcgcgggggcaggaggcaagaagaagtccggcaagaacaagtagtcggtctttcagaaggcatatgtgttgtcgatccatatgactcaacttgttttggtactgtttccagatctatatg

SEQ ID NO: 29471 - protein, 97 aa, Panicum virgatum
  misc_feature: Ceres CLONE 1891464
  misc_feature (1)..(80): Pfam Name: SPC12 Pfam Description: Microsomal signal peptidase 12 kDa subunit (SPC12)
MDWQGQKLAEMLMQVLLVASAVAAFLAGYVRGDFQLMLLVYAAGVVLTALVTVPNWPFFNRNPLKWLDAAEAERHPRPQVSAAGAGAGGKKKSGKNK

SEQ ID NO: 29472 - DNA, 731 bp, Panicum virgatum
  misc_feature: Ceres CLONE 1891472
  misc_feature: Encodes the peptide sequence at SEQ ID NO. 29473
acagcaccagcatcgatcacacagcaatcaacacacacagccatcccactacttgcacgccgaaggaggaggaggaggagcaactcaccaagcgagagccatgacgacgaaggcgatctcggcgcttgccgtcgtcctgctcgcggcggcggcgttccaccagcagctggccgcgccggcgcgcgccgcctacatcgcgtgccccgccgtgctccaggacatgacgccgtgcctgcccttccttcagggcggcgaccgcagcccctccgccggctgctgcgccggcgtgaggtccctctacgaggccgccgacaccaccgccgagaggcgcgccacctgcgagtgcctcaagactgcgtacctccaggtccaggcccagctctccgccgcgcaggcgctgcccggcgactgcggcctctcgctgccctacatcatcacccccgacatcgactgcaacacgattgaatgaagcagggatagatgcagctgtgaccgctcaatccaaatccatatacgacgactgatggtgatgatcgtatcagtgctctgacttgctgtatgtggaagcactgcgttattagaattagaataaaggatttggtgccaattaatgctgtcgcttgtaatcgtgtgtgagccatcagtagtggcttctatgtgtgctagttaatcaatctcccatgtactcgcgtgtgcaactttaatatactgtgctccagttaattataaac

SEQ ID NO: 29473 - protein, 122 aa, Panicum virgatum
  misc_feature: Ceres CLONE 1891472
  misc_feature (34)..(118): Pfam Name: Tryp_alpha_amyl Pfam Description: Protease inhibitor/seed storage/LTP family
MTTKAISALAVVLLAAAAFHQQLAAPARAAYIACPAVLQDMTPCLPFLQGGDRSPSAGCCAGVRSLYEAADTTAERRATCECLKTAYLQVQAQLSAAQALPGDCGLSLPYIITPDIDCNTIE

SEQ ID NO: 29474 - DNA, 685 bp, Panicum virgatum
  misc_feature: Ceres CLONE 1891482
  misc_feature: Encodes the peptide sequence at SEQ ID NO. 29475
tttcggtttcctcccttcggtttcctccccccatctctctctctcatcatcgtcgccacctccatcccgtctccatccccttcggcctccgatccctccacgagtcgagcagaggatccgcggcggcggcgggcggtggtcggccggcgatggcgcaccgggtggacaacgagtacgactacctcttcaagatcgtgctcatcggcgactccggcgtcggcaagtccaacatcctctcccggttcacccgcaacgagttctgcctcgagtccaagtccaccatcggcgtcgagttcgccacccgcaccctccagatagaaggaaagaccatcaaagctcagatatgggatactgctgggcaagagaggtaccgtgcaatcactagcgcttactacagaggagctgtgggtgcacttttagtctacgatatcacaaagaagcagacatttgaaaatatccagaggtggcttcgtgagctccgtgatcatgcagactccaacattgtgatcatgatggttggtaacaaatcggatctgaaccacctgagatcagtttcagaggaagatggccaggcattagcggagaaggaaggcttatccttcctggagacatcagctcttgaagccgtgaatggtgagaaggcatttcagactattctcgctgatattcattcaatcataagcaa

SEQ ID NO: 29475 - protein, 178 aa, Panicum virgatum
  misc_feature: Ceres CLONE 1891482
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENIQRWLRELRDHADSNIVIMMVGNKSDLNHLRSVSEEDGQALAEKEGLSFLETSALEAVNGEKAFQTILADIHSIIS

SEQ ID NO: 29476 - DNA, 2731 bp, Panicum virgatum
  misc_feature: Ceres CLONE 1891501
  misc_feature: Encodes the peptide sequence at SEQ ID NO. 29477
aagccaacgccgagaaccccctccctgtctacctctcaattttttctctcactcgctcgccgcggctggcaccgaggcggggggtgcacaggggaacggggcttgccggccggtgagggggagcgcgcgcggcgatgtcgcggttcgtggacaagctgccgttctttgaccggaggtcgtcgccgatggaggaggccgaggacatcccgcggaacggcctcctgcacgtgcaccaccaccaccagcagccgccgccgccgcaccacagcggcctgctcatgcagccgcagccgccgccgccggcgaagcagtcgtcgttcacgctcgcgcagctgctgaagcgcgtcaacgaggcgcgcagcgacgcgtcgtcgcccacgtcctcgcccacgcactcgcactacaccatcgagctgggcggctccgtgccgggctccaccggcagcgacctgagcgagcacatgcacggcggcggcggcgggggcgggccgctgctgccgttcgtgctcaagttcacggacctcacgtacagcgtcaagcagcggaagaagggctcgtgcctgccgttcgggcgcgcgggcggggagacggccgagcccgaggcgcccaggatgaagacgctgctggacaacatctccggcgaggcgcgggagggcgagatcatggcggtgctcggcgccagcgggtccgggaagagcacgctcatcgacgcgctcgccaaccgcatcgtcaaggagagcctccacggctccgtcacgctcaacggcgagtcgctcgacggcaacctgctcaaggtcatctctgcgtacgtgatgcaggacgacctcctgtacccgatgctcaccgtcgaggagacgctcatgttcgccgccgagttccgcctcccgcggtccctgcccaccaaggagaagcggaagcgcgtgcaggcgctcatcgaccagctcggcctgcgcagcgcggccggcaccatcatcggcgacgagggccaccgcggcgtgtcgggcggggagcgccggcgcgtgtccatcggcgtggacatcatccacgacccgatcgtgctgttcctggacgagcccacctccgggctcgactccaccagcaccttcatggtggtcaaggtgctgcagcgcatcgcgcagagcggcagcgtggtggtcatgtccatccaccagccgagctaccgcatcctgggcctgctggaccgcctcctgttcctctcccgcgggcagaccgtgttctacggcccgccgggcgcgctgccgtccttcttcgacgacttcggcaagcccatcccgggcaacgagaacccgacggagttcgcgctcgacctcatccgggagctggagaccatgccggacggggccagggacctcgtggagcacaacaagaagtggcagatgcggcgcgtggcgcccaagacgatgaagcaccacgacgacgggccgtcgccgccgctgtccctcaaggaggccatcagcgccagcatctctggcgggaagctcgtgtccggcgcgaccgacgggtccgtgtcgtcggcgccggcggccgcggtgtccaagttcgccaacccgttctgggtggagatgggcgtcctgacccggcgcgccttcatcaacacgaagcgcacgccggagatcttcgtcatccgcctggccgccgtgctggtgacggggttcatcctggcgactatcttctggcgcctggacgagtcccccaagggcgtgcaggagcggctgggcttcttcgccatcgccatgtccaccatgttctacacctgctccgacgcgctccccgtgttcctgaacgaacgctacatcttcctccgcgagacggcctacaacgcataccggcggtcctcgtacgtgctctcccacaccctcgtcggcttcccgtccctgatcgtgctgtccctggcgttcgcgctcaccaccttcttcgccgtgggccttgccggcggcgccgggggcttcttcttcttcgtggccatcgtgctggcgtccttctgggccgggtccgggttcgcgacgttcctctcgggcgtggtgaccaacgtgatgctggggtaccccgtggtggtgtcgacgctggcctacttcctcctgttcagcggcttcttcatcaaccgcgaccgcatcccgcgctactggatctggttccactacctgtcgctggtcaagtacccgtacgaggcggtgatgcagaacgagttcagcgacccggcgcggtgcttcgtgcgcggcgtgcagatgttcgacaacacgccgctggccgcgctgccggcggcgctcaaggtgcgggtgctgcgcgccatgagccaggcgctgggggtggacatcgggacggccacgtgcatcaccacggggcccgacttcctggcgcagcaggccgtcacggacctcaccaagtgggactgcctctggatcaccgtcgcctgggggttcctcttccggatcctcttctacatctcgctgctgctcgggagcaggaacaagaggaggtgatcatccgggcctgcctgctttcgcggggggctaccttggatttcttcttgggaatttatccccatttcctttctgatcgaccgcatcatctgattagtagtagtatgggacgggagttgtgtatcgcatcgcgtgtaaatttgcttgtaagtttccatggcaagttcaaattgtaattcgaccacatttacttatgcaatggttcccctttttggggggctttgtgtttc

SEQ ID NO: 29477 - protein, 788 aa, Panicum virgatum
  misc_feature: Ceres CLONE 1891501
  misc_feature (482)..(692): Pfam Name: ABC2_membrane Pfam Description: ABC-2 type transporter
  misc_feature (174)..(364): Pfam Name: ABC_tran Pfam Description: ABC transporter
  misc_feature: SWISSPROT Homolog: EC 3.6.3.28 Phosphonate-transporting ATPase
MSRFVDKLPFFDRRSSPMEEAEDIPRNGLLHVHHHHQQPPPPHHSGLLMQPQPPPPAKQSSFTLAQLLKRVNEARSDASSPTSSPTHSHYTIELGGSVPGSTGSDLSEHMHGGGGGGGPLLPFVLKFTDLTYSVKQRKKGSCLPFGRAGGETAEPEAPRMKTLLDNISGEAREGEIMAVLGASGSGKSTLIDALANRIVKESLHGSVTLNGESLDGNLLKVISAYVMQDDLLYPMLTVEETLMFAAEFRLPRSLPTKEKRKRVQALIDQLGLRSAAGTIIGDEGHRGVSGGERRRVSIGVDIIHDPIVLFLDEPTSGLDSTSTFMVVKVLQRIAQSGSVVVMSIHQPSYRILGLLDRLLFLSRGQTVFYGPPGALPSFFDDFGKPIPGNENPTEFALDLIRELETMPDGARDLVEHNKKWQMRRVAPKTMKHHDDGPSPPLSLKEAISASISGGKLVSGATDGSVSSAPAAAVSKFANPFWVEMGVLTRRAFINTKRTPEIFVIRLAAVLVTGFILATIFWRLDESPKGVQERLGFFAIAMSTMFYTCSDALPVFLNERYIFLRETAYNAYRRSSYVLSHTLVGFPSLIVLSLAFALTTFFAVGLAGGAGGFFFFVAIVLASFWAGSGFATFLSGVVTNVMLGYPVVVSTLAYFLLFSGFFINRDRIPRYWIWFHYLSLVKYPYEAVMQNEFSDPARCFVRGVQMFDNTPLAALPAALKVRVLRAMSQALGVDIGTATCITTGPDFLAQQAVTDLTKWDCLWITVAWGFLFRILFYISLLLGSRNKRR

SEQ ID NO: 29478 - DNA, 407 bp, Panicum virgatum
  misc_feature: Ceres CLONE 1891504
  misc_feature: Encodes the peptide sequence at SEQ ID NO. 29479
acccctcaaacatacaagaagaagcagcattcgaagtgcttacatcttgtggtatatatctctgaagaagatgagcagctcggcagttggtgatggcaaggggtgtgatgctactcccaagacagagtggcctgagctagtgggaagcacgatcaaggaggcgacggagaagatcaatgcggagcggccggacctcaatgtggagccggtccctgttggcaccatagtcccccaagatttcgacccgaagcgcgtccgtctctgggttgacaccgtcgccgaggtccccaggattggctgaaccagcttaacgcaaagccaccgaataatgaatgctacatgcatgtgttccacagaccattctacataggtcaattaaataaataaaaaatatggctgtgatggag

SEQ ID NO: 29479 - protein, 76 aa, Panicum virgatum; identical to SEQ ID NO: 26537
  misc_feature: Ceres CLONE 1891504
  misc_feature (17)..(76): Pfam Name: potato_inhibit Pfam Description: Potato inhibitor I family

SEQ ID NO: 29480 - DNA, 1378 bp, Panicum virgatum
  misc_feature: Ceres CLONE 1891530
  misc_feature: Encodes the peptide sequence at SEQ ID NO. 29481
ctctctgtctctctcctccctgccgccccgccgctctccccgcccgccgccgctatggaggttctccacgaggagatgcccttcgacctcgacttccacccgtccaaccccctcgtcgtcacctccctcatcaccggcgagctatgcctgtttcgctacggcccggagtcgcagcctgagaggttgttttcggtgaaagctcacaaggagtcatgcagagctgttcgctttgtggactcaggaaaagtgatcttgtcagggtctgctgattgctcagttcttgcttcggatgtagaaacaggcaaggccattgcccgcttggaggatgctcacgaggatggcataaaccgccttatctgccttactgaaacaacaattgctacaggtgatgatgaaggctgcattaaggtgtgggatacccgggaacattcttgctgcaacacttttcatgtccatgaagattatatttcagatatgacctatgtggctgactcaaatcaaatactggcaacaagtggggatggaactttgtcagtgaacaacctgcgtaggaataaagtaaaatcacaatctgaattttcagaagatgagttgctatccttggtggtaatgaagaacggtaaaaaagttgtttgtggaactccatgtggagcactgttattatattcatggggatactttaatgattgcagtgaccgctttctgggacacacacagtctgtggatacaatgctgaagctggatgaagaaactctgatttctggtgcatcagatggtgtgatcagattagtgggcatcttacctaatagaataatacagccacttgctgaacattcagaatatcccgttgaggcccttgctttctcaaacgataagaaatatctaggaagcctttcacatgataaaatgcttaagctatgggacttgcaagagctcttgaatggcccacaggtagttaatggtggtgaacctgctgagtctgctagcgatggtagtgatgacgatggcgacgatgacagtatggatgtggacatggcaccttcctcgtctaaaggatcaaggagtaaaaaggtgggcaaaggtcagagttcaagtaggccggcatcagatttctttgcagatttataggcgccatgctcccaaagcagaagctgtgcgttgtactctttttgcagtactgtacgtgagtgcgactgggcaactttgattgccactgcagttttggtattttccagtgtaggccatgtcaaatgttgtttctaagtgtattgactgatggaatattagaggtagaagtagtaagctgtgatttatctcgaggaaacaggacctcactgtatatgctttgccgatttgccagtaaaaaatggttccgagt

SEQ ID NO: 29481 - protein, 357 aa, Panicum virgatum
  misc_feature: Ceres CLONE 1891530
  misc_feature: SWISSPROT Homolog: EC 2.7.11.7 [Myosin heavy-chain] kinase
MEVLHEEMPFDLDFHPSNPLVVTSLITGELCLFRYGPESQPERLFSVKAHKESCRAVRFVDSGKVILSGSADCSVLASDVETGKAIARLEDAHEDGINRLICLTETTIATGDDEGCIKVWDTREHSCCNTFHVHEDYISDMTYVADSNQILATSGDGTLSVNNLRRNKVKSQSEFSEDELLSLVVMKNGKKVVCGTPCGALLLYSWGYFNDCSDRFLGHTQSVDTMLKLDEETLISGASDGVIRLVGILPNRIIQPLAEHSEYPVEALAFSNDKKYLGSLSHDKMLKLWDLQELLNGPQVVNGGEPAESASDGSDDDGDDDSMDVDMAPSSSKGSRSKKVGKGQSSSRPASDFFADL

SEQ ID NO: 29482 - DNA, 725 bp, Panicum virgatum
  misc_feature: Ceres CLONE 1891539
  misc_feature: Encodes the peptide sequence at SEQ ID NO. 29483
cgtctgctcggccgatctcgcgcagcgccggcgccgccgcatccctgaatctgagcccctttcgtcttgcccagcctcgagcacgtcccccttcccctcctctaccctccctccattcgattcgagcttatcgctagggttcctgaccccgctccaccttctcccatggcggacgaagccaaccgaacggcgttcatggagctgcaggcccggatgttcgataccaccgggaagatcaagcagttacaaacccaaatgcgttctaaagagggggaaaagaagcgtgcttacctcactctggaggaactccgccaattgccagatgacactaacacctacaagactgttggaaaagtgtttattttggagccaaaatcagttcttttgaacgagcaagagcaaaaatttaatgaaagtgagagcgcgatagcatcaatgcagacttcgaaggaataccttgagaaacaggtgggagaagtggagaacaacatcagagagctgcttcaacaggacccgggccttgcacgccagattctctcgatgactgtccaatgagagttgtttacgctgcatttgcatatgatcaggtgtaattttacaatttgatctgtctgcaaactctgctttccccttgccgtactgtgagttgtgggtggtgttttgctgcaatggtcccgtccatgtatgaacaaaagaatttgcagttgccttcctgcaataggttt

SEQ ID NO: 29483 - protein, 129 aa, Panicum virgatum
  misc_feature: Ceres CLONE 1891539
  misc_feature (11)..(116): Pfam Name: Prefoldin_2 Pfam Description: Prefoldin subunit
  misc_feature: Functional homolog of the protein sequence given in SEQ ID NO 51316
  misc_feature: Useful for making plants with altered terpenoid content
MADEANRTAFMELQARMFDTTGKIKQLQTQMRSKEGEKKRAYLTLEELRQLPDDTNTYKTVGKVFILEPKSVLLNEQEQKFNESESAIASMQTSKEYLEKQVGEVENNIRELLQQDPGLARQILSMTVQ

SEQ ID NO: 29484 - DNA, 705 bp, Panicum virgatum
  misc_feature: Ceres CLONE 1891551
  misc_feature: Encodes the peptide sequence at SEQ ID NO. 29485
gaccatcacaattattcatttctcgcatttgcagcccccacaaacccccgaaggaaggaagagaagagctcccgatggagaacgccgccgtgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgctccggcctggaggccgccgtcggggggtacatcccggccggcgccgcggggctccgcttcgacgacttcgagtccctccaccgcgcgctcggggacgcgctgttcggccccatcccggaggcggtgcccgaggaggaggacgaggagggggacatgaaggaggcgttccgcgtgttcgacgaggacggcgacggctacatctcggccgccgagctccaggccgtgctcaagaagctcggcctgcccgaggcgcggaacctcgccacggtgcaggagatgatctgcaacgtcgacagcgaccgcgacggccgcgtcgacttcggcgagttcaagaacatgatgcaggggatcaccgtgtggggcgcctagctgcagcgtccctgcgttgccaaccttctacagtgtgttgacatgtatgtatgatgtatctactatgtaggca

SEQ ID NO: 29485 - protein, 185 aa, Panicum virgatum
  misc_feature: Ceres CLONE 1891551
  misc_feature (114)..(142): Pfam Name: efhand Pfam Description: EF hand
  misc_feature (29)..(57): Pfam Name: efhand Pfam Description: EF hand
  misc_feature (152)..(180): Pfam Name: efhand Pfam Description: EF hand
  misc_feature: SWISSPROT Homolog: EC 2.7.11.1 Non-specific serine/threonine protein kinase
MENAAVKPSLSKKPSPSFRLRNGSLNALRLRRVFDLFDRNGDGEITLDEMASALDALGLGADRSGLEAAVGGYIPAGAAGLRFDDFESLHRALGDALFGPIPEAVPEEEDEEGDMKEAFRVFDEDGDGYISAAELQAVLKKLGLPEARNLATVQEMICNVDSDRDGRVDFGEFKNMMQGITVWGA

SEQ ID NO: 29486 - DNA, 1907 bp, Panicum virgatum
  misc_feature: Ceres CLONE 1891559
  misc_feature: Encodes the peptide sequence at SEQ ID NO. 29487
agactccaagcgcaagcaggcgaggccgcgaggcggggcgggacacgggaggagataacgccggaagcagaccgcgagaaggggcaggctcaatgctacagatgtgaatactccagagtggaaattctcaaaaatgattcatgatgcacaaatcaaattttctgatcactccatcctaaggattgttcaaatgttgggtcgatacggaaactggaaacgtgttttgcaagttgttgaatggcttcagtcacacgaaaggttcaagtcctacaagagcaggtatatttacacaacagttcttgatgttctaggaaaggcaaagagaccaatcgaggcattaaatgtgttttacaccatgcagaagcaattgtcatcttatcctgacatggcagcttatcattgtatcactgtggctcttgggcaagctggtcttgtgaaagagctatttgatgtgattgattgcatgcgttctcctcctaggaagaagttcaaattggaccctcttcagaattggaatcctcgcttggaaccggaccttattgtatacaatgcagttttgaatgcttgtgtgcaacaaaagcaatgggaaggggcattttgggtactgcaacagttgaaagagaagaataatcgtccaacaaatacaacatatggtcttgttatggaggtaatgcttgtctgtggaaagtacaatttggtgtatgagttcttcaataaggtggagaaatcgtcgatacctggtgctctcaactataaagttcttgtaaatgcactttggagagaaggaaagatcgatgaagcagtaatggctgtgaaagatatggaaaggcgtggaattgttggttcagctagtctgtattatgaccttgctcggtgcctttgcagtgtagggcggtgcaaagaggcacttctccaggttgagaggatatgcaaggttgccaacaaaccgctggttgttacctacacaggactcattcaaacctgcatagacaatggcagcatggaaaatgctaaatacatattcagcgagatgtgcaactactgttcaccaaatactgtgacttgtaacatcatgctgaagtcttttctggagcatggaatgcttgaagacgcgaaggatctaatccaggatattctgaacggcaggataaggagcaatgtggattcgagccaaaccgcaactgctgacaagtttactttcaatactttcatggaggcctgtgctgcagcacagaggtgggatgactttgagtacgcatttcgtgagatgttatcgaaagggtaccacttcgatgagcgaaggcacttgcgtatggtactcgacgcttataggaatgggaaggaacagctgttggatgatctatggcgctacctgtgccatcacaaccgtgccccgcccgcccctgtcataatggaaagattttgcctgaaactggtgcaaggcgacacgatggctgcaatctcctgcgtcagcaggttccaggagggcaagatacagaacacgtcctccatgtcgtggctgaatctactgaaccggaatgcgggccgcttgaaggaggagcatgttgccaagttagtccgtcaactgaacaacttcgttagctcgaggagttcctctgataacattagcttgtaccaaaaagttcagagtagctgtacagcgttcctttctggtgccaccgttgtagaaaaggcgccatctgtgttagcaaggtgattagtgggctggcctttgggccatgggcccagcccatgcggctagggccgccttagggtttacttgtgattggtttggaataggctagaatctccgttgattagggtgtcttctataaaccctagactccttgcctatatattgtacacctctgtacccctgattaatcaatccatagttttcccgtgcc

SEQ ID NO: 29487 - protein, 527 aa, Panicum virgatum
  misc_feature: Ceres CLONE 1891559
  misc_feature (136)..(170): Pfam Name: PPR Pfam Description: PPR repeat
  misc_feature (309)..(343): Pfam Name: PPR Pfam Description: PPR repeat
MIHDAQIKFSDHSILRIVQMLGRYGNWKRVLQVVEWLQSHERFKSYKSRYIYTTVLDVLGKAKRPIEALNVFYTMQKQLSSYPDMAAYHCITVALGQAGLVKELFDVIDCMRSPPRKKFKLDPLQNWNPRLEPDLIVYNAVLNACVQQKQWEGAFWVLQQLKEKNNRPTNTTYGLVMEVMLVCGKYNLVYEFFNKVEKSSIPGALNYKVLVNALWREGKIDEAVMAVKDMERRGIVGSASLYYDLARCLCSVGRCKEALLQVERICKVANKPLVVTYTGLIQTCIDNGSMENAKYIFSEMCNYCSPNTVTCNIMLKSFLEHGMLEDAKDLIQDILNGRIRSNVDSSQTATADKFTFNTFMEACAAAQRWDDFEYAFREMLSKGYHFDERRHLRMVLDAYRNGKEQLLDDLWRYLCHHNRAPPAPVIMERFCLKLVQGDTMAAISCVSRFQEGKIQNTSSMSWLNLLNRNAGRLKEEHVAKLVRQLNNFVSSRSSSDNISLYQKVQSSCTAFLSGATVVEKAPSVLAR

SEQ ID NO: 29488 - DNA, 699 bp, Panicum virgatum
  misc_feature: Ceres CLONE 1891584
  misc_feature: Encodes the peptide sequence at SEQ ID NO. 29489
atcatttcctccctcgtgcgctctctcgaaccttccaaagcgcccgaaccctagcgagttcggaaccctagcagcgcgcggatctcggctcggctcccacccatccgcgccatggacgaggacttcgagatgcccccggccggcgccgacgagatgatgggcgacgacgggatgggcgacttcggcggcgacgagggcccggtcatgaaggtgggcgaggagaaggagatcgggaaacaggggctcaagaagaagctgctcaaggagggcgagggctgggagacgcccgaggtcggcgacgaggtcgaagtgcattacacgggtacactccttgatggaacaaagttcgattcaagccgtgatcgtggagatcccttcaagtttaagctgggacaaggtcaagtaataaagggctgggaccaaggcatcaagaccatgaagaaaggagaaaatgctatttttaccattcctccagaattggcttatggagaatctggttcgcctccaaagattccacccaatgcaaccttgcagtttgatgttgagctgctttcatggaccagtgtcaaggatatttgcaaagatggcggcatattcaagaagatacttaaggagggagagaaatgggagaacccaaaggatcctgatgaagtacttgtgaaatatgaggccccgtctgggagagggtactattgtttc

SEQ ID NO: 29489 - protein, 195 aa, Panicum virgatum
  misc_feature: Ceres CLONE 1891584
  misc_feature (53)..(147): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MDEDFEMPPAGADEMMGDDGMGDFGGDEGPVMKVGEEKEIGKQGLKKKLLKEGEGWETPEVGDEVEVHYTGTLLDGTKFDSSRDRGDPFKFKLGQGQVIKGWDQGIKTMKKGENAIFTIPPELAYGESGSPPKIPPNATLQFDVELLSWTSVKDICKDGGIFKKILKEGEKWENPKDPDEVLVKYEAPSGRGYYC

SEQ ID NO: 29490 - DNA, 2310 bp, Panicum virgatum
  misc_feature: Ceres CLONE 1891613
  misc_feature: Encodes the peptide sequence at SEQ ID NO. 29491
gcttcaaccttaaaccgaggagtgctcggaaaagcttgaaccatccaactgaaagtctccggcagctcaaggcttccaacttccaagctcagggtttcattccttctaagatgaaattaaagcctggaaggagaaagctgtaagaggatttgacgcttggcgcaccacatgcgatttgacgcttggcgcaccacatgcatgcatgatcaatttgtgatgcagctgtcttgcactgatctcccttcgtgagggcttctgttttcaatcaagcaaatagattcagcgtgcacatacagtacttctgtctctgaaaacaaaacaaacagaggatactttcagaaagtatgaagctattagcttttggtttagtcttgttggggtgcttacaaggttttgttacttgtgattaccaagttacagcactgtatgaaatcaagatgcatctcattgatgaaaatgatgtcctaaacgactggaagaataatcaaatgaccccctgcgggtggggaaatgttatttgtcaaggcaacaaagtaattgccataaaattgagctcaacagggttacgcggagtcttgtcacccagcattgcagaactaacaactttacaaaagctggtattggatggcaatacgataagtggtggaattcctgaggcacttgggaacatatcaagcttaacaattctaaatctaggaaataatatttttaatggttccatacctgattctcttggccgtcttcaaaagctccaaatactggatttaagtgaaaatctcttaaccggggagatcccagtctctctctcaaatctttcatcactgcatgacattaatctatcaggcaactcccttaaaggtgaaataccagaacaactactccaggtggctcaatacaactatacaggcaaccacttgaactgtagccgaaactcaactatttcatgtgaaaaaggcaccactaaggcagggcctaaaactaaaagcattctttggggcttggctgctgtttcttctctactagcagttattttctgtttcctcttttgctttggactgatcaaattcagaaggctcaaaaaaggtaaatggagcgtaatggatagatcggaggtgaatatgcaccgaggtgaagagatagtatgggacatagaagggaacaatccagagttcacattttacgaattttcacaagttttggaagctacaaataatttctcggtagaaaataaacttgggcaaggtggctttggtcctgtttacaagggccaatttcctgatggattggatatagcagttaagagacttgcttcacattcagggcaaggtctcacagaattcaaaaatgaagtccaactcatagccaaactccagcacagaaatctggttaggctgttgggttgttgctctcaaggggaggagaaaatgttgatctatgaatatttgctgaataaaagcttggatttcttcatatttgatgaaacaagaaggactttactaaattgggacagacgactagtgataatcgaaggaattgcacagggacttttgtatttgcataaacactctcggttacgagttatacatagagatgttaaagcaagcaacattctcttggactctgaaatgaatccaaagatttcggattttggactagcaaaaatgtttagctcaaatgatatcgaaggaaacacacaaagggtggttgggacttatggttatatggctccagagtatgcttctgaaggcctcttctcaacaaaatctgacgtattcagcttcggtgtgctaacccttgagatcatcactggaaaaagaaattcaggtttccataagcacggaagcttcctgaaccttcttggatatgcatggcatttgtggcaagagcgaagatggtttgcacttgtcgattcatcattggctgcaagcggttgtacatcagagatgatgaggtgcatcaacattgcgttgctatgtgtgcaagagaatgcgaccgataggcccaccatgtctgatgtggtcgcaatgctaagcagcaaaagcgtcgccctgcctgagcctaaacacccaggatatttccatgtaagggttgcaaaggaggaggaggccttcacaactgcagagccatacagtgccaatgatgcgactgagtccatcgcatatggtagatagtattgaatgaacatatggtagatactgtgatactgtaaattatttcagatgtgaatgtttgcttttactatgcttggcaatgttcgtgtgactctttgagtcaattgcagaactatgcatgtcgcgttgtcgacttctc

SEQ ID NO: 29491 - protein, 608 aa, Panicum virgatum
  misc_feature: Ceres CLONE 1891613
  misc_feature (291)..(562): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50655
  misc_feature: Useful for making plants with altered cell wall content and/or composition
  misc_feature: Functional homolog of the protein sequence given in SEQ ID NO 50654
  misc_feature: Useful for making plants with altered carbohydrate content
MKLLAFGLVLLGCLQGFVTCDYQVTALYEIKMHLIDENDVLNDWKNNQMTPCGWGNVICQGNKVIAIKLSSTGLRGVLSPSIAELTTLQKLVLDGNTISGGIPEALGNISSLTILNLGNNIFNGSIPDSLGRLQKLQILDLSENLLTGEIPVSLSNLSSLHDINLSGNSLKGEIPEQLLQVAQYNYTGNHLNCSRNSTISCEKGTTKAGPKTKSILWGLAAVSSLLAVIFCFLFCFGLIKFRRLKKGKWSVMDRSEVNMHRGEEIVWDIEGNNPEFTFYEFSQVLEATNNFSVENKLGQGGFGPVYKGQFPDGLDIAVKRLASHSGQGLTEFKNEVQLIAKLQHRNLVRLLGCCSQGEEKMLIYEYLLNKSLDFFIFDETRRTLLNWDRRLVIIEGIAQGLLYLHKHSRLRVIHRDVKASNILLDSEMNPKISDFGLAKMFSSNDIEGNTQRVVGTYGYMAPEYASEGLFSTKSDVFSFGVLTLEIITGKRNSGFHKHGSFLNLLGYAWHLWQERRWFALVDSSLAASGCTSEMMRCINIALLCVQENATDRPTMSDVVAMLSSKSVALPEPKHPGYFHVRVAKEEEAFTTAEPYSANDATESIAYGR

SEQ ID NO: 29492 - DNA, 504 bp, Panicum virgatum
  misc_feature: Ceres CLONE 1891625
  misc_feature: Encodes the peptide sequence at SEQ ID NO. 29493
ggctgggacagggaagaaaccacccaaaccctcctcttctccccttctccgcgcgtcacctgccaccggaaaccctagatctgccccgacccatggatccgcagcagccggagcccgtcagctacctctgcggagattgcggagctgagaacaccctgaagccaggagatgtcatccagtgccgtgaatgtggctaccgcatcctctacaagaagcggacccgccgcattgtccaatatgaagcgcgctgaagacaaggagaaaacacaatgctgttagtcgtccctctaccaatgtaatgagcttcctggggaaaatggaaatgtaagactgcaatttttgcatgctgtgtgtgtggccattgtactagagagatattgcagtaatatgattggtgatgggccttgactcttgagtggtgcagatcgattagcatgcgtcatacctgtattattcacgggcattcgccccccatgatctaaaactgatggaaactttgttttt

SEQ ID NO: 29493 - protein, 52 aa, Panicum virgatum; identical to SEQ ID NO: 17825
  misc_feature: Ceres CLONE 1891625
  misc_feature (11)..(42): Pfam Name: DNA_RNApol_7kD Pfam Description: DNA directed RNA polymerase, 7 kDa subunit

SEQ ID NO: 29494 - DNA, 646 bp, Panicum virgatum
  misc_feature: Ceres CLONE 1891628
  misc_feature: Encodes the peptide sequence at SEQ ID NO. 29495
ttacagatttcattctacaagatacattcaagagtcgttatccatcagttaacggcgcaaaagttgtctttgacagaactaccggccgctcaaaaggctatggttttgttaaatttggagatttggatgaacagacacgagcaatgactgaaatgaatggccaatactgttctagcaggcccatgcgccttggaccagcatccaacaagaagaataccggtggacaacaacaggcatcaagtgctacataccagaatacacaaggaactgattctgacaatgatccaaacaatactactgtatttgttggtggtcttgacccaagtgtgactgatgagcttctgaggcaaactttcagtccatatggagagcttctctatgtcaaaatacctgtaggaaagcgctgtggatttgtccaatattctaacagggcatcagctgaggaggccataagggtgctaaatggaacccagttaggaggccagagcgtaaggctctcatggggtcgtagccctgcaaacaagcagcctcagcaagagcagaaccaatggagcagcggctactatgggtatccccaaggatacgatccatatggttatgctcggcctcctcaagatcctgccatgtatgcttatacagcatatcc

SEQ ID NO: 29495 - protein, 214 aa, Panicum virgatum
  misc_feature: Ceres CLONE 1891628
  misc_feature (100)..(165): Pfam Name: RRM_1 Pfam Description: RNA recognition motif. (a.k.a. RRM, RBD, or RNP domain)
  misc_feature (1)..(63): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 536 in the 10/666,642 US patent application
  misc_feature: Functional homolog of the protein sequence given in SEQ ID NO 50786
  misc_feature: Useful for making plants with altered terpenoid content
TDFILQDTFKSRYPSVNGAKVVFDRTTGRSKGYGFVKFGDLDEQTRAMTEMNGQYCSSRPMRLGPASNKKNTGGQQQASSATYQNTQGTDSDNDPNNTTVFVGGLDPSVTDELLRQTFSPYGELLYVKIPVGKRCGFVQYSNRASAEEAIRVLNGTQLGGQSVRLSWGRSPANKQPQQEQNQWSSGYYGYPQGYDPYGYARPPQDPAMYAYTAY

SEQ ID NO: 29496 - DNA, 696 bp, Panicum virgatum
  misc_feature: Ceres CLONE 1891674
  misc_feature: Encodes the peptide sequence at SEQ ID NO. 29497
ctagcccgcaccccttcttcgtttcctccccgcgccgccgcctccgctcgccgccgccgccgccgccgccgccgccgccatgggccgaagacctgcgaggtgctatcgccagatcaagaacaagccatatcccaagtcaaggtattgtcgtggtgttcctgaccccaagatcaggatctatgatgttggaatgaagaagaagggagttgatgagttcccctactgtgtgcaccttgtctcttgggaaaaggagaatgtctctagtgaggctcttgaggctgcccgtatcgcgtgcaacaaatacatgaccaagtctgcaggaaaggatgccttccacctcagggtccgggttcaccccttccatgtgctccgtatcaacaagatgctttcgtgtgctggggctgataggctccagactggaatgaggggtgccttcggcaagccccagggtacctgtgctcgggtggacattggccaggttctcctttctgtgcgctgcaaggacaacaatgctgcccatgccagtgaggctctgcgtcgcgccaagttcaagttccctggtcgccaaaagatcattgagagcagaaagtggggcttcaccaagttcagccgtgctgattacctgaagtacaaaagtgagggtagaatcgtgcctgatggtgtcaacgctaagctgcttggtaaacatgggccggc

SEQ ID NO: 29497 - protein, 205 aa, Panicum virgatum
  misc_feature: Ceres CLONE 1891674
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGKHGP

SEQ ID NO: 29498 - DNA, 1577 bp, Panicum virgatum
  misc_feature: Ceres CLONE 1891727
  misc_feature: Encodes the peptide sequence at SEQ ID NO. 29499
cttttcccgcggcatccactctttcaaaatcctcacgcatccgtcctagcctctacgccctccagtcctagcgcctcgcgtcgcctccgcaccctagggtttccccgcccccgccgccggccatggaggcggtggtcgtcgacgctggctccaagctgctcaaggccggcatcgcggcgcccgaccaattgcccccgctggtgatgccgtcgaagatgaagctggaggtcgaggaccagcaactcgcggacggcgcggtggtggaggaggtggtgcagccggtggtgcgcggcttcgtcaaggactgggacgccatggaggacctgctcaactacgtcctttacaggaacattggctgggagattggggacgagggtcagatcctcttcaccgagccactcttcacgcccaagactcttcgcgagcaattagtgcagcttatgtttgagaaattcaacgtttcaggcttttatgcctctgaacaggctgtattgtcactctatgctgttggacgcatttcaggatgcacagttgacattgggcatgggaaaatagatattgctccagtttgtgaaggagctgttcaacatgtagcatcaaagagattggagattggaggaggtgacttgacaaatctgtttgcacaagaactgaaaaaatctaatccatcagtaaatcttaatacttctaatgttgagaggctgaaagagcaatacgcatgctgcactgaagatcagttggcctttgaagatatagaaagctcatgccagccagaaaggcacactcttcctgatgggcaggttataacaattgaaaaagagcggtatattgttggtgaagctttgtttcaaccaagtattttgggtttggaagattatggtatcgttcaccagctagttaccagtgtctcaaatgtttcatcagaataccatcggcagctgctagaaaacaccatgttatgtggtgccactgcatcgatgactggttttgaagacagattccaaagagaagcaaatctttctgcttcagcaatttgcccatctcttgtaaagcccccagaatacatgcctgagaacctagcaaggtactcggcctggatgggtggtgcgatactggccaaggttgtcttccctcagaaccagcatgtcaccaagggcgagtatgatgagactggcccatccattgtgcataagaagtgcttttagaaacagccgccttgacttggcacggttggtgcgccatttgctgctgccgctcatctcactgatgcgctttgtgtatgcgactgtagttcatacctgattgctgcaggtgctgatgctgggatctacaacttactgcactgagctcaccccaacctgcagcgccaatgcccttcggcgctgctgttctcagcttttcgtggtcttttcatgcatccggccctctggccaggtgaggttgtattgcccctaggttatttggagtgcagtagattgtaagattaactctatttgtttggtgttgtagccaattgttcaattgtacctgtagtatcagaaagtttcctaaaataattatttgcaatttgcattatc

SEQ ID NO: 29499 - protein, 360 aa, Panicum virgatum
  misc_feature: Ceres CLONE 1891727
  misc_feature (3)..(360): Pfam Name: Actin Pfam Description: Actin
  misc_feature: SWISSPROT Homolog: EC 2.7.10.2 Non-specific protein-tyrosine kinase
MEAVVVDAGSKLLKAGIAAPDQLPPLVMPSKMKLEVEDQQLADGAVVEEVVQPVVRGFVKDWDAMEDLLNYVLYRNIGWEIGDEGQILFTEPLFTPKTLREQLVQLMFEKFNVSGFYASEQAVLSLYAVGRISGCTVDIGHGKIDIAPVCEGAVQHVASKRLEIGGGDLTNLFAQELKKSNPSVNLNTSNVERLKEQYACCTEDQLAFEDIESSCQPERHTLPDGQVITIEKERYIVGEALFQPSILGLEDYGIVHQLVTSVSNVSSEYHRQLLENTMLCGATASMTGFEDRFQREANLSASAICPSLVKPPEYMPENLARYSAWMGGAILAKVVFPQNQHVTKGEYDETGPSIVHKKCF

SEQ ID NO: 29500 - DNA, 1792 bp, Panicum virgatum
  misc_feature: Ceres CLONE 1891748
  misc_feature: Encodes the peptide sequence at SEQ ID NO. 29501
ctctactacagtggccgcctctcctcccccgtcttcttccccttctcttctgggaagaacacaagcaaaaagaagatcagagattcttttcttggcgtctggaataaaagtaagtagatgagaaactagtagggaatggaggaagagatgcaaaccgagactagaaccgagaagcaataggattactcactctgcaatcctgcggcattagcgtgtacgaccaagcagcgtggttcttgggcactatagaaatatgccaagattcgacctcgctgcatccatgcttctctgctcagaggacagcaccgccattttcgaccttgaggaggagagcgaggacatttcgtgggttcttcggccgccgtcgcgccacgccgacgcttcttctgggttcttgttgattgactttccgctgcagtcggagagcttcatcgatgagctcctggagagggaggaggggcacctgcccatggagggctacgcccagcggctcctgcagcaacctggcgggttggatttggtggccgtcaggagcgccgccatcgactggatttggaaggtccatgagcattacaagttcggacctttgacggttgtcttgtctgtgaactacctagatcggttcctctctttgtgcgatcttgcgctaggggaagcttgggtgacacaactcttagcagtgactgtattgtccttggctgcaaaaatggaggaaacaattgtcctagatcctttagacttgcaggcaagtgcagttatagattatgcgacacatcttcatatattatgtgttttctcatttctcaagttgttgaagtcaatggcttgataggtggtcaatgcggaatatgtatttgatcctacgactgtgcacaggatggagcatttggtgctcaataccctgagttggaggatgcaagctgtgactgcttgctcatttattgactactatcttcacaaattcagtgatggtgatgcagtatccgaaatcgtacttgctcgctcaattcaacttatcttgagcacatctaaagctgctgaattcatggcattcaaaccgtcagagattgccgcaagtgtggctcttgtggcattggggaaatatgacagttcaatacttgagagtgtggtgacttgttgcaaacaattaagaaaggagaggatattaggatgctatgaagtgattcaagaaaagattgttatgggaaacattattctcaagtcaactggctctcccgttttccccgagcagcatagccccataggtgtgctgaatgtagctgcatgcgaaagccaacaaaatgatggtgtcagtgtaggaatggctctagtacgcgatgaagctccatcagcaagcaaaaggagaaggatttgcagatgattggtctcatggctaggtgcttcactctccaactattgcttcaagcatgtcaatctaattcagccactcggaagaattggtatgtccaagctgttttgaggattcaaagaagcaagagaaaatatggaccgtgtttgccccccccccccccccccataatggcaaaagccaattgacttgcagcggagttttagtttttttgcagtttacaagagtcttgggcgtgcaaaactatttgatggtccggtgatggtattggttattggctgattggttgaggtagatagcggaattgaaccatgaactccgagtgctgtagatatgagagttcttttgttgcattttgtattcatgctcacttctttgcttttgtgataacctgggagagggatgctttgatgtaggtaatgg

SEQ ID NO: 29501 - protein, 182 aa, Panicum virgatum
  misc_feature: Ceres CLONE 1891748
  misc_feature (49)..(177): Pfam Name: Cyclin_N Pfam Description: Cyclin, N-terminal domain
MLLCSEDSTAIFDLEEESEDISWVLRPPSRHADASSGFLLIDFPLQSESFIDELLEREEGHLPMEGYAQRLLQQPGGLDLVAVRSAAIDWIWKVHEHYKFGPLTVVLSVNYLDRFLSLCDLALGEAWVTQLLAVTVLSLAAKMEETIVLDPLDLQASAVIDYATHLHILCVFSFLKLLKSMA

SEQ ID NO: 29502 - DNA, 1672 bp, Panicum virgatum
  misc_feature: Ceres CLONE 1891751
  misc_feature: Encodes the peptide sequence at SEQ ID NO. 29503
aaccccaccttcgcatcctgcccgtcgcctcgccgtcgaaatccacgccggcgcaacctaggtcaagcctccgccccctctcccccggctccgaccatgtcggcgccctccgaccccgccgcggccgctggccaggcgcccgcccccgcggccgcgtcggccgccgcttcctccagcagcggcctcaccttcaagctccaccccctcgtcatcgtgaacgtctcggaccaccacacccgcgtcaaggcccaggccgcctgctccggggacggctcctcctcgtccggggcggcggcggggcagccaccgagggtgttcgggtgcgtgatcggggtgcagcgcggccggacggtggagatcttcaacagcttcgagctcgtgctcgaccccgtctcgggcaccctcgaccgcgccttccttgagaagaagcaggagctctataagaaggtgttccccgatttctatgtgctgggctggtactccactggaagcgatgtgcatgacactgacatgcaaatccacaaggccgtgagtttttagaaccttttcttcaagtgattaatctgagaaacggcgacattgggctttggcatttagtgtttgctcgtgttatttatgaagaaaatgcgtgtttcatttaatcttagtatagtacttattactgctaatggcaagtagcacctaggaattgttattactatgtggtaggcctattttcaggtgcctactaaaacaagagaacaaactggcttgatgcttgtggaatctgggaattctatcactgtagtattgtaattggtgctgaagcagatgttgatggacgttaacgaaagccctgtttatctactattaaatcctgcaatcaacctctcccagaaggatctccctgtgactatctatgagagtgagttgcatgtcattgacgggagtcctcagctcatctttgtcagatcaaattataccattgagactgtggaggctgagaggatatctgtagaccatgtggcccatctcaaaccatctgatggcggctcagcggcaactcagttggctgctcatcttacaggaatacacagtgccatcaagatgctcaatagcagggtccgagttatccatcagtatcttgttgccatgcaaaaaggtgatattccagtggataattcgctgcttaggcaagtctcaagccttgtaagaaggttaccagctatggaatcacagaaattccaagatgacttcttaatggaatacaacgacactctcctcatgacttaccttgctatgttcactaactgttcaagcacaatggacgagttagttgagaagatcaacacaagctatgagagacctgcaaccaggagaggagggagaggtgctttcatgtagctcacttgccaatcagttactgctgctctcatctgtggagatttttggaaataccttcttgtatcctgaggcaattttttgcatgcaatctattatgcggtatacggctgctctagagttacttcaaactttctagacaaaaatgatgatttcctcgattccgtgccaaatgccacttgtgctgaagctggtctgtaaagctcatcctctccgtagttattctattcaactcgcaaatggatattgatgctggtttgcgatgtcactatggttagcaaaacttgaaacc

SEQ ID NO: 29503 - protein, 190 aa, Panicum virgatum
  misc_feature: Ceres CLONE 1891751
  misc_feature: Functional homolog of the protein sequence given in SEQ ID NO 50926
  misc_feature: Useful for making plants with modulated biomass
MLMDVNESPVYLLLNPAINLSQKDLPVTIYESELHVIDGSPQLIFVRSNYTIETVEAERISVDHVAHLKPSDGGSAATQLAAHLTGIHSAIKMLNSRVRVIHQYLVAMQKGDIPVDNSLLRQVSSLVRRLPAMESQKFQDDFLMEYNDTLLMTYLAMFTNCSSTMDELVEKINTSYERPATRRGGRGAFM

SEQ ID NO: 29504 - DNA, 532 bp, Panicum virgatum
  misc_feature: Ceres CLONE 1891825
  misc_feature: Encodes the peptide sequence at SEQ ID NO. 29505
agtagcctgcctgaccgacccccccagccggaggccgccgcgcgaagcctcttcctccttcgtcctccagcaccggcggcgcgagcacgacgacggtcgtcggcgacaatggtggcggcgtccgcggcggagcggacctacggggcggcggcgcggtcggcgctggcggcgctggaccgcaacctcatcccggacgcgggcacccggcgcctcacgcggctgctgctcgcgcggcgcctccgccagggctacctcccctccgcgccgctgcagctgcagcagctcctccacttcgtccactctctccaagagatgcccattgcgattgaaaccgacgaagctaaagctcagcactacgagctgccaaccatatttttcacgctcgttctcggaaggaatctcaaatacagttgctgctacttccctaacgagtccagcactctggaagatgctgaggttgcaatgttggaactgtactgcgagagggcgaaagtgcacgatggacggagcatccttgatgtcggatgtggat

SEQ ID NO: 29505 - protein, 141 aa, Panicum virgatum
  misc_feature: Ceres CLONE 1891825
  misc_feature: SWISSPROT Homolog: EC 2.1.1.79 Cyclopropane-fatty-acyl-phospholipid synthase
MVAASAAERTYGAAARSALAALDRNLIPDAGTRRLTRLLLARRLRQGYLPSAPLQLQQLLHFVHSLQEMPIAIETDEAKAQHYELPTIFFTLVLGRNLKYSCCYFPNESSTLEDAEVAMLELYCERAKVHDGRSILDVGCG

SEQ ID NO: 29506 - DNA, 718 bp, Panicum virgatum
  misc_feature: Ceres CLONE 1891851
  misc_feature: Encodes the peptide sequence at SEQ ID NO. 29507
  misc_feature (614)..(614): n is a, c, t, g, unknown, or other
  misc_feature (615)..(615): n is a, c, t, g, unknown, or other
attccacccgcggccgcaccaaacccccgtccctaatcatccccccaaccaaaccaaaaccaaaacccaaacaagtcttctcctccccgatccccgacgtcgccggaggcttcgcctgagcagcgtcaacggttgtctaatcaaaaggagcatgaccgcgcttgcgcctccgtcttcctccgtcgccgctgccctcacccgccaaccggcgcggtttttgaaagggtgcagtgtcgccaaggagacaaagggctcggtttgcaacctcttcactccaaattcaaataatgccaaagtaaaatcagtgggcttgagaatatcatcatccttgaaaagggatggtggctatccagctggtggtgcctctgggaacggcgacgtgctattgccaagaagtacttccgtacgtggccaggaccattcggttgctgaccctgtactcccgacagattccatggttgcgccagaaattctctctgctaatctggcacgtgttgcggacaagttcgcagatgaagacacagacactgaacttgatttggatagcccgacagagggctttgcatctattgcagatgccattgaggatatacgacaaggaaaacttgtgattnngtgtgatgacgagtcaagggaaaatgaaggagaccttataatggctgcttccttgggtacctcagaggctatggcttttatagtaggcatgggactgggattg

SEQ ID NO: 29507 - protein, 188 aa, Panicum virgatum
  misc_feature: Ceres CLONE 1891851
  misc_feature: SWISSPROT Homolog: EC 4.1.99.12
  misc_feature (155)..(155): Xaa is any aa, unknown, or other
MTALAPPSSSVAAALTRQPARFLKGCSVAKETKGSVCNLFTPNSNNAKVKSVGLRISSSLKRDGGYPAGGASGNGDVLLPRSTSVRGQDHSVADPVLPTDSMVAPEILSANLARVADKFADEDTDTELDLDSPTEGFASIADAIEDIRQGKLVIXCDDESRENEGDLIMAASLGTSEAMAFIVGMGLG

SEQ ID NO: 29508 - DNA, 660 bp, Panicum virgatum
  misc_feature: Ceres CLONE 1891868
  misc_feature: Encodes the peptide sequence at SEQ ID NO. 29509
acagcaaatcgaattccagtttccaatcctcaaatcctccagcccgctcgccgccgctccgtcacctcccgtccgatggcccgcacgaagcagacggcgcgcaagtccaccggcggcaaggcaccgcggaagcagctggcgacgaaggcggcgcgcaagtcggcgccggcgacgggcggcgtgaagaagccgcaccggttccgcccgggcacggtggcgctgcgcgagatccgcaagtaccagaagagcacggagctgctgatccggaagctgcccttccagcggctggtgcgggagatcgcgcaggacttcaagacggacctgcggttccagtcctcggcggtggcggcgctgcaggaggccgcggaggcctacctggtggggctcttcgaggacaccaacctctgcgccatccacgccaagcgcgtcaccatcatgcccaaggacatccagctcgcgcgccgcatcaggggcgagagggcttaaagcgcctctgatgttcgtccgtcgtcgtggtgttcgtctctctgcggtgggacaactagatgcgtcatgcatggggcgttcgttccttgctgatgtcttgaaataatgttctgaatgtgtttgcctcactgcgatggaatatgatgggtgggttctgaatggctttgttcttgc

SEQ ID NO: 29509 - protein, 136 aa, Panicum virgatum; identical to SEQ ID NO: 10238
  misc_feature: Ceres CLONE 1891868
  misc_feature (58)..(132): Pfam Name: Histone Pfam Description: Core histone H2A/H2B/H3/H4

SEQ ID NO: 29510 - DNA, 912 bp, Panicum virgatum
  misc_feature: Ceres CLONE 1891899
  misc_feature: Encodes the peptide sequence at SEQ ID NO. 29511
agcaaagcgacggccccctcctccagttcccctccaacatactccctagcgaccagatcgagcttttccccggcgtggttaaggtcgttgtcctcggatcgacctcttgtccaaccaaatcgagcatcaatcgcttaaattagaaggtgatggtgctcagattgagcctcctgcgcattcgtccgcaccattttgcgtggatcctgtagcacgccttggttcttctccacgaactaactacacaggaacattctcagtgcagatactgaaatatggcatcaagacgcaatgttcgttacacacctcttcctgtagaggatggggagtacaacaatcctgctaaagaagatgttgatcttcggttcacttacactccaaaatcctacaggaggatcccctggaagtcaattgccctggcattgttcctcctcctccttggaacttcacttctcttcctttcatacttcatattcacaggtcacatggagggtgatagttctcaggcatatggtctcttattcctgggcttcctttccttccttcctggcttttacgaaactcgggttgcttactattcatggcgaggagcaccaggttacacctttgcatccataccagattattagcctctcagttctagccgcctttggtgtgcagtaaagcggcaagagagcagcctggaacttcaactgggaaccaatttcagcgataaacatttagcatgcagatgtagtggttctgctctttgttgtgttaatatcgtactgtattactcatcggccagtgaaagaataatcattattctactgtaaagcgcaaacgctgattttgcacttgatattttctgtgcccattgctgttgcacagctacctcaggaatatgttctacaagtccagtatgtgcttatctgg

SEQ ID NO: 29511 - protein, 117 aa, Panicum virgatum
  misc_feature: Ceres CLONE 1891899
  misc_feature: Functional homolog of the protein sequence given in SEQ ID NO 50657
  misc_feature: Useful for making plants with altered protein content
MASRRNVRYTPLPVEDGEYNNPAKEDVDLRFTYTPKSYRRIPWKSIALALFLLLLGTSLLFLSYFIFTGHMEGDSSQAYGLLFLGFLSFLPGFYETRVAYYSWRGAPGYTFASIPDY

SEQ ID NO: 29512 - DNA, 659 bp, Panicum virgatum
  misc_feature: Ceres CLONE 1891912
  misc_feature: Encodes the peptide sequence at SEQ ID NO. 29513
attcgcctttccgcacccgccgctcggtcgccttcgagttccaccagccaccaaacccgccggggagaagtcgagaggagcaagtagaagaggagatggcccgtacgaagcagaccgcccgcaagtccaccggagggaaagcccctcgcaagcagctcgccaccaaggttcgttcgcgtctctctctcgtgctcctccgttccgatatgctctgttctcgccgagatttggaggttgttgggcgcagttgtcctgagaagcggttgcgatttgttgcgcaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcttacctcgtcgggctcttcgaggacaccaacctctgcgccatccacgccaagcgcgtcaccatcatgcccaaggacatccagctcgcccgccgcatccgcggcgagcgcgcgtaagccgcagccgccgctgccgtacgggtagtggagatgtag

SEQ ID NO: 29513 - protein, 137 aa, Panicum virgatum
  misc_feature: Ceres CLONE 1891912
  misc_feature (59)..(133): Pfam Name: Histone Pfam Description: Core histone H2A/H2B/H3/H4
MLCSRRDLEVVGRSCPEKRLRFVAQAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 29514 - DNA, 3101 bp, Panicum virgatum
  misc_feature: Ceres CLONE 1891917
  misc_feature: Encodes the peptide sequence at SEQ ID NO. 29515
gtccgctccacttgaactccagtactccaccacttcgttcactccacttgacctccattcccaaatgacagggggagaggcgattcatgcagtgggcttcgtcaactctgtgctacgcaaggtgtttgatgtaatcgcgagagacaggaccatgaatagccaagtcaagagaggcctaggtgtcctcaagcgggagatgagtatggtggcatgcgaaatcgagagcaacgaggagaagaaccaaggggcgacacatgagagcaagattgtgcttctgagggacttggcttgtgagatcgaggacttcatagaccttacatgggttccagggagaggctctggctttgtcctctcggcgtttgggatggacccccgaactggaatccttcaaagcatcgaccatttcaaggacagtatccaggctgttcggaattggcaacctgatgccggaggcagccatggcggagacgacggtgctgcgacgtggtcctgctcttcagctacacctactcaatcctatagtcaagaggctgcgttgaggagcatctgcaaacacagagatgaacttggcaggttgctgacagaagccggagggcaagagctgaaggtgatctccatcgtcggttgccgtggcgtggggaagactactctagcaagagcagtctacgaccattgccgtgcctccggtgaattcaattgcgttgcttgggtggtggcaactgagtgccgggatccggaggaccttctgacgaaggttctcaaggaggcacatagtacggctgagcctaccactagagctgcagaagggagcggtatctccgattttgagcaaacaagccttcaatttttcttgcgtgacaaaaggtactttgttgttattgacgatgtggacaatccggaagtgtggcaccatataaaacatgaattccctgaagaaggtcacagtagcagaataattgtcaccacaagtgtccactccgttgcggctcaatgcagctggggcagctatgtgtatacaatgcaatgtttgagcaatgatgagtcagaagaagtattctgggaaacggttggtcaagagaatcggtcacctgtcctacaggatgcttcagaaggcatcatcaagaaatgtggaggtttaccgctggcgctgatcagcgtagctaactatttacgtcaacgaggacgatccgagagtcgcgtggcaggaggactcacaaaagagcactgcaaaagggctgcccgcgcacttggagacaagatactaaaaggtcaggatgccgagtttttgaagattaatacagctcttctccagtgctacaacaaccttcccgactacgtacatcggagctgcttgctttatgccagtgtattctccagaggccgccctattaacagcaatgctctacttagaagatggatgactgaagaattagctgttgcaaatgacaccgtcacagacgaagaaggtgccaagagttgtttagaggtgctcattgagcggtgtatcattgaaccagtaaagatcaacaatgcaagggtagccagatgcagagttcacagtataatgctcgagttcatcatccataaggctatctcaaagaactttgttgctctggttgacaaggatgagctcctgtccagaaagggtgtcggtgtccgccgactcttggttcaggatagcagtaaggaaggagtcgaagatgctgacatagacttgtctattatgaggtcactaacaatctccggaagccctctccttgacctccaagcctgcaagttactgcgtgttctcgatctggaaggttgcaaggggttcaaaaattctgatgtcctcagagccatatgcaaacagcggtttctcaagtacctcagcctcagggagactgatgttgtcctccttccctcagaaatacagtacctagagcatttggaaacactagacattcgggacactggggtggaagttctgcccattgaggtcatcaggctaccactgttggctcacctgtttggccggtttcggctagcccatggaatcaaacaggaaatatcacagaaaagtagattgcagactctggctggagtcgtcgttaccgagccagacaaaagttttgaaaacattatacttcacgccggaaaactgagaaaggtcaagatctgctccaacagctcccgcaataaatggatgaaaatgaactcgtgttgcaattcgcccttgttgcggcttaaggagcgcttcagtggcagcaaagctctccaagttctatcaattgattcaagtgatttctgtacagacttcgtaagcttcttaggggctccctgtgcgatcacatctatcaagctacgggggcaactgaagagtttgcctgatactcctaccctaagggagctgctcggtctaaataagctgctactcatctcgactggtttgcgcattgaagatttatctgcactgcaaaatttatcttgcttggaatacctcaagctagcagaagatcgcgatgggttttggggtggaaggttcgttgtgaagagtggcggattcccaagcctgaggagactgtgcttcgaggccccaaagcttccagaagtccgattcgaagaaggatctatgaagtctctcaccattcttgatctactctgtccatatccagatattccagagccctgtttgtctatgtacttcgttagtttttatcaggtacatcccattgccaacggaagcagcaggcttggcgtcgcaggcgtacagtatcttgacaatctcaacgaggtgatcctccaccactctacgagggaaccaaaagttcaagcttggaaagaggaagcgattaggcacaaaaacaagccatctgtgaagaggcagcaacaaccaatcatccatgcggcataaacgtgaatggttctgtctcctgtaatagaagtgttttattaatatgcttgttttattcactgttcaacatttttgttcaaagtcacctgtaataattgatagaggtaactgcctacctactgcgccctaagtggcaccgtaccgaccagcacagtgtggtttggtcctgttgtattgatcgattgtgatttactattttgagaatttt

SEQ ID NO: 29515 - protein, 942 aa, Panicum virgatum
  misc_feature: Ceres CLONE 1891917
  misc_feature (137)..(462): Pfam Name: NB-ARC Pfam Description: NB-ARC domain
MTGGEAIHAVGFVNSVLRKVFDVIARDRTMNSQVKRGLGVLKREMSMVACEIESNEEKNQGATHESKIVLLRDLACEIEDFIDLTWVPGRGSGFVLSAFGMDPRTGILQSIDHFKDSIQAVRNWQPDAGGSHGGDDGAATWSCSSATPTQSYSQEAALRSICKHRDELGRLLTEAGGQELKVISIVGCRGVGKTTLARAVYDHCRASGEFNCVAWVVATECRDPEDLLTKVLKEAHSTAEPTTRAAEGSGISDFEQTSLQFFLRDKRYFVVIDDVDNPEVWHHIKHEFPEEGHSSRIIVTTSVHSVAAQCSWGSYVYTMQCLSNDESEEVFWETVGQENRSPVLQDASEGIIKKCGGLPLALISVANYLRQRGRSESRVAGGLTKEHCKRAARALGDKILKGQDAEFLKINTALLQCYNNLPDYVHRSCLLYASVFSRGRPINSNALLRRWMTEELAVANDTVTDEEGAKSCLEVLIERCIIEPVKINNARVARCRVHSIMLEFIIHKAISKNFVALVDKDELLSRKGVGVRRLLVQDSSKEGVEDADIDLSIMRSLTISGSPLLDLQACKLLRVLDLEGCKGFKNSDVLRAICKQRFLKYLSLRETDVVLLPSEIQYLEHLETLDIRDTGVEVLPIEVIRLPLLAHLFGRFRLAHGIKQEISQKSRLQTLAGVVVTEPDKSFENIILHAGKLRKVKICSNSSRNKWMKMNSCCNSPLLRLKERFSGSKALQVLSIDSSDFCTDFVSFLGAPCAITSIKLRGQLKSLPDTPTLRELLGLNKLLLISTGLRIEDLSALQNLSCLEYLKLAEDRDGFWGGRFVVKSGGFPSLRRLCFEAPKLPEVRFEEGSMKSLTILDLLCPYPDIPEPCLSMYFVSFYQVHPIANGSSRLGVAGVQYLDNLNEVILHHSTREPKVQAWKEEAIRHKNKPSVKRQQQPIIHAA

SEQ ID NO: 29516 - DNA, 2334 bp, Panicum virgatum
  misc_feature: Ceres CLONE 1891956
  misc_feature: Encodes the peptide sequence at SEQ ID NO. 29517
ggtgtccggcagccaattttccctagtatattccccgcgtccatttcacgcggggcctgcgagctcgctcagcctctcaggagctccagcgaggctggtgcaggccgattcgccgccgtcaggacgtgcgacgcctcggcgcggtggcgccggatctgccagcacatgagcctccatataggagtataggacacacctttcaaggaataggagctgcatcacggctcacaaggagctgaggggacgccatggtgggcaatcgacacaagggtccgacggatgatgagcccgactccggaagcgcaagatcatctgatgacatggctccagacgaccgccgttttggggatgggagcacgggaacattttcatccccatggtgtacaaatccaccccaaataccattcccgttcatcgctcctcatttctcgatcccgtcgtcccgggaacttggtagtacgtcccggaaacttggttactgcgttccagacaaagctaaacgtaggaaacgacagactcggtcttcaataaatgctatgacaaatgagggcaaagacatcatgaggctgctagcagaactcaaggaccagatgcgcgaacaatcaatgcagcttactgaaagtaatagtgaaatacgcaagcagatggggaatcttattgaaagtcaaaatggtcaaagcaaagtgttggagaagcttattgaaagtcagaatggccaaagcaaagagttggagaagcttactgcaagtatcaggaaacaattggagtttcatactaacatcacaggtcatgctgaatctgatgctccaagatcacaaatgaatcaagtgccgccacctagataccgactggaattcagatctgcgcctactggcaaaataataacggggaaaaccataaagataagtgtagctctagttgaagttagtagtggtcgacccgtagaaaatggaccccttgcttccggaacagttgagttggttgtcgttaacgcagagttcaatcaacataataatcgatactattggcccagagaggattttgagagcaacataacaaaaccacgacgtgggaattcggcaacagggggtgtggaccagtcagtaaaatcaatagtgagtaacggccgatttaaccttaatcgaggggttataagttacagtggttctgcaatatttgaaaactcccacaacaggaaggttaggcttggggcgatgctagtgttgccaactggggaacgagttctggaagcattatcagatcctttgttagtgcgggaccatgtccagtcaggaaaacaaagtaacttgcaccctaacagctcaaatggacaaaggcaaggtctaggtgacaatgattatcaagaagaaaatagctcaaggcctaacatgcaacaaccatcatggccaaattcaactcatactgggggaatcagatcaaatataattggaggacaatcacagcttccatttctaggaacctctaatatgctttctacagaaccatttaccagtcaagaacaacagtcttctatacaacaataccaaagtcctcgtgtgccaatggtggcccaagctacatacaaccaaaatggatcgaatataattggaggacaatcacagcttccatttctaggaacctctaatatgctttctacagaaccatttaccagtcaagaacaacagtcttctatacaacaataccaaagtcctcgtgtgccaatggtggcccaagctacatacaaccaaaatggatcgaatataattggaggacaatcacagcttccatttctaggaacctctaatatgctttctacagaaccatttaccagtcaagaacaacagtcttctatacaacaataccaaagtcctcgtgtgccaatggtggcccaagctacatacaaccaaaatgataccacgctcggtttctctcggcccagtaccccaccccgcacgttatcggcccaaacgatgctgccagcctagccttccagtctgttaccccgtaatttcacccgggccatttcccctccggcggcggcgcttgggctcgccggcgatgcacctggccgcagagggagtgtgggaacatcgccgccttccgtcgacgccagctcgagctctacgatacgtacgtggacagatgcgggcaacggaatggctctgacttctgtctgctaccctgctgggaaaataaaaacattatgcactgcttactgctacacgtactaaaccagcgacgttgcttaatttcttgttaatttgccttctttcgatgcaaatgtttacactgtcgaatctccaaacctgctcatggtttcttttcatgctgttt

SEQ ID NO: 29517 - protein, 578 aa, Panicum virgatum
  misc_feature: Ceres CLONE 1891956
  misc_feature (195)..(548): Pfam Name: Calmodulin_bind Pfam Description: Calmodulin binding protein-like
MVGNRHKGPTDDEPDSGSARSSDDMAPDDRRFGDGSTGTFSSPWCTNPPQIPFPFIAPHFSIPSSRELGSTSRKLGYCVPDKAKRRKRQTRSSINAMTNEGKDIMRLLAELKDQMREQSMQLTESNSEIRKQMGNLIESQNGQSKVLEKLIESQNGQSKELEKLTASIRKQLEFHTNITGHAESDAPRSQMNQVPPPRYRLEFRSAPTGKIITGKTIKISVALVEVSSGRPVENGPLASGTVELVVVNAEFNQHNNRYYWPREDFESNITKPRRGNSATGGVDQSVKSIVSNGRFNLNRGVISYSGSAIFENSHNRKVRLGAMLVLPTGERVLEALSDPLLVRDHVQSGKQSNLHPNSSNGQRQGLGDNDYQEENSSRPNMQQPSWPNSTHTGGIRSNIIGGQSQLPFLGTSNMLSTEPFTSQEQQSSIQQYQSPRVPMVAQATYNQNGSNIIGGQSQLPFLGTSNMLSTEPFTSQEQQSSIQQYQSPRVPMVAQATYNQNGSNIIGGQSQLPFLGTSNMLSTEPFTSQEQQSSIQQYQSPRVPMVAQATYNQNDTTLGFSRPSTPPRTLSAQTMLPA

SEQ ID NO: 29518 - DNA, 569 bp, Panicum virgatum
  misc_feature: Ceres CLONE 1891957
  misc_feature: Encodes the peptide sequence at SEQ ID NO. 29519
accggccggccacctccatctcgctcgtagccgtgtcgagctccggcgccgccggcgacggcgccgcgaagaacccggccatggagcccgacacggacgcgccggcgggggagggcctggagctggcgcagttcgcggcggggtgcttctggagcgtggagctgacgtaccagcggctccccggtgtggcgcgcacggaggtgggctactctcagggccaccgcgacgcgcccacgtacgagctcgtgtgcgcccacggcacgggccacgccgaggtggtgcgcctgcactacgaccccgcggcgtgtccctacgccaagctcctcgactcgttctgggcctggatcgacccctccacgctcatcaggtagggtgaggacgtcaggactcactaccggacggggatctactactactcggcagagcaggacaggctggcgcgggagtcgctggcggagcagcggaggaagtgggatggctagatcgtcaccgagatcctgccggcgaagcggttctgccccgccgaggagtaccaccagcgctacctcgagaagggcggccagtctgcg

SEQ ID NO: 29519 - protein, 122 aa, Panicum virgatum
  misc_feature: Ceres CLONE 1891957
  misc_feature (40)..(122): Pfam Name: PMSR Pfam Description: Peptide methionine sulfoxide reductase
  misc_feature: SWISSPROT Homolog: EC 1.8.4.11 Peptide-methionine-(S)-S-oxide reductase
  misc_feature: Functional homolog of the protein sequence given in SEQ ID NO 50429
  misc_feature: Useful for making plants with modulated flowering time
RPATSISLVAVSSSGAAGDGAAKNPAMEPDTDAPAGEGLELAQFAAGCFWSVELTYQRLPGVARTEVGYSQGHRDAPTYELVCAHGTGHAEVVRLHYDPAACPYAKLLDSFWAWIDPSTLIR

SEQ ID NO: 29520 - DNA, 513 bp, Panicum virgatum
  misc_feature: Ceres CLONE 1891992
  misc_feature: Encodes the peptide sequence at SEQ ID NO. 29521
accacgaatgcatctcatccccagactgcaggccgccgccgcccacctcccgcgccgaccgctgccgccggcagcctcccgcgtcgaccgccgctgccggcagcctcctgcgccggccgcatccacccacgcctcgagctcccattgtgggccggccgcttctgcccgcgattcgagctcccgccgccggccggccgcctccggcccaactcgagctcccgcgccagaggagagggggaagggagcagtggcggaggtggagggaggagcggcagaggaggtgacggtgggggaaaacggaggggggtcggcgagggaagagggaggggatggggtggcgggctgggggagagaagggagggtaggcttcgtcttccgcgagaacgccacttcccccgggtactacgacggccgctactggaccatgtggaagctgcccatgttcggctgcaccgacgccacccaggtgtacgccgagctcgaggagtgcaagaccgcctaccccaacaacta

SEQ ID NO: 29521 - protein, 168 aa, Panicum virgatum
  misc_feature: Ceres CLONE 1891992
  misc_feature (93)..(168): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MHLIPRLQAAAAHLPRRPLPPAASRVDRRCRQPPAPAASTHASSSHCGPAASARDSSSRRRPAASGPTRAPAPEERGKGAVAEVEGGAAEEVTVGENGGGSAREEGGDGVAGWGREGRVGFVFRENATSPGYYDGRYWTMWKLPMFGCTDATQVYAELEECKTAYPNN

SEQ ID NO: 29522 - DNA, 2403 bp, Panicum virgatum
  misc_feature: Ceres CLONE 1892021
  misc_feature: Encodes the peptide sequence at SEQ ID NO. 29523
atacggattaatcgattgatccccggggcctctcgttcctcggttcctccccttcaccaaggcaagtacagccgccggacccaccgatcgccccctccctcgcggcggcggcggcggcggagatggggctggtggtgccgccggaggagaccgaccggtgcgtgcgcgggtgctgccgcagcgccgccatcccgctcccctcccgcccgcctccttctccctcctctccccaatcgcgcgagggtcggagagcacggtgtacgaggctcggctggccggcgagcgcgtcgcggccaagaagcccatgctgtccacgtccgaggacctcgacaagttccactaccagctccagctcctctgtgagctggatcacccagggttggcgaaactgatcgcagcacatgcacaccctccaaattatttgatgttttttgatttcttcgagcctccaaaccttgcggacaagattcatgttgaagaatggagcccttctgtccagcaagtggtggccattgccagcgatctagcaaaggctctccagtacctacacatccttggggttgttcacagagatataaaacctgcaaatattttgctagacaaagacctccatccacacctagcagattttggcttagccatgtttcagaaggatattaagcgtgtctcagttgagaactggaaatcatctggcaagcccactggtggtttccataaaaaaaatatggttgggacactaatttacatggcaccagaaattttgagaaaggatatacatacagaaaagtctgatgtatatagcttcgcaatatctatcaatgagcttcttactggtgtggtgccttatacagatctgcgagcagaagcacaggcacacactgttcttgaaatgacttacactgaacaacaacttacagcagcagttgtttctcaaggattgcgccctgcacttgcccttccaaaatctggtgttccattggttctttcgtcacttatccagcgttgctgggattccgatcctgaaaagagaccatcgtttgaaaatataattgatgagctaaatataatccaaaagcatttagtttcaagtgcttgctttccatcatctcctgtgagcaagagtcaaaatggcaacatagaagcacaccattataaagaagcattaaactggtttaaccaaggggagctttttgttaagagatcagaaaaatcggatcttacagagaatgtttggtctggctattccaatcagtcctcagagtatcatccaacattaagttggggatcttttgcaacatgtggtcgaagggaaactatggaagatacccattttatgcttccccatgtgagcgaagaaaaggatgtttttgcctttggcatttttgatggtcacagaggttcagcagctgctgagttttctgtccgagctgtccctgggtttctgaagcaatttggtcagggtacaagcccaattgatacccttgcagaagcatttgtaaggacggacatagcatttcgagaagaactaattcttcaccaaaagtcaaaaaggataatccaaaaagaatggcatcctggttgcacagctgtgacagccctagtagtgagaaacaagctttttgtagcaaatgctggtgattgccgggcaatcctaagccgtgctggtaaaccatttcccatgaccaaggatcatgttgccagctgtccgaaggaaagagagcgcgtaataaaagctggaactgaagtaaaatggcaaatagatacgtggcgtgtgggtacagctgctcttcaggtcacaaggtcaattggtgatgatgatctcaagccagcagtcacagcacaacctgaggttactgaaactgctttgtcagatgatgatgagttcctggtgatagctagtgatggcctgtgggatgtggtaagcaacgaggatgtgctgtcaataatcaaggacacagtaaaagagcctagaatgtgctccaagaggctggctacagaggctgcagagcgcggcagcaaagacaacatcactgtcattgttgtgttccttcgccctgtctccacagctgagcgaatatactgagtgaccaccaaaactcttgctcatgctatcagctcactattttttaattaaatttaaatcggtacagaagaaaagaagttacacattcattctgaacgtatgcagtttttatcctgtcgaggataaaaagaacaaagcatgtcaagatagcagcctcagttgcaatttttttctgtcttttgcaatatctcatttgtaaacgagccaaacggatgagcatacaaaagttctttttctttctttctttctttctttcttttcctgttgtaaagcagaacacacaacgaataatctctaatagaagtatactagttgggtac

SEQ ID NO: 29523 - protein, 592 aa, Panicum virgatum
  misc_feature: Ceres CLONE 1892021
  misc_feature (324)..(575): Pfam Name: PP2C Pfam Description: Protein phosphatase 2C
  misc_feature (1)..(252): Pfam Name: Pkinase Pfam Description: Protein kinase domain
  misc_feature (333)..(589): SWISSPROT Homolog: EC 3.1.3.16 Phosphoprotein phosphatase
  misc_feature (14)..(248): SWISSPROT Homolog: EC 2.7.11.1 Non-specific serine/threonine protein kinase
MLSTSEDLDKFHYQLQLLCELDHPGLAKLIAAHAHPPNYLMFFDFFEPPNLADKIHVEEWSPSVQQVVAIASDLAKALQYLHILGVVHRDIKPANILLDKDLHPHLADFGLAMFQKDIKRVSVENWKSSGKPTGGFHKKNMVGTLIYMAPEILRKDIHTEKSDVYSFAISINELLTGVVPYTDLRAEAQAHTVLEMTYTEQQLTAAVVSQGLRPALALPKSGVPLVLSSLIQRCWDSDPEKRPSFENIIDELNIIQKHLVSSACFPSSPVSKSQNGNIEAHHYKEALNWFNQGELFVKRSEKSDLTENVWSGYSNQSSEYHPTLSWGSFATCGRRETMEDTHFMLPHVSEEKDVFAFGIFDGHRGSAAAEFSVRAVPGFLKQFGQGTSPIDTLAEAFVRTDIAFREELILHQKSKRIIQKEWHPGCTAVTALVVRNKLFVANAGDCRAILSRAGKPFPMTKDHVASCPKERERVIKAGTEVKWQIDTWRVGTAALQVTRSIGDDDLKPAVTAQPEVTETALSDDDEFLVIASDGLWDVVSNEDVLSIIKDTVKEPRMCSKRLATEAAERGSKDNITVIVVFLRPVSTAERIY

SEQ ID NO: 29524 - DNA, 652 bp, Panicum virgatum
  misc_feature: Ceres CLONE 1892041
  misc_feature: Encodes the peptide sequence at SEQ ID NO. 29525
aaaagaaaaaggaaaaaaattcgcacgcgacgacgcgacggagaagcggggaggggaagcagcagacggcagcgagagaaatccccaccagcctccaaaccctaaccagctcccccgtcgtcctccagatctcgcttccgtccgccccgactcgatgtgacccggccctagggtttgagacggtgcggcggtgagggctcttcgcgggggtttgggattcgtgacgcgaggaaggggggcccgcggtggcgacggcggcgcgggcgcacatgaaggacccggctcaccgcaccaaggtggtgctccggcggctgccgccggcgatcgcccagcaggccgtcgtggaccaggtcgacgcgcgcttcgccgggcggtacgactgggcgtgcttccgccccggcaatgccagccaaaagaatcatagatattctcgactctaccttaacttcaagcacccagaggatgttgttgagtttgctgaggtcttcaatggacatgtatttgtgaatgagaagggtgctcaatttaaagctcttgtggaatatgcaccatcgcaacaggttcccaaaaatatcaagaaggatagccgtgaaggaactattgtgaaagatccggaatacttagagtttcttgagcttatttcaaagcttac

SEQ ID NO: 29525 - protein, 127 aa, Panicum virgatum
  misc_feature: Ceres CLONE 1892041
  misc_feature (1)..(127): Pfam Name: Smg4_UPF3 Pfam Description: Smg-4/UPF3 family
MKDPAHRTKVVLRRLPPAIAQQAVVDQVDARFAGRYDWACFRPGNASQKNHRYSRLYLNFKHPEDVVEFAEVFNGHVFVNEKGAQFKALVEYAPSQQVPKNIKKDSREGTIVKDPEYLEFLELISKL

SEQ ID NO: 29526 - DNA, 1400 bp, Panicum virgatum
  misc_feature: Ceres CLONE 1892055
  misc_feature: Encodes the peptide sequence at SEQ ID NO. 29527
atcttcctcccttcgctcccccagcatccgtgcgccgccctccacgctctccagcccagctgcagctcgagtccggctggtgcgacagcaccctcccttcccacgacttctccgttctttttctcggcctcggtcttcctttcctagcggcggcgacagtgcgagttgcgctgcccgttgttcgtctagcgacgggcgttcgccggcgacggacatccgacagggctatgtcctatactggttccgcccctggcgcctgcaccggaagtgtcatcggatcgtacgcagtttcggtgcaggaacttttggttatagatgatttgctatcagctctggtgggtattgagggacgatatatttctattaagatagttcatggaaaggagggccctgttgtcttccagattgattcttcaatggaccttgccctccaggtattaactcgtagaatattccctttgtgtgaggattatgtgctggtaagacaatttgtggagtcaaggtcacatttcaagaatggtctggtcaaccatgctctggctgcagctctaagagcattcctactggattatcaggcaatggtcgctcaactggagcaccagttccgccttggaaggctttctgttcagggattatggttcttttgtcagaggatgatgagttcgttgaatgcattggcagttctagtggagaaggctactttcaacaataccagtggttctgcaactcttaatctacttcaaagccaggcaaaggcgatgggtggtgatagtgctgtccggtctttactggagaagatgacagaatatgcaagtgcagcatacctcaggatgctagaaaggtgggtgtatgagggagttattgatgatccttatggtgaattcttcattgctgaaaacaaatctctgcagaaggagagcctcactcaagattatgatgccaaatattggcagcaacgatacagcttaaaagaaggaattcccagtttccttactaatgttgccgcaatgattctgacaacaggaaagtatcttaatgttatgagagaatgtggacacaatgttcaggtttccttagaaaattctaagcttatgagctttggttcaaatcaccaatatcttgaatgtatcaaatctgcatatgattttgcaagtggtgaattgttgactctgatgaaagataagtatgatctcattgggaaactgcgttccctgaagcgctatctactccttgaccaaggtgactttttggtccattttatggatattgctcgagaggagcttatgaagaaaccagaggaaatatctgctgaaaaacttcagtctctgcttgacattgctttgcggagtacggcggcttcttctgatccaactcatgaagaattaatttgctgtgtggaa

SEQ ID NO: 29527 - protein, 390 aa, Panicum virgatum
  misc_feature: Ceres CLONE 1892055
  misc_feature (28)..(390): Pfam Name: Spc97_Spc98 Pfam Description: Spc97 / Spc98 family
MSYTGSAPGACTGSVIGSYAVSVQELLVIDDLLSALVGIEGRYISIKIVHGKEGPVVFQIDSSMDLALQVLTRRIFPLCEDYVLVRQFVESRSHFKNGLVNHALAAALRAFLLDYQAMVAQLEHQFRLGRLSVQGLWFFCQRMMSSLNALAVLVEKATFNNTSGSATLNLLQSQAKAMGGDSAVRSLLEKMTEYASAAYLRMLERWVYEGVIDDPYGEFFIAENKSLQKESLTQDYDAKYWQQRYSLKEGIPSFLTNVAAMILTTGKYLNVMRECGHNVQVSLENSKLMSFGSNHQYLECIKSAYDFASGELLTLMKDKYDLIGKLRSLKRYLLLDQGDFLVHFMDIAREELMKKPEEISAEKLQSLLDIALRSTAASSDPTHEELICCV

SEQ ID NO: 29528 - DNA, 693 bp, Panicum virgatum
  misc_feature: Ceres CLONE 1892055-R
tgttgtcgcctgaactccttgtgaaagttgagaagctgaaagctttatgccttcaatatgccacttccatccagctcttgatgccatccatcgaagttgccaactccgagaatacatcgaaggccgggaagtcaaagtcaaggacaaatatatcgcaggacagagaccagcagctgaaactggcatcagagaatgtcgtcatgtcagagtcaatcctgaaattcgaagcggcgttcaattcagagctccagagccttgctcccacactgagcaacagttcacacgcggagccgtacctgacccatctcgcgcagtgcatccttggtgtccgaatggaccaatgaattgcctgatgcggaccgtgctcattggactcggtacaaggtcattaccctccagggtggcactgcccggcccgatcaagatctgtgcatgtacttgtgatagattatagataggccagtaggatctagtattctagtgagccacggatggtgcctttgttggtgcgggcgtgtcagctgtttgattgtcttggcgtgtttatcagctgtgattcagcattgccggtgcggctcgtgtctgaagattgccatgtgcgatgtcttggccatgtatcatgtgcattgtaggcgacagacatgttggtcggcgtgtaagcttgaattgatatattttgcttagtcgaggctc

SEQ ID NO: 29529 - DNA, 627 bp, Panicum virgatum
  misc_feature: Ceres CLONE 1892071
  misc_feature: Encodes the peptide sequence at SEQ ID NO. 29530
actgtccaggctgaagctatattgacggccttaaatggtgtggcttcttcaagcaataacaattcaaaggatgatggttgggcatcctcagatgatgagactgatgctatggaacaagaggatgatccagaagctgacacagcaaggttgagtttcaaggagcatcgtcgtgcacactacgatgagtaccgcaaagttaaggaactgatgcgcactgggtcccttgttgaggatgaggctgacgagaataacagggttgataatagcagtgaaggcaagggtatggggaaaggtgccgcagttgaggacagaaaaccctcagcgcaaacatgagagttgagatggtcctgttctctctgttgttcactaagataggcaaagccatcacggcagctgaagcttgctgtttggcgtatgttggatccatggtttcgggttaggtggttttctgtaagcaaagcagctgttacctcctattttgttttgaggtgccggtgtccctaaaatggcagtgctgactgaaaattacagtggagttggctccttgctcgttattatgccatttagtggctcttttacattttcaatcaacgaatatgttgtggctagagtgaactgcttgatgct

SEQ ID NO: 29530 - protein, 110 aa, Panicum virgatum
  misc_feature: Ceres CLONE 1892071
  misc_feature: SWISSPROT Homolog: EC 5.2.1.8 Peptidylprolyl isomerase
TVQAEAILTALNGVASSSNNNSKDDGWASSDDETDAMEQEDDPEADTARLSFKEHRRAHYDEYRKVKELMRTGSLVEDEADENNRVDNSSEGKGMGKGAAVEDRKPSAQT

SEQ ID NO: 29531 - DNA, 424 bp, Panicum virgatum
  misc_feature: Ceres CLONE 1892088
  misc_feature: Encodes the peptide sequence at SEQ ID NO. 29532
acctcctcgaccccgcgcgtgctgggtgatcagacctcgtccaccccagctcgagctccatcgtctgttgaggagcctaagatgagcgtggatatcctcgacgggagcacggtccggagcttcgtggaggacgagggctgccttcaactcctccgtcgacggccgcttcggcgcgctggaggcggaccgggacggcctgctcacgtacgcggagatggccggcgagctcttgagcctccgggtgctggacaggctcttcgtgcgtggactgaggcggcggcgcgggccggcgagctcggcgcgctgtgccgcggcctgttcgtgcggttcgacaggaacagcagcggtcaggtggatcgggacgagttccgggcggggatgagggaggtgatgctcgccgtgtccgacggtctctgcttcctcc

SEQ ID NO: 29532 - protein, 114 aa, Panicum virgatum
  misc_feature: Ceres CLONE 1892088
  misc_feature (75)..(103): Pfam Name: efhand Pfam Description: EF hand
MSVDILDGSTVRSFVEDEGCLQLLRRRPLRRAGGGPGRPAHVRGDGRRALEPPGAGQALRAWTEAAARAGELGALCRGLFVRFDRNSSGQVDRDEFRAGMREVMLAVSDGLCFL

SEQ ID NO: 29533 - DNA, 673 bp, Panicum virgatum
  misc_feature: Ceres CLONE 1892115
  misc_feature: Encodes the peptide sequence at SEQ ID NO. 29534
acggatccatccatctctcctttgctctttcccttcaattcaatcgtctcacagaactctttccgagagatcgagacaatccggcggcggcgggttccgctccagggacacctacctcttcgcgcgcgccgacgtgcagatcaagctcgtccccaacaactccgccggcaccgtcactaccttctacttcatctcggaggggccgtgggacgtccacgacgaggtggacctcgagttcctgggcaacgtgagcgggcagccctacacgctgcacaccaacgtgttcgccggcggcagcggcggcaaggagcagcagttccacctctggttcgaccccaccgccgacttccacacctactccatcgagtggacgcagcagcacatcctcgtgctggtggacgggacgccgatccgggagttcaagaaccacgcggaccgcggcgtggcgtacccgtcgacgcagcggatgcggctgtacggctcgctgtgggacgccgaggactgggccacgcagggcggccgcgtcaagacggactggtcgcacgcccccttcgcggcgcagtaccgcaacttcacggccgcggacgcctcctcctcctcggcgtcgccggcggcggcgggcgggtacgggcaggagatggacgcggcggcgcagcagggcatgaagtgggcg

SEQ ID NO: 29534 - protein, 223 aa, Panicum virgatum
  misc_feature: Ceres CLONE 1892115
  misc_feature (2)..(181): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50386
  misc_feature: Useful for making plants with altered carbohydrate content
  misc_feature: Functional homolog of the protein sequence given in SEQ ID NO 50992
  misc_feature: Useful for making plants with altered cell wall content and/or composition
  misc_feature: Functional homolog of the protein sequence given in SEQ ID NO 50905
  misc_feature: Useful for making plants with altered lignin content
RIHPSLLCSFPSIQSSHRTLSERSRQSGGGGFRSRDTYLFARADVQIKLVPNNSAGTVTTFYFISEGPWDVHDEVDLEFLGNVSGQPYTLHTNVFAGGSGGKEQQFHLWFDPTADFHTYSIEWTQQHILVLVDGTPIREFKNHADRGVAYPSTQRMRLYGSLWDAEDWATQGGRVKTDWSHAPFAAQYRNFTAADASSSSASPAAAGGYGQEMDAAAQQGMKW

SEQ ID NO: 29535 - DNA, 867 bp, Panicum virgatum
  misc_feature: Ceres CLONE 1892123
  misc_feature: Encodes the peptide sequence at SEQ ID NO. 29536
aagaagagctaagccagttcaggaggaacaacaatcaggtaggtagcagcaacggatcatcagtcgccatggcggccacgagtgctgccaagagcctgctgctctgcttggcagcagtcgcctttcttcaccacctccagtttcagtccccggctgtagccgcaacatcgctcggcaaaaacggtagcagggccggcggcggccacgggaggaccctcagcctcacgctgtaccagcaggagaccatcaacaagaccgggtacatcgtcgtcgacggcgtggccggcgcgggcgtcaacgagaccaccacgccgttcggcaccatctacgtcttccgcgacgacctcacggtgcgcgccgaccgggcctccccggtggccggcgtcgcggaggggagctccatcaccaccaccctcgacgggctgcagagcctgtcgctgggcaagatcaccgtcgaccacgccggccaccggggctccgtgtccgtcctcgggggcacctacaacaccaagccgtccgactaccccgtggtgggcggcaccggcgacttcgcctacgcgctgggctacgtccggtcgacgccggtggacctgcggggacgaacggtgacgtacaagacggagcttcacttgtactggccgccgtacgcccactacgctcctgttccacacaagcccgtatagactatagtatacgtgaatacgcatcatctacgccgttctaaaaaatctctggtcctactgtatttttaaaattaaagtaagtatatatgtaggagtatagaatttgcattgatagtagcagtatatatacggtggtgtattttttcctattttttggatcgaaataaaggagcagcgtgagcgt

SEQ ID NO: 29536 - protein, 204 aa, Panicum virgatum
  misc_feature: Ceres CLONE 1892123
  misc_feature (19)..(190): Pfam Name: Dirigent Pfam Description: Dirigent-like protein
MAATSAAKSLLLCLAAVAFLHHLQFQSPAVAATSLGKNGSRAGGGHGRTLSLTLYQQETINKTGYIVVDGVAGAGVNETTTPFGTIYVFRDDLTVRADRASPVAGVAEGSSITTTLDGLQSLSLGKITVDHAGHRGSVSVLGGTYNTKPSDYPVVGGTGDFAYALGYVRSTPVDLRGRTVTYKTELHLYWPPYAHYAPVPHKPV

SEQ ID NO: 29537 - DNA, 682 bp, Panicum virgatum
  misc_feature: Ceres CLONE 1892171
  misc_feature: Encodes the peptide sequence at SEQ ID NO. 29538
ctggagttgggggcatatttaacgaggaggttctcaaggctatgaaagaatctgattctccacgccctgcaatttttgcaatgtccaacccaactactaaagctgaatgtacacctgatgatgtattcaagcatgttggagagaatgcgatatttgctagtggaagcccattcagtaacgtttctttaggaaatggtaagacaggctatgctaatcaagcaaacaacatgtatctatttcctgggattggtttaggagctctcctttcaggtgctcggcatatttcagatgacatgcttcaagcaggagctgagtgcctcgcatcatatatcacagatgatgaaattcaaaaaggaatcctcttccctgaagtctccagtataaggcacatcaccgcacgtgtcggcgcagcagttgtccgtgccgccgtcgctgaagacctggctgaggggtaccgcactgtgggtcctaaggagcttggaagcgtgtcagagtcgcaaacggtggactacgtcgctcggaatatgtggtaccctatttacagcccccttgtgaacaacaaataaatcggcaaaatctcacggctgcaccgaagcagatgtccctgacattccacccgaaagaatataccagacttaggcatttgttttggctacttgttacaactaaagctttgctcaat

SEQ ID NO: 29538 - protein, 187 aa, Panicum virgatum
  misc_feature: Ceres CLONE 1892171
  misc_feature (1)..(143): Pfam Name: Malic_M Pfam Description: Malic enzyme, NAD binding domain
  misc_feature: SWISSPROT Homolog: EC 1.1.1.39 Malate dehydrogenase (decarboxylating)
GVGGIFNEEVLKAMKESDSPRPAIFAMSNPTTKAECTPDDVFKHVGENAIFASGSPFSNVSLGNGKTGYANQANNMYLFPGIGLGALLSGARHISDDMLQAGAECLASYITDDEIQKGILFPEVSSIRHITARVGAAVVRAAVAEDLAEGYRTVGPKELGSVSESQTVDYVARNMWYPIYSPLVNNK

SEQ ID NO: 29539 - DNA, 687 bp, Panicum virgatum
  misc_feature: Ceres CLONE 1892190
  misc_feature: Encodes the peptide sequence at SEQ ID NO. 29540
ataaccaaagacgccgttgtgcgggagacgaagagggaaagtgaagagcagcgtcggactagtgagccatgctcgcctcgccggcgctcgccggcgcgcactccttcgcggcgtccgtgtccggcagcctccgcgtccccctaccttccgtccccgcgccctcgccggcgccggcgcggcgcgcggcgctgtccgtcgtcgccaaggtcaaggtgcctacgccccaggacgaccgcatcgcccgccatgtccgcctccggaagaaggtgagtggcaccacggagaggcccagactgagtgttttccgctcaaacaagcatttgcacgctcaagtcattgatgatacaaagcaatgcactttggcttcggcttcaaccatgcacaaatctctctccaaggaattggaatactccgctggaccaacaatcgaagtagcacaaaagattggtgaagtgattgccaagtcttgcctggagaaaggaattaccaaagttgtcttcgaccgaggtggtttcctctaccacggccgcataaaagctcttgctgatgctgctagagagcacgggcttgagttctgaatctttaccccgaatgttcatatttcaatgatcaccctgtatcttttcttttcaccccctcgatgttgaacagagtttgtagtcacctgccttgttttgcagagtgcag

SEQ ID NO: 29540 - protein, 169 aa, Panicum virgatum
  misc_feature: Ceres CLONE 1892190
  misc_feature (51)..(169): Pfam Name: Ribosomal_L18p Pfam Description: Ribosomal L18p/L5e family
MLASPALAGAHSFAASVSGSLRVPLPSVPAPSPAPARRAALSVVAKVKVPTPQDDRIARHVRLRKKVSGTTERPRLSVFRSNKHLHAQVIDDTKQCTLASASTMHKSLSKELEYSAGPTIEVAQKIGEVIAKSCLEKGITKVVFDRGGFLYHGRIKALADAAREHGLEF

SEQ ID NO: 29541 - DNA, 641 bp, Panicum virgatum
  misc_feature: Ceres CLONE 1892212
  misc_feature: Encodes the peptide sequence at SEQ ID NO. 29542
caacgaaatttcaaaaaaagaatagcctactcctccgtatctcatatgggtttcataattataggaattggttccataaccaacattggactaaatggagctattttacaaatattatcccatggatttatcggtgctacactttttttcttggcgggaacggcttgtgatagagtgcgtcttgtttatctcgaagaactggggggaatatctattccaatgccaaaaatttttaccatgtttagtagcttttcaatggcctctcttgccttgccaggaatgagcggttttgttgcagaattagtagtattttttggactaattactagtccaaaatttatgttaatgccaaaaatgctaattacttttgtaatggcaattggaatgatattaactcctatttatttattatctatgttacgccagatgttctatggatacaagctatttcatgttccaaacgaaaattttgtggattctggaccacgggaactatttcttttaatctgtatctttttaccagtaataggaattggtatttatcctgattttgttctctcgctatccgttgacagggtggaggctctattatccaattattatcctaaatagaattttctttttttaactagtccgctcta

SEQ ID NO: 29542 - protein, 188 aa, Panicum virgatum
  misc_feature: Ceres CLONE 1892212
  misc_feature: SWISSPROT Homolog: EC 1.6.99.5 NADH dehydrogenase (quinone)
MGFIIIGIGSITNIGLNGAILQILSHGFIGATLFFLAGTACDRVRLVYLEELGGISIPMPKIFTMFSSFSMASLALPGMSGFVAELVVFFGLITSPKFMLMPKMLITFVMAIGMILTPIYLLSMLRQMFYGYKLFHVPNENFVDSGPRELFLLICIFLPVIGIGIYPDFVLSLSVDRVEALLSNYYPK

SEQ ID NO: 29543 - DNA, 445 bp, Panicum virgatum
  misc_feature: Ceres CLONE 1892254
  misc_feature: Encodes the peptide sequence at SEQ ID NO. 29544
atcacgggaaaggagaagggaagagaaggctctcgggcctacctttatcccgacggagcatgatcacaggcctcaccttaagcttcgtcttgcatggcattcacgcgcgccaggggctgctgctgtccctcgctgctgggggcgccccgggcgacgtcgcgcggctcgtcgccccgctcgcacgcggcgctcctcggcatcggtctccacctccgcgttccgcagctcccgggcgcccgaggcagccatggaggccccgcggtggcaccgcgcggccgcgtctaccggcatcgtctgcggctgggcgagctacggctgcgtgtcatccaacttcaccctcgaggaccagaacgagagacccgtgtcactgaacaatatcatgggcaagccggtggtggtctacttctaccatctcgactgagacactcggatgcaccatacatgc

SEQ ID NO: 29544 - protein, 139 aa, Panicum virgatum
  misc_feature: Ceres CLONE 1892254
  misc_feature: SWISSPROT Homolog: EC 1.11.1.15 Peroxiredoxin
SRERRREEKALGPTFIPTEHDHRPHLKLRLAWHSRAPGAAAVPRCWGRPGRRRAARRPARTRRSSASVSTSAFRSSRAPEAAMEAPRWHRAAASTGIVCGWASYGCVSSNFTLEDQNERPVSLNNIMGKPVVVYFYHLD

SEQ ID NO: 29545 - DNA, 649 bp, Panicum virgatum
  misc_feature: Ceres CLONE 1892263
  misc_feature: Encodes the peptide sequence at SEQ ID NO. 29546
atcaagccatcaccaagcagcagcacccaaacttgctgtggttggagttggagcacagcagcagcacaaagccctctcgtcctcgtgcctgcctcctttccctcctcgttgagccgccgcccgttgccgtcgttgctggtccagttcggccggccgcggcgcggacgagggaataggatcgccataggttgcgtggcgtcggcgtcgtcatcggcgcggtcggaggcgccgagcagcagcaaaggcagtagcagtgcggcggcgtcatcaggttcggcggccatggcggcggcggcagcgcgcgtgaaggcggtggcgacgatcaaggccaccgtggtcgggttcctcgacagcctgcgaccgtcgagggccatcgacgacgtcaaggacctcatcggcaggtcgctctacctcgagctcgtcagctcccagcttgacgcagagacggggcaggagaagcccaccctccggagctacgcgcacagggtggcggacaacgacgacgaggtggtgacctacgaggcggacttcgacgtgccggcgggcttcggcgcggtcggcgccgtgctcgtcaccaacgagcaccacacggagatgttcctcgaggacatcaagctgatgacgccgtcctcctctgacgacgacgacg

SEQ ID NO: 29546 - protein, 216 aa, Panicum virgatum
  misc_feature: Ceres CLONE 1892263
  misc_feature: SWISSPROT Homolog: EC 1.13.11.12 Lipoxygenase
IKPSPSSSTQTCCGWSWSTAAAQSPLVLVPASFPSSLSRRPLPSLLVQFGRPRRGRGNRIAIGCVASASSSARSEAPSSSKGSSSAAASSGSAAMAAAAARVKAVATIKATVVGFLDSLRPSRAIDDVKDLIGRSLYLELVSSQLDAETGQEKPTLRSYAHRVADNDDEVVTYEADFDVPAGFGAVGAVLVTNEHHTEMFLEDIKLMTPSSSDDDD

SEQ ID NO: 29547 - DNA, 628 bp, Panicum virgatum
  misc_feature: Ceres CLONE 1892280-R
  misc_feature: Encodes the peptide sequence at SEQ ID NO. 29548
tgcattgctgtcaactttacaatatgttctttggccagaatgtgggtggcaacctgtatcccttactgatttgttcacagccgccgctgttaaaaaagtgtacagaaaagcaacattgtgtatccatcctgacaaggtgcaacaaaagggtgcaaatctccagcagaaatatattgctgagaaggtttttgatctccttaaggaggcatggaacaaattcaactctgaagagctcttctaacaagccatgaatgaacatacccatcagcacctgcacaaggttactcaagaagaaacacccaagctggagtggcttgcagacgatagggggaaagcgtaaagcagactaagcaaagcctcaactatagctgtagttattgtaatcaccattgcttgtttttagtacccccaattttccttcccatttgtatgtgttgattcaattacatctcacagcggcggcggccctagctggacctcatccagtaggtgtatattagtgccctgttttgtactatttatcctaggctgtatgtgccggcagattgggtgcggggcgtgttgaggccagtgttgtgattttggattaggtacagggtttaattaccatggagagctggttttactt

SEQ ID NO: 29548 - protein, 79 aa, Panicum virgatum
  misc_feature: Ceres CLONE 1892280-R
  misc_feature: SWISSPROT Homolog: EC 2.7.11.1 Non-specific serine/threonine protein kinase
ALLSTLQYVLWPECGWQPVSLTDLFTAAAVKKVYRKATLCIHPDKVQQKGANLQQKYIAEKVFDLLKEAWNKFNSEELF

SEQ ID NO: 29549 - DNA, 591 bp, Panicum virgatum
  misc_feature: Ceres CLONE 1892280
ttatatcctcagattattgaattatctgcagggtaagctcctgaagttagttaactaaaatactcctacagtaaaaaaggtgctgttttaaaagaaacatttgctcatacctattcttgtattaacattagctgataggtggatttggaactcccaagtatggcttagtaacttgcaagtcacatctgctgagtgtcgtcatactggagctttttttttcgcgaccgtgcctgggcacttttttcattaagaggcgtactggagctttttgtaattgctgagtgtcattatatctaggttcagaacaaacactataaatctggaaaagccaaaatgacctacattttggaacggagggagtagtttccttgtacataatgtgaccttttgtcatggaatgttaatacttaataattaatgaatgctgacagcaagttatattgtagctcagtgtcaatgcctcaaatgctatttttatgcctagtccttatcacaatactatttcattcatgttatgtactatttcattcgtgtggagaaacatgtctcttctgaactttcttgttttgacatagacttgtacatatgtgg

SEQ ID NO: 29550 - DNA, 1307 bp, Panicum virgatum
  misc_feature: Ceres CLONE 1892298
  misc_feature: Encodes the peptide sequence at SEQ ID NO. 29551
agttgttccggagtttggttcgcaaactgcagctcgcatctctctctccatggcggcgccgtcgccggagcccgcggccgagccatcggcgacgctgagtatctacaaggcggcgcggagcatcaagaggcgggcgagcacgctgtacaacgcgctgcgtagcgtggcggaggacgcggccttcgtggcggaggtcgcggcgctgtggccggcgctgccgctggtggccaacctccgatgcggcctctggtacgcgccgccccgggccttcgccgccacctgctacttcaagtccaccgacggccacgccgggaactggtctttctcgaccgcacgcctcaacctccacctcgctctactcgccgggaacagaggagggtgcataatagttgattcaacaaggagagggaaacgattccctgatagtatgtcaaagaccatacctatttggtgctgtgtcctgaaccgagcaatcgagaggcatcggctgcgggctatccacaaaggtggactgggtggtgaagtgaattgtgaagtgtcatctactatgctgaatggagataccaaaaacaactcttgttcatctaactgggatagctcagtgcatcttcctgtatgggttctaggcactgagaaaaatgctatagaggggcgcattgaggaatggacagatcaatttgaatcatgtggtgcagacattcattcacttgcaataaatttgcaaaagccactacgtcctctatggatatcacaaaggacacgcatatggttaaatgaagtgcctgagattgagtcatgggatttcactcctatcatactaatttctgcatcagcatcggatgcagttgctacgcaaaggatgtcttcagaattcagctggcaatatatccccggagcaggagatgatgaagagagttgggcacgtggtctaacccctaccttattctggaaacattcatatgaccttcttgatgctggaccagatcattgcaaccagttagttgcagatattgttgaaaaggatagggtttatcgtgcacagagaggtgaacattctcctcaaattacagctaagcctctaaagggctatgatgatatcaaatgtaatgatgatcgtacaagcactatgtggcctatgaacttggacccctgtaccagtgcaacagatgcacaatgttccagtaatggtcatcttctcttctggattggaacatcaaaccttgcagtatcatctactctccaagttgcagatgccttagttggcgtggactgcatactgaactgtgacagcacgtccaagttacctt

SEQ ID NO: 29551 - protein, 419 aa, Panicum virgatum
  misc_feature: Ceres CLONE 1892298
  misc_feature (1)..(404): Pfam Name: Init_tRNA_PT Pfam Description: Initiator tRNA phosphoribosyl transferase
MAAPSPEPAAEPSATLSIYKAARSIKRRASTLYNALRSVAEDAAFVAEVAALWPALPLVANLRCGLWYAPPRAFAATCYFKSTDGHAGNWSFSTARLNLHLALLAGNRGGCIIVDSTRRGKRFPDSMSKTIPIWCCVLNRAIERHRLRAIHKGGLGGEVNCEVSSTMLNGDTKNNSCSSNWDSSVHLPVWVLGTEKNAIEGRIEEWTDQFESCGADIHSLAINLQKPLRPLWISQRTRIWLNEVPEIESWDFTPIILISASASDAVATQRMSSEFSWQYIPGAGDDEESWARGLTPTLFWKHSYDLLDAGPDHCNQLVADIVEKDRVYRAQRGEHSPQITAKPLKGYDDIKCNDDRTSTMWPMNLDPCTSATDAQCSSNGHLLFWIGTSNLAVSSTLQVADALVGVDCILNCDSTSKLP

SEQ ID NO: 29552 - DNA, 730 bp, Panicum virgatum
  misc_feature: Ceres CLONE 1892298-R
  misc_feature: Encodes the peptide sequence at SEQ ID NO. 29553
cacaagaacaatatagagcataaggacacacgtccatccggcattgttagacatgtatacggtacaagacatgttttgtagacacataggcatagccaggcaacacattacatagaagctcgatacaatggcgatccggaacatgcaggtggcgacgcgttcgctggacgcggacatgacggtggacgagttcaaggagtggctgcggcggttcgacacggaccgcgacgggcgcatcagccgcgacgaggtgcggcgcgccatgcgcgccatccgcgcccggttcacggggtggcggagcaggcagggcatcagctacgccgacgcggacggcgacgggtacatggacgacagcgaggtggacggcctcatcgagttcgcgcagaagaacctcgggctcaagatcgtcgcctactgagctggtcgacgcaggtggcggccgggcgggccgggcggcggcgagacccatgggctagcagcagcacgccaccatctgcctgtccccgctaaaaataagaacaactgcttgatcgcccgcttgcttgcttaaagctttgctttcttgtacgtactctatcaattcatgggctctgtatccctcggtgtgtgatctatgtaaggtgtgtagggcggctgcctcctctgcaaggtcgagccctgccatgggtgccgccgccgcggattttcatttgtttgctctagtgaaattgacagtgtatccttgaccatc

SEQ ID NO: 29553 - protein, 96 aa, Panicum virgatum
  misc_feature: Ceres CLONE 1892298-R
  misc_feature (21)..(49): Pfam Name: efhand Pfam Description: EF hand
MAIRNMQVATRSLDADMTVDEFKEWLRRFDTDRDGRISRDEVRRAMRAIRARFTGWRSRQGISYADADGDGYMDDSEVDGLIEFAQKNLGLKIVAY

SEQ ID NO: 29554 - DNA, 628 bp, Panicum virgatum
  misc_feature: Ceres CLONE 1892299
  misc_feature: Encodes the peptide sequence at SEQ ID NO. 29555
attatcctcttcttcccgtggcacggcggccgcgtcgtcctcctccttccgccccttccctttccccctcccctctcccagacgcttctagaaacttccagagccccgccccggcgcctccggtgacgcggcgcgatgtacggcctcctgacctcgccgtgccctcggggcccgctgcttcgcgccctcccgagcccgtccgcccgcgcgctcccgagaaccctagcgttccccgcgcgcccggccccccgcggcctccgcctgcccgcgccctcgcgcgccgccgtggaggcgtcggcggcggccacggcgctgggcgggctgctgtcctcgccgctctcggcgatggaggccggcctgcggagcgtcaacctcgcgcccctgcgcgcccccgtggccgcggccatgtccgcggccgtgcggtggctcggcgtgtaccgcgaggtgctgctcgttggcgtgctgctctcgtggttccccaacatcccctgggaccgccagcccttctcggccctgcgcgacctctgcgaccctttcctcgccctctgccgggaggtcatgccgccggtgttcgggcgcaagctcgacctcagcccgctcgtcgcgttcatggccatcgacatcatca

SEQ ID NO: 29555 - protein, 164 aa, Panicum virgatum
  misc_feature: Ceres CLONE 1892299
  misc_feature (91)..(164): Pfam Name: YGGT Pfam Description: YGGT family
MYGLLTSPCPRGPLLRALPSPSARALPRTLAFPARPAPRGLRLPAPSRAAVEASAAATALGGLLSSPLSAMEAGLRSVNLAPLRAPVAAAMSAAVRWLGVYREVLLVGVLLSWFPNIPWDRQPFSALRDLCDPFLALCREVMPPVFGRKLDLSPLVAFMAIDII

SEQ ID NO: 29556 - DNA, 403 bp, Panicum virgatum
  misc_feature: Ceres CLONE 1892302
  misc_feature: Encodes the peptide sequence at SEQ ID NO. 29557
agcaacgcctcgtacagtttcttcgtgacagcaagtaaaagccataccaaaactaccacaagaaaagtttttgtagcagctagctgttgcaaatggcgtcgacggtggcgagcatcaagaaggcggaggagacgtgcgcggaggagacggcctccggggagtgcgcggcggcgtgggacgaggtggaggagctcagcgccgcggcgagccacgcccgggacaagctcaaggagaacagcgacccgctggagaactactgcaaggagaaccccgaggccgacgagtgccgcacctacgacaactagagcgcgcatgtatatatgctaaatttgccgtacacgatcgaaggatagcgaagtgaagaagtggctatgtaagctggtgaatttgcacgaagcttcat

SEQ ID NO: 29557 - protein, 70 aa, Panicum virgatum
  misc_feature: Ceres CLONE 1892302
  misc_feature (1)..(70): Pfam Name: CP12 Pfam Description: CP12 domain
MASTVASIKKAEETCAEETASGECAAAWDEVEELSAAASHARDKLKENSDPLENYCKENPEADECRTYDN

SEQ ID NO: 29558 - DNA, 629 bp, Panicum virgatum
  misc_feature: Ceres CLONE 1892319
  misc_feature: Encodes the peptide sequence at SEQ ID NO. 29559
atcttcttccacggcttcttggactcgctgctgttccttggggagaggagaggaggaagcatgggtagcttcgcgaggctggcgaggagggcggtggagacggacgcgccagtcatggtgaagatacaagaactgcttcgaggggctacggacgtgatgtcgcttgcccagggagttgtttactggcaacctcctgagtcagctatgaataagattgaaaaaatcatcagggaaccagcagtcagtagatatggttctgatgatggaattcctgaacttcgtgaagcacttcttgaaaagctacgcagagagaataagcttaccaagtcatcagttatggtcactgctggtgcaaatcaggcttttgtgaacttggtcctcactctttgtgatgctggtgattccgttgtcatgtttgcaccatattatttcaacgcctacatgtcattccagatgacaggtgttactgacatattagttggtgcttgcgaccccaagacacttcatcctgatgttgattggttggagaaggttctgaaagaaaatggccctatccctaaacttgttactgttgtgaatcaggggaatccctctggagcttttattcccggcctatgcttgagagaatt

SEQ ID NO: 29559 - protein, 189 aa, Panicum virgatum
  misc_feature: Ceres CLONE 1892319
  misc_feature: SWISSPROT Homolog: EC 2.6.1.1 Aspartate transaminase
  misc_feature: Functional homolog of the protein sequence given in SEQ ID NO 50929
  misc_feature: Useful for making plants with modulated nitrogen use efficiency
MGSFARLARRAVETDAPVMVKIQELLRGATDVMSLAQGVVYWQPPESAMNKIEKIIREPAVSRYGSDDGIPELREALLEKLRRENKLTKSSVMVTAGANQAFVNLVLTLCDAGDSVVMFAPYYFNAYMSFQMTGVTDILVGACDPKTLHPDVDWLEKVLKENGPIPKLVTVVNQGNPSGAFIPGLCLRE

SEQ ID NO: 29560 - DNA, 576 bp, Panicum virgatum
  misc_feature: Ceres CLONE 1892335
  misc_feature: Encodes the peptide sequence at SEQ ID NO. 29561
aacctccattaattcccactcaccttataattccaagcaagctagtaggcatggacgccatctcgtgcctggccacctccttggccgacgccgccatcgcgcgcgcgctccacctgtcggccatgtcctcccactccgccgcctccctcgtctcagcgcccgcgccgcaccaccaacaatcgccgctgctcgccgccgcccacctgccggcgcatctcacccccgaatcgccgcctggccctgctggcgggcgccgcaaccaccaccagcagcagcagctggcgccggccgggggccgcgcggggaagcgacggcggtcgcgggcgtccaagcgcgcccccaccacgtacatcaccaccgaccccgccaacttccggatcatggtgcagcacatcactggcgtgcaggccgatgagctgccgggcgacatgctgctgcagcggacggcggctgacattgacatgctgctgctgcccgcggacgcccaagccggagtggaggcgtcgtcgtcggcgcttgcgcttcatcagcagccgtgcttcccgacgctggactcgtggaacgtcatgtacgacg

SEQ ID NO: 29561 - protein, 175 aa, Panicum virgatum
  misc_feature: Ceres CLONE 1892335
  misc_feature (94)..(124): Pfam Name: VQ Pfam Description: VQ motif
MDAISCLATSLADAAIARALHLSAMSSHSAASLVSAPAPHHQQSPLLAAAHLPAHLTPESPPGPAGGRRNHHQQQQLAPAGGRAGKRRRSRASKRAPTTYITTDPANFRIMVQHITGVQADELPGDMLLQRTAADIDMLLLPADAQAGVEASSSALALHQQPCFPTLDSWNVMYD

SEQ ID NO: 29562 - DNA, 1697 bp, Panicum virgatum
  misc_feature: Ceres CLONE 1892356
  misc_feature: Encodes the peptide sequence at SEQ ID NO. 29563
attcagtgtcttatgctattgtctgatcactctaaagcatcatcgaccaatgaattttgtggagaaataacaccctcaattgaatccccaactgcaccgaactatgatgcatccagttcattgtcttccttttatggtttgggcaacttgttaatgatttgttcaacaacctgaaaaatttcgcttcttttctgatgtttctgcgtaggttgatacctcgtcatgcttgtgccgagtggacagatcatccgccgccgccgcggcgaggcgcatctcggtgtccaaggcgtgcgtgcagccgagcctcagggcgtccatccacccgctgaagccgaaggcgtcgccgcggccggccgaccggagcagcggtgggcaatgcccgctgctccccggccttcccgacgacctcgccatcgcttgcctcatccgggtgcccagagccgaccactgcaggctgcggctggtgtgccggaggtggtgccgcctgctcgccggcaactacttctacggcctccggcgtcggctcgggctcgccgagcagtggctgtacgccgtgaagcgcgacgacggccaggacgggcgcgtgtcgtgggacgtgctcgacccgtcgcgcggcgcgtggcgcgcgctgccgcccgtgccgcgggagtacgcgggcgccgacggcttcggctgcgccgtgctcggcggctgccacctgtacctggtcggcggcgcggacccgcgccggggcgaaggcggcggcgccatgcggcgggtggtgttctacagcgcgcggaccaaccgttggcaccgcgcgccggacatgctgcgccgtcggcagtgcttcggcgcgtgcgtgatgggcaaccgcctgtacgtcgccggcggcgagagcgggagcggcggcggaggcgggctcaggtccgccgaggtgttcgaccccgccaagaaccggtggtcgttcgtggccgagatggcggcggcgatggtgccgttcgtcagcgcggtgcacggcgggcggtggtacgtcaagggcctcggcgcgcagcaggaggtggtgagccaggcgtactcgccggagaccgactcgtggtccgtcgtgctcgacggcatggtcaccggctggcggagccccagcgcgtgcctcggcggcaggatctacgccgccgactgcagggacggctgccggctgagggcctacgacgaggccgcggacgcgtggaccatctgcgccgacagcaagcagcaccagtggagctcccaggcggcggaggcggccgccattgtcgcgctccacggcaggctctgtgtcgtccgcaacgacatgagcgtcgtggccgtcgacgtcgcggccgggcaggggaaccagcagagctgggagaccctggccggcaaagcgcatgctaagagcttcgtcacgggcctcttgtccaacctcgccggccgtggccgcgccaagaaccgcatcctccattgcctagttcttgaggcctagctgatcacttgctgcctatgaatcaccggtacttcactaacccagccgtacccgtatccgattcttgcgtatccgatacttcgatactccgatactctctctatactaccactatgtcgttttttaaactcacatatcgccgtatcgccgtacccgtattgccgtacccgtatcatacatagcttgctgcttcatctgttctatgtagaatcacacactg

SEQ ID NO: 29563 - protein, 242 aa, Panicum virgatum
  misc_feature: Ceres CLONE 1892356
  misc_feature (23)..(71): Pfam Name: Kelch_1 Pfam Description: Kelch motif
MRRVVFYSARTNRWHRAPDMLRRRQCFGACVMGNRLYVAGGESGSGGGGGLRSAEVFDPAKNRWSFVAEMAAAMVPFVSAVHGGRWYVKGLGAQQEVVSQAYSPETDSWSVVLDGMVTGWRSPSACLGGRIYAADCRDGCRLRAYDEAADAWTICADSKQHQWSSQAAEAAAIVALHGRLCVVRNDMSVVAVDVAAGQGNQQSWETLAGKAHAKSFVTGLLSNLAGRGRAKNRILHCLVLEA

SEQ ID NO: 29564 - DNA, 557 bp, Panicum virgatum
  misc_feature: Ceres CLONE 1892359
  misc_feature: Encodes the peptide sequence at SEQ ID NO. 29565
gaatccactagtgtactttataaataatcacacaggaggcaggcattccgatccgatcccattccctgattccctcttcctctccaatgcagcctggccgtctccggccccgtccccatccctaagcctagcaagggacccatggggttctggtggccgctcctggtgctcgcggccgccgacgcggtctgccgcctgctcctcttcctcatcccgcccaccgtcccttccatcggaatggacgctgccgacgtgttggccaaggaggacagcttcatctgcttacatgaaaagggcgaagctgctcagaccgaggaggtccaatgctaccaacgatcaaccatgaaggagttgggctatttccctggattggctcatgatgaagacaaggagcatgttgcgcaatgcaggagagctcacaggatatgggcaattagtagtttcaagcgatggcggcacttccttcgtatccttgtcatgtatatacttgagcctcaagatctggtgtgcgaggtgtcgtctccggacacgatagagactatggttgatgcttcctt

SEQ ID NO: 29565 - protein, 138 aa, Panicum virgatum
  misc_feature: Ceres CLONE 1892359
  misc_feature: SWISSPROT Homolog: EC 1.2.1.3 Aldehyde dehydrogenase (NAD(+))
MGFWWPLLVLAAADAVCRLLLFLIPPTVPSIGMDAADVLAKEDSFICLHEKGEAAQTEEVQCYQRSTMKELGYFPGLAHDEDKEHVAQCRRAHRIWAISSFKRWRHFLRILVMYILEPQDLVCEVSSPDTIETMVDAS

SEQ ID NO: 29566 - DNA, 588 bp, Panicum virgatum
  misc_feature: Ceres CLONE 1892367
  misc_feature: Encodes the peptide sequence at SEQ ID NO. 29567
gacgtggccggcagcaactccacctctctctctccatctcaacccctctcggcctggcctgtcgcgtctccttccccgaccgggcgatctccagcgagcgagagagagagccagcagccgcgcgggaggagctctgctcgtcgaggccgcccaccatggggttctgggtgtccacggtcatcttcctcctcgccggcgtcgtcgcctccctcttcacgctcctctgctgcaaccgcgggtcatccaccaacctattccatttgaccttggtgactacggctgtaatgtgttgttggatgatgtatgccattgtttaccttgctcagatgaagcctttgatcaaccccatcctgagcggggagtgagctttctgttgaaaataattaaatccaacatgctgtaccattattcagtatgtgaaccttttattcattttggccaccctgaaataaagaaactgccatgagttttttgctactctacctccaggttattgaggcacgctgtgattagtgtacccaattgtatgataaacgcaataataatatgtatggtgtttttatctgaatgtctgtgcactgatccgtc

SEQ ID NO: 29567 - protein, 69 aa, Panicum virgatum
  misc_feature: Ceres CLONE 1892367
  misc_feature (1)..(69): Pfam Name: ATP_synt_H Pfam Description: ATP synthase subunit H
  misc_feature: SWISSPROT Homolog: EC 3.6.3.14 H(+)-transporting two-sector ATPase
MGFWVSTVIFLLAGVVASLFTLLCCNRGSSTNLFHLTLVTTAVMCCWMMYAIVYLAQMKPLINPILSGE

SEQ ID NO: 29568 - DNA, 745 bp, Panicum virgatum
  misc_feature: Ceres CLONE 1892378-R
  misc_feature: Encodes the peptide sequence at SEQ ID NO. 29569
tggataaatctgaagcaactgcacattctggtggtgatactaaacaagatcttgtagcatctggagaggagaccaatggagcagctgatgatacatcaaggcctgctgatattacacccgttaaaccaagacggggccgacctcctggtccaaagtcatcggagaagaaggctgctgcaaagaataaaccttcaagtttggatttgaagaaggccgaggaggctagtgattcagcagggaagtcgacaaaacgatcagcgaaggatgaggtcaagtcttctgtaaaaaaggctggtgaagcagaatcatctaagaagcctcaaaagagtagttcgaagcagcagaaggatgaagctctttctgaggaagatcctgctgaggatctgagcttaaaggaaatgatctcgccgaagtcttcaaccaaggggccaggtagaaccaaaggacaaagcacagagaatagcacatctaagaggaagcaagaacaagatacagaagagcttcctcgttcaaggaaaaacaaaggccttgatggcagcctaattggtgcaaggatcaaagtttggtggccagatgataagatgttctacaaaggtgttgtggaatcatttgattccaattctaaaaggcacaaggtcgcatatgacgatggggatgtagaggtactacttctcagggatgaaaaatgggaatttatcactgaggagaaaggagcttctgtggcatctgaaacgccacgaggcag

SEQ ID NO: 29569 - protein, 247 aa, Panicum virgatum
  misc_feature: Ceres CLONE 1892378-R
  misc_feature: SWISSPROT Homolog: EC 2.1.1.43 Histone-lysine N-methyltransferase
DKSEATAHSGGDTKQDLVASGEETNGAADDTSRPADITPVKPRRGRPPGPKSSEKKAAAKNKPSSLDLKKAEEASDSAGKSTKRSAKDEVKSSVKKAGEAESSKKPQKSSSKQQKDEALSEEDPAEDLSLKEMISPKSSTKGPGRTKGQSTENSTSKRKQEQDTEELPRSRKNKGLDGSLIGARIKVWWPDDKMFYKGVVESFDSNSKRHKVAYDDGDVEVLLLRDEKWEFITEEKGASVASETPRG

SEQ ID NO: 29570 - DNA, 1371 bp, Panicum virgatum
  misc_feature: Ceres CLONE 1892378
tcgccaagcctcgcccgcgcgcagcccaccccgagccagaaaatccagctagccataagacaccaccagcctgccccgtgccccgcaccgaaacctcgtcgcgtcgcgcggaagcagaggagagttggcgggcgggtagggttgggggaagggaatacagccgcggaatccctcgcctcgtcatcctccaccgctaaacccccttctcgctctctcctccgcggccgccgcgccgacgcccgcctgcttcccggcccgcgccgggagggggaaaccctagcagcggcagatctcgcgcgggcgcgctggatccgggcgcgcaggcgcccgattcgggcgggggaatggcggacgacggggccgcggacccggagaaggagctgcggcagctggaggaccggctcagggaggtcggggaacgcctgcaggctccgcccgacgaagcagaggacctgctcaagctcctcaaagaagttgaggactgtttacttaaagttgagcaatcacctcctgaaagcacatcaaacgctattcgaccagcaactgaagcgctggtcaggaaagagctgatgggccatactgacccaaatgtcaggcttgctgtggcatcatgtatctccgagatcacaagaatcacggcacccgacgctccatatgatgatgatgcaatgagggatgtattctctttaattgtgggtgccttccagcatctggatgacatagagaacccattctttggaaggagagcttcgattcttgatactgttgcaaaagtccggtcctgtgtggtgatgctagatcttgaatgtgatgatttgataaatgatatgttccatcacttcttgaggactgtttcgtctggacattcagatactgtcatatcctgcatggaaacaataatgagattggtaattgaggaaagtgaggatgtccaaccacagattgcatcatgcttactccaaaatgttagaaaagaggaaaaggaatcttcttcaccttcttttgaacttgctgagagggtgatagactcgtgccgtgaaaaactaaagccagtctttctgcaatcactaaaaggcacttccttgagcgaatacagccaaatcgttgcattagtttgtgaagagggttcagatgacagggaagataacaatgctgatccttctgggaaggacacggtggatgatggcaaactctctgaaaggactatctctgacgaactaccacaggagtcttcaaaggcagagcaagatgttagccatccggagcaagatggtacttctatgaatggcaatgcagctattgctattagcaacaattcaactccagctggtactgatcccattgctgcagagcccaaaaaaagtcagccct

SEQ ID NO: 29571 - DNA, 708 bp, Panicum virgatum
  misc_feature: Ceres CLONE 1892380
  misc_feature: Encodes the peptide sequence at SEQ ID NO. 29572
accccaaactccgcgtcctctaatccttttcctatctctatccttcatcccaatggcctccgcggcggcgaagcggaagccggtgttcgtcaaggtggaccagctgaagcccggcacgaccggccacacgctcgtcgccaaggtgctcagctccaagaccgtcctccagaagggccgccccagcgctgccgccgccggccctgcggcgcggcccaccaggatcgccgagtgcctcatcggcgacgagaccggttgcatcctcttcactgcccgtaacgagcagggtacgatccccctctgttcgtgcagtaatctgttctttttgtttggtgacatgggctttcacttgtgacatgtgtgcaatccttcgccttgggagatttggttggagcggcgtgcgtacgaataatcctttgcccgatacatgtactgcttttgaatacgattcgctagaatctacgttactatgtgacaccgttttttagcacagcaatcgctgcagtttagtactccagtatgatctaatctgtaatagttgtgtgctatgtgctcacagttttatccctgttttggaaaaatcagcaatgcaatcatctctagaactggattataaggatgtcaagtttgatcttaaggaatattacctctatctgatccccaaatattagtgtgtctaggattattgttagtaaaacgtaaaatcaatcg

SEQ ID NO: 29572 - protein, 99 aa, Panicum virgatum
  misc_feature: Ceres CLONE 1892380
  misc_feature: Functional homolog of the protein sequence given in SEQ ID NO 50161
  misc_feature: Useful for making plants with modulated drought sensitivity
  misc_feature: Useful for making plants with modulated water use efficiency
MASAAAKRKPVFVKVDQLKPGTTGHTLVAKVLSSKTVLQKGRPSAAAAGPAARPTRIAECLIGDETGCILFTARNEQGTIPLCSCSNLFFLFGDMGFHL

SEQ ID NO: 29573 - DNA, 401 bp, Panicum virgatum
  misc_feature: Ceres CLONE 1892392
  misc_feature: Encodes the peptide sequence at SEQ ID NO. 29574
agttgcttccctgtctcctgtctccctccctagtcgctgcctcggtgcttgctcaatctctccggccgccccgacggcgggcgtatgctcgtgctcctccgcccgccgctcgtagagcgcagaccggagacactgggggaccgtctgccggatgacgagatcgccgagttcttggaggccttgaccctcttggagaaggactgctactggtgcctctcgtccgaggagctgggatctgtcatgctttcactgggtctcaccctgacggagggtgaggtccgggacgtgatctgcaaagtcgacgctgatggcattggcaacatcgatttcaccgatttcctccttctcttgggccgcggaatgatggagcctgattctgaggagtagctcaccgaggcgtt

SEQ ID NO: 29574 - protein, 100 aa, Panicum virgatum
  misc_feature: Ceres CLONE 1892392
  misc_feature: SWISSPROT Homolog: EC 2.7.11.1 Non-specific serine/threonine protein kinase
MLVLLRPPLVERRPETLGDRLPDDEIAEFLEALTLLEKDCYWCLSSEELGSVMLSLGLTLTEGEVRDVICKVDADGIGNIDFTDFLLLLGRGMMEPDSEE

SEQ ID NO: 29575 - DNA, 675 bp, Panicum virgatum
  misc_feature: Ceres CLONE 1892418
  misc_feature: Encodes the peptide sequence at SEQ ID NO. 29576
aagagcacggagccagccaactcgccattgctcctcctcctcccatctgctgatctgccgcctcctctgtccaccccgtccacagcttatccaggacggcacagccaagaaccccagcgtcactcaccagcaacacaagctcgcgaggcgattaaaggggcagaggacctgctcggccgagagattgctctcgctcactcgcgcggcggcactcctctcagtcagggctcgcgcgcaatgtttaggggttacggcccctcggcgcgcgccgtcatgggctccccgggctacgtcgacccccacctcctccgctccggcgtggccaccaagaagagcgacgtgtacagctttggcgtgctgctgctcgagctcctgacggggaaggaggccgtctgccgcgagacgggacaccggctcaccgccgcggtgggccccatgctcagagacggtagagtgtcggacgtgctggaccagaggctcgggtccgagtacgacgccgcggaggccgccgccgtggcggaggtcgccatgcagtgcgtgaacgacaacccggcgctccggccgtccatggccgacgtggtgcgcctgctcgaggagaagacctcagccgtcggatcgaaatcggaccgcaagatgatgtcctaagttggattcatgtcgtaggatgtaaatact

SEQ ID NO: 29576 - protein, 135 aa, Panicum virgatum
  misc_feature: Ceres CLONE 1892418
  misc_feature: SWISSPROT Homolog: EC 2.7.11.1 Non-specific serine/threonine protein kinase
MFRGYGPSARAVMGSPGYVDPHLLRSGVATKKSDVYSFGVLLLELLTGKEAVCRETGHRLTAAVGPMLRDGRVSDVLDQRLGSEYDAAEAAAVAEVAMQCVNDNPALRPSMADVVRLLEEKTSAVGSKSDRKMMS

SEQ ID NO: 29577 - DNA, 2160 bp, Panicum virgatum
  misc_feature: Ceres CLONE 1892424
  misc_feature: Encodes the peptide sequence at SEQ ID NO. 29578
gtcgatctggtccgaggaaccctattccagtccagggggtttctttcgctccctgccgtgtcggatcccactacaacccttctccgttccgcctccgaccaggcccgaaaggaaaagccttcccggccgcccgcccccgccgcgctcgccatggacttctctgaacaggacgtcgacgtcttcggcgaggactacgacgtccaagacggtggcgctgaggctgaggccgacggcggcggcgactcgtcgggctcctcctccccgtcctcatcctcatcgtcctccgccgccgcgtcctcctcatcctccagtggcggctcaagcctcagcgacggcgctggcgtggagggtgaggacggcgccgacgagggggatggcgaggacggcgccgattcgtccaacctcgtggggacgaggggcaccggcgccggtgactaccgggacgacgagaggggggaggatggggacgaggaggtagaggaagagagggatttgttcggctccgacaacgaggattacgtcagaacccccgcgcgcagcctgtacctagtcccagtgcttcctgcaattcggaacactaataatcattctcgaggaggctttggaggacgaggtggcagaggtccaccacttcttccgagaccaggaggtcatccagggcgacataactttggctatggtagattcgggaatgggcgcaatgtcgaaggtttggtttcagatctgaagcttaataagagcgaagaaacattgtctagaaaagctgttgcttttcaggagccttccgagatcgcatgcttaagccgcgttgaaggtggaggtgtgttctttgatgatcgcagcttgaggctcttcaaacgtgaaatttgtgactatgtcggtgcagatctcaataaaggattcgagtcatttatagagaagaaagatttgggttctgaaggatttggcgatcttctcgcatgcataagaagtacgaacataattcttcagaataatatacattttgtgacataccgcaataatcttaacaagatattggccactgcttacctaagagaaccatggaagatgggcgttcacaaaagaaggggtgttgtataccttgatgttcataagctccctgaaagaccaaaaagtgaggtggagcgtaggagatgttattggggctattcttttgaaaaccttgccactgagaactccttcagtgaggatggaggaggtattgatgcaaatgtagagtattgttctgtaataaagacaaaattgggtgcccatcgcattattatgggtgctgagatggactgctgtgatgcaactgatgatggcaggcggttctatgtggagttgaaaacaagcagagagctggagtaccatacagtggaagcatatgagaaagaaaagctacttaggttttggattcaatcattcctggcgggtgttccttatgttgttgtgggattcaggaatgatgctggcatactcgtgcgaacagaaagactaagaaccaaagatattacacaaaaggtgaaggcaaagaactactggcagggtggtgtttgcctggcctttgctgacgaggtcttatgctggctgtatgggactgtcaaagagaatgaagactatgttctgcaatttgtacatccatttaatcgcttggaacttctacgtgcccagtctccctgccctgaagccataactttgcatgtgcagcaactttcaggtgcagcagactagattctattatagacatctgcggtgacaactgccttggagaaagttccatgggctccaattctatcagccgagccagaattgttgagctgacaacttactctaacccaatcagcaagcgagatgagctgatgcatcatgagctaatggcatcgatcaccgggagcagctacatccatggtgcactttctgagtggccaaagagattttgaacccatcatagattgtattttgattgtaacaaaatggtataaaactagacagacgaagagctataacactatgctactggttcgagcgatcaatcatgtaaactgtaccattgatgagatgaatgatgaacatgcaaattgttatagttgttgcaagttacatgtaaacagaacttattcgtacactagacttgaaataacaaattttcattaggcg

SEQ ID NO: 29578 - protein, 527 aa, Panicum virgatum
  misc_feature: Ceres CLONE 1892424
  misc_feature (383)..(447): Pfam Name: RAI1 Pfam Description: RAI1 like
MDFSEQDVDVFGEDYDVQDGGAEAEADGGGDSSGSSSPSSSSSSSAAASSSSSSGGSSLSDGAGVEGEDGADEGDGEDGADSSNLVGTRGTGAGDYRDDERGEDGDEEVEEERDLFGSDNEDYVRTPARSLYLVPVLPAIRNTNNHSRGGFGGRGGRGPPLLPRPGGHPGRHNFGYGRFGNGRNVEGLVSDLKLNKSEETLSRKAVAFQEPSEIACLSRVEGGGVFFDDRSLRLFKREICDYVGADLNKGFESFIEKKDLGSEGFGDLLACIRSTNIILQNNIHFVTYRNNLNKILATAYLREPWKMGVHKRRGVVYLDVHKLPERPKSEVERRRCYWGYSFENLATENSFSEDGGGIDANVEYCSVIKTKLGAHRIIMGAEMDCCDATDDGRRFYVELKTSRELEYHTVEAYEKEKLLRFWIQSFLAGVPYVVVGFRNDAGILVRTERLRTKDITQKVKAKNYWQGGVCLAFADEVLCWLYGTVKENEDYVLQFVHPFNRLELLRAQSPCPEAITLHVQQLSGAAD

SEQ ID NO: 29579 - DNA, 566 bp, Panicum virgatum
  misc_feature: Ceres CLONE 1892427
  misc_feature: Encodes the peptide sequence at SEQ ID NO. 29580
cgtaatgctgacttcgaccacgtttatcggacgatgtcttttaacaaacctcatggctctacaggtattttgttgtcaaattccctcttgaaagtattgttgtttattacattacgacacatggcatttgtgacacattttctctattgttctactacagcttctgcgacatcggtccagttacataaagcagcgagtgtatgtgatgttgaaacagtgttaccgagctgactaggttttcttatggaaattatgtgtatttatgagtgcatattgtcataatggcaggcaaacggaaatcaagctgatgaagatatacctgagctggcagaagctgatatggttgtctttcttggtgatttcaactaccgacttgacggcatcacttatgatgaagcaagggatatggtctctcagaggagctttgactggcttagagaaagggatcaacttcgagcagaaatgaaggcgggaaatgtgtttcaaggaatgcgtgaaggtcctatcagatttcctccaacttacaagttccaaagaaaccaaccgggtctctcatgttatgattc

SEQ ID NO: 29580 - protein, 75 aa, Panicum virgatum
  misc_feature: Ceres CLONE 1892427
  misc_feature: SWISSPROT Homolog: EC 3.1.3.36 Phosphoinositide 5-phosphatase
MVVFLGDFNYRLDGITYDEARDMVSQRSFDWLRERDQLRAEMKAGNVFQGMREGPIRFPPTYKFQRNQPGLSCYD

SEQ ID NO: 29581 - DNA, 598 bp, Panicum virgatum
  misc_feature: Ceres CLONE 1892455
  misc_feature: Encodes the peptide sequence at SEQ ID NO. 29582
gaaacaacattacaaaaagcacaaaaaaaaacacttgtagcggtcaacttcttcttcttcttctacatctgtcattcaactcatcatcggctcagacagcgagtggaatcccttgccttaatattattaccgattctttgtacacatatatagctacctgtttttgactgcaaataaagcatccatcgatccgcagctagctagcgaccaaaaaacaacaagatgatctcctccgcggaagcagctgatcatggcggaggcggcatcacgtcgtggccggaggtggtggggatgagcatagaggaggccaagaaggtgatcctcaaagacaagcccgacgccgacatccacgtgctgcgggtcggcaggccggtagaaagggatttccgccccatccgtgtccgcatcttcgtcggcgccgccgaccagactgcctgcagagggctagcagctctgcccataactttcttgctcacaacatcatgcgcgtgccaaatatggccatcgtatgtatgtatggatgtgtgttgttaccctctggatccattagataaggtatgtaagatgtgaataaagcgtcgattgtgtgtagccttac

SEQ ID NO: 29582 - protein, 115 aa, Panicum virgatum
  misc_feature: Ceres CLONE 1892455
  misc_feature (16)..(71): Pfam Name: potato_inhibit Pfam Description: Potato inhibitor I family
MISSAEAADHGGGGITSWPEVVGMSIEEAKKVILKDKPDADIHVLRVGRPVERDFRPIRVRIFVGAADQTACRGLAALPITFLLTTSCACQIWPSYVCMDVCCYPLDPLDKVCKM

SEQ ID NO: 29583 - DNA, 593 bp, Panicum virgatum
  misc_feature: Ceres CLONE 1892465
  misc_feature: Encodes the peptide sequence at SEQ ID NO. 29584
aagcgccgccgcctccgctgctcacaaacgcaaccctccgcagggtagcggcgctcctctctcctccccaaccggcagagacaagagaacgcggcggtgagatggtgaagaacagcaggaagagcaagagcaagcgcgtcacgctgcgcccgaagcacaaggtgctgcgcaaggtgaaagaccaccaccgcaagaagggtaaggaggccaagaaggagggcaaggccggccaccggaagaaggtcgagaaggacccggggattcccaaggagtggccgtttaaggagcaggagctcaaggcgctcgaggcacgccgcgcccaggtgctgcaggaactcgagctcaagaaggaggcgcgcaaggagagggatcggaagaggaagcttggattgcttgaggatgaggacattaccaaattggcatctgcatcttctgcacagggcaatgagtatgcagagaagggtgcaacaaacgagaacactcctttagaaatagcgaagagccatgatcattcagagagatcgttctacaatgagcttgttaaagtgattgatgcttccgatgtcattctggaggttcttgatgcaagggac

SEQ ID NO: 29584 - protein, 163 aa, Panicum virgatum
  misc_feature: Ceres CLONE 1892465
  misc_feature (16)..(96): Pfam Name: GN3L_Grn1 Pfam Description: GNL3L/Grn1 putative GTPase
MVKNSRKSKSKRVTLRPKHKVLRKVKDHHRKKGKEAKKEGKAGHRKKVEKDPGIPKEWPFKEQELKALEARRAQVLQELELKKEARKERDRKRKLGLLEDEDITKLASASSAQGNEYAEKGATNENTPLEIAKSHDHSERSFYNELVKVIDASDVILEVLDAR

SEQ ID NO: 29585 - DNA, 2834 bp, Panicum virgatum
  misc_feature: Ceres CLONE 1892497
  misc_feature: Encodes the peptide sequence at SEQ ID NO. 29586
aaggaggaagaaaggagcaagtatagtataggaagcaggcaagcaatgggcctcctcccgagtagtaataagctgcaggctatcatctccattttgttcctcccaccagtactgctagtcccttgctcgtactcgaaatcatgtccggactccgatgagcctcctccttcgctgggcaaatacaactacgactccaccctggataccaagtcccagtgcacgatagccaatgattcaggtctgttcgctaacattagctggcaggagctcgccgacatgtccgacgccggcgccggcgagcgaccgtcgatgtacgtgatcccaggttcaacgtcgtcggtgcgactgatcacctacaacgaggaggcctgtgtcctgggggcgtccttcaacgtctccttcacgatgagcctgtatccgccgtcgtggaacgagacgacggcggggcagagcaacaccagcagcatcaggggcgtagccttcctcgccatgccggacatcgccaacgtgtttcgtgccaacgagaccctgacaaagctgctggcgctcggtgcgcgcggctcgctcatcctctccaaccccaggagctggacagccccgatcgccggcgccggaagcgtttccggggacctcgggtggctgccatctgacgcatcgctcccgctggatgaccctccaagtcgccatctggtgatccgtattaccggcatccggcagccagcggaggagcggtacaccgtctggattgagtatgacggccggaggcggatattggcagtctacatcggcgccggcggtaaaagcaagggcaggccggaaaaggctgtagtcaccttggaccaggtgaggtacagggacccggtgcacaggacggcctgcttcggcttgttctcctcgctggggcaactgaagcaagtccacacctggagcacggagggcgacgagttgcccgattctgagtacttcatccttgagaacatagcgcggcttaagagagcccggagacagagactacgcatgactgtgggttcagtcgccgggtcggtgtcagccgccgccgccgtggccgtcgccgccgcattctacttccggtccaagcagcggaggtggaagaaggagcaggagaagctcacaaggatcatgcagcgcctccctggggtgcctacccaggtggatttcgccgacatcaggaaggccaccgccagcttccacgagaccacgaggctggggactggcggcttcagctccgtctacaggtgccgcctccctgctgcttccggttccacggcggaggtcgccgtcaagaagttcacacggggagtccacgaggagcgctacgaggacttcctcgccgaggtcagcatcatcaaccgcctccgccacaagaacgtcgtcccactcgtcgggtggtcttaccacaaaggagagcccttgcttatctatgagtacatgaagaatggtagcttggatcaacatctctttcggagaggcggcgatggcgagcagcggcatcagcaagaagaaacatctatccggcagtggcacacccgctacagcatcgtgagggacatagccacgggcctgcactacgtccatcacgagcacgagccaatggtgttgcaccgtgacatcaaagcaagcaacatcatgctcgactccaacttccacgcccgtgtcggcgacttcggcatcgcctgcacggtggctgcagaccggagctcggccaccggcatggttggcacctggggttacatagcgccggattacgcgatgagccatagggccacgcgccagactgacatctacgcatttggggtgctcgtccttgagattgttacgggcaagaagaacatggatgtgccaacggaagacggccacatctccggctgggtctggcgtcttcatggggaggggcagctgctcgaggctgtggatggcgtggtgctaacccaaagccgtatgaatcctgaagaaatcgccggtcaggctaaacgtctactgctcctggggttggcgtgcaccaaccccaacccgtcgagtcgcccgagcatggcggaggcggtgcaggtcatcaccaagttggcgccaccgccggaggtgccacttgaaaggccaaagtttgtgtggccgccggaaccggaagaatggcgttcactcgacgactctgacaatagcacaacagtgatgagtaattttggggcatcctttgccagcacggtcgaaatcagcactccacgagccgaggcattccaaggtagccgcgccattcgtgcggagggacgacagcaactccctcacgaatcaccctgatccaatccgaggggagtaagtacatttgaatatcatttatgttaatttgatttttttttgtgatgctgctaaatcttggttaatttgtaggcttctatatatcctgaaagcaggttgggtaatccatgacttctttgtacaaccatagtagaaccactagaaccaagaaattttgtattgtgctatgtgtgtactttgcttctggatttctgttgttgggtaggagatcatttacctcatgttgtaactcaaaggaggggaacacagatataggaacctgatcttgagagttgttggtgtatggtcattaagttgttttcagaagaagcagtgtctaattttatatgtgtcatggccttgttggtaccaggggcaacctgaatatgcagtttcgtcagtcttgcaatgatgctagcttcttcagtttcatcaagtgtaggcacaaggaagaagtgcatttactgtaaccaatacaattcatgcagctgctttgtgggggctccggaagctgataaatgacattt

SEQ ID NO: 29586 - protein, 754 aa, Panicum virgatum
  misc_feature: Ceres CLONE 1892497
  misc_feature (388)..(676): Pfam Name: Pkinase Pfam Description: Protein kinase domain
  misc_feature: SWISSPROT Homolog: EC 2.7.11.1 Non-specific serine/threonine protein kinase
MGLLPSSNKLQAIISILFLPPVLLVPCSYSKSCPDSDEPPPSLGKYNYDSTLDTKSQCTIANDSGLFANISWQELADMSDAGAGERPSMYVIPGSTSSVRLITYNEEACVLGASFNVSFTMSLYPPSWNETTAGQSNTSSIRGVAFLAMPDIANVFRANETLTKLLALGARGSLILSNPRSWTAPIAGAGSVSGDLGWLPSDASLPLDDPPSRHLVIRITGIRQPAEERYTVWIEYDGRRRILAVYIGAGGKSKGRPEKAVVTLDQVRYRDPVHRTACFGLFSSLGQLKQVHTWSTEGDELPDSEYFILENIARLKRARRQRLRMTVGSVAGSVSAAAAVAVAAAFYFRSKQRRWKKEQEKLTRIMQRLPGVPTQVDFADIRKATASFHETTRLGTGGFSSVYRCRLPAASGSTAEVAVKKFTRGVHEERYEDFLAEVSIINRLRHKNVVPLVGWSYHKGEPLLIYEYMKNGSLDQHLFRRGGDGEQRHQQEETSIRQWHTRYSIVRDIATGLHYVHHEHEPMVLHRDIKASNIMLDSNFHARVGDFGIACTVAADRSSATGMVGTWGYIAPDYAMSHRATRQTDIYAFGVLVLEIVTGKKNMDVPTEDGHISGWVWRLHGEGQLLEAVDGVVLTQSRMNPEEIAGQAKRLLLLGLACTNPNPSSRPSMAEAVQVITKLAPPPEVPLERPKFVWPPEPEEWRSLDDSDNSTTVMSNFGASFASTVEISTPRAEAFQGSRAIRAEGRQQLPHESP

SEQ ID NO: 29587 - DNA, 543 bp, Panicum virgatum
  misc_feature: Ceres CLONE 1892499
  misc_feature: Encodes the peptide sequence at SEQ ID NO. 29588
ggtctcccaaccagattacctcacaccccagttctcccagggcccgggccatgggcagcgcgtcgtccccgccgccgcggcggcggtggagctgggcctcggcgctcgccggcgcggcgacgacggccgccgcgacggcgctggtgctgtgccggccgcgggacccccgcttcgagctcatctccgtcagcctgtccaccttccacttccgcccgccggcggcgctggacatcggcctcaccctcacggtgcacgccaccaacccaaacgtcgtgcccgtgcgctacgggccctccaccgtctccatcctctacggcggcgcgcacctcggcacggcgcgcctcgacgccggcgggcagcccgccacgtcctgccgcctgctccacctcccggcgcgcctcgacggcgtcgagctcgcgcaccgcgcgcgctccatcatctccgacgtcgcgcgccgccacatggagctggaagccaccgtcgagatcgccggcgaggcggccgtgctcctctggtcccggcccttctcgtccgcatcgacag

SEQ ID NO: 29588 - protein, 164 aa, Panicum virgatum
  misc_feature: Ceres CLONE 1892499
  misc_feature (31)..(164): Pfam Name: Hin1 Pfam Description: Harpin-induced protein 1 (Hin1)
MGSASSPPPRRRWSWASALAGAATTAAATALVLCRPRDPRFELISVSLSTFHFRPPAALDIGLTLTVHATNPNVVPVRYGPSTVSILYGGAHLGTARLDAGGQPATSCRLLHLPARLDGVELAHRARSIISDVARRHMELEATVEIAGEAAVLLWSRPFSSAST

SEQ ID NO: 29589 - DNA, 2488 bp, Panicum virgatum
  misc_feature: Ceres CLONE 1892501
  misc_feature: Encodes the peptide sequence at SEQ ID NO. 29590
cttgtcctcctcccgaattaaaacgctcgacctgccgaagccgggccaaaccctaggtcccgattcgtcccctcgcccgcgctgctcggattcgatcgggctgggcgcggtgtcggatcggcggcgggatgacgatcccaagcgcggagggcttcctccaggcctcgagctgcctcccgtgcacggcggaggaggagcgagagctcgtccgcgcgctcaccagggaggccgaggagaatgtcaaggacggggatctccgctacctcgtctcgaagagctggtggatggagtggcaatgttatgtgggctttgtcagttgcgatgagaatggcactgatcagcttcctcaggctacgaatagacccggacagattgataactcaaagcttgtttcagcagaaacaatcagtggtagtgaagagccagagcttcgaaggaccttgatagacggggaggactacattttggtaccacaacaagtttggcggaggctacttcaatggtataaaggtggaccagaaatctccagaaaagtagtttttggtaacccaactcacaaggattacatagtggatgtctatcctctctgtctaaaactaattgacggaagagacaattctgaacagaatatcagaataagtagaaaggccaaaattcatgagctttatttagtagtttgctcactcatgtcagtggagaagtctgagattatcatctgggactattaccaaaagtcaaagagcaagaagttgactaacctcaatgagacactagaagaagctcaaattaacatggaccacgagatcctcttggagatgaaggtagatgagagcagttcaggttttagttcaagatccacaaataatgagttggcactaattcttttaggaccttccacatcatcattatcaattgctggagggcccaccatttcaaatggtttttcatctggaattggttctagtttttcgcaagataatagcttcagtcctttactaaaggactcagcagatggttacaacagtttcagcaatggaactaaggatgatactcatggattgagtggtttacataacttgggcaatacatgcttcatgaatagtgccatacaatccttggttcacacacctcccttggtagagtactttttggaggactatactcgtgagataaacacagaaaatccactagggctccagggtgaacttgcagtagcatttggagagctacttacaaaactttggtcatctggtcgaacatctgttgctccacgtgcatttaaatcaaaactttctcgttttgccccgcagttcagtggttataatcagcatgattctcaggagctacttgcatttctgttggatggattgcatgaagatctcaaccgtgtcaaaaagaaaccatatattgaggcaaaggatgctgatggccgtccagatgatgaatttgctgaagaatgctggaataaccataaagctcgaaatgactcaataattgtagataagtttcaaggtcaatacaagtctacattggtgtgcccagtttgtaacaaaatctctgttacctttgacccatttatgtacttgtcactaccattgccatcaactgttactcgaatgattactgtaactgtattcaatggtactggagatgctcttccaatgcctttcactgtgacagtacagaaaaatggaaattgccgagatcttaccaaagcccttgctgatgtttgctgcttgaagagttctgagacattgttgcttgcagaggtgtacgagcgtcgaatctaccgctaccttacaaatccaattgagggacttcacaatataaaagatgaagatatacttgttgcatataggctcccaattggtcatgaaaaacttttgaggttggagatcctgcaccgtagggcagacagatttgctgctgaaccccagtttaatatcaaccggaagctcattgggtgcccccttgtgacttgtattcctaatgactctactggaaaatctgacatttatgcggctgtctctgctgttcttgttccatttgagcgagcaaaagcacatggccctgatgtgtctgcagtcaagttgaatggcaatgggccaagtctggatggtattgtactaatggataatggcaccacctgcgaggagggtatctctacgtcaactggggatgataatgcagttgatgaacatttaccttttcagctttccatgactgatgaaagaggtagtgtgagaaatgctataaacacggattcaaatcgtgttttaggaatagttttaagggttttgatggattggtctgatagagagcatgagatgtacaatattgattacatggatgaacttcctgaagtcttcaagcctggttttttgtcaaagaagacccggcaagaagcagtgaatttattttcatgcttggatgcctttctgaaagaggaacctctggggcctgatgatatgtggtactgccctggctg

SEQ ID NO: 29590 - protein, 786 aa, Panicum virgatum
  misc_feature: Ceres CLONE 1892501
  misc_feature (309)..(576): Pfam Name: UCH Pfam Description: Ubiquitin carboxyl-terminal hydrolase
  misc_feature: SWISSPROT Homolog: EC 3.1.2.15 Ubiquitin thiolesterase
MTIPSAEGFLQASSCLPCTAEEERELVRALTREAEENVKDGDLRYLVSKSWWMEWQCYVGFVSCDENGTDQLPQATNRPGQIDNSKLVSAETISGSEEPELRRTLIDGEDYILVPQQVWRRLLQWYKGGPEISRKVVFGNPTHKDYIVDVYPLCLKLIDGRDNSEQNIRISRKAKIHELYLVVCSLMSVEKSEIIIWDYYQKSKSKKLTNLNETLEEAQINMDHEILLEMKVDESSSGFSSRSTNNELALILLGPSTSSLSIAGGPTISNGFSSGIGSSFSQDNSFSPLLKDSADGYNSFSNGTKDDTHGLSGLHNLGNTCFMNSAIQSLVHTPPLVEYFLEDYTREINTENPLGLQGELAVAFGELLTKLWSSGRTSVAPRAFKSKLSRFAPQFSGYNQHDSQELLAFLLDGLHEDLNRVKKKPYIEAKDADGRPDDEFAEECWNNHKARNDSIIVDKFQGQYKSTLVCPVCNKISVTFDPFMYLSLPLPSTVTRMITVTVFNGTGDALPMPFTVTVQKNGNCRDLTKALADVCCLKSSETLLLAEVYERRIYRYLTNPIEGLHNIKDEDILVAYRLPIGHEKLLRLEILHRRADRFAAEPQFNINRKLIGCPLVTCIPNDSTGKSDIYAAVSAVLVPFERAKAHGPDVSAVKLNGNGPSLDGIVLMDNGTTCEEGISTSTGDDNAVDEHLPFQLSMTDERGSVRNAINTDSNRVLGIVLRVLMDWSDREHEMYNIDYMDELPEVFKPGFLSKKTRQEAVNLFSCLDAFLKEEPLGPDDMWYCPG

SEQ ID NO: 29591 - DNA, 649 bp, Panicum virgatum
  misc_feature: Ceres CLONE 1892501-R
agatcgctgccaagaaagcacacaatgagaaagatgatgtcatcaagctttggttccgtcaggcctctcatctcttcgcatgcaatcagtggctgaaaataatccagcaggagaatattgtcctccagctcaagcataaagcgcatcagatagcgtccataatacctgaacttccatggatgaccctgaaggagaagcctacacagggtcaacaccggaaacattggactaggcgaaaaggtcgaaggcagaagaagggaggcagcttctttgatgcgatcttatttgcagtcgcgctaggtcttgctggtcccggttttcttctcggttcgcccctgggtcggctgttgccaaccctgtagagagttaggtaagcattttgctgcgtagatccatagatggaaggtccaggtgggcccttctccccttcatgagccatggtgtcaaatgatcaaaatctgttaggccgggatctgttggtttcgaaatggattctggtgcgtgcaaagacgtaaatgaatctccatactgcacatgttttttttttggttttgtcttggtgtaaatatgcgtctatttggtatctctgaatattgtacatatgaatcactgttgaattgtcaactttgtcgtctgtctggttcagcac

SEQ ID NO: 29592 - DNA, 2320 bp, Panicum virgatum
  misc_feature: Ceres CLONE 1892509
  misc_feature: Encodes the peptide sequence at SEQ ID NO. 29593
acgtgagacgaacgcgactcgagttgaagaggcggcggcgatacagagaaacgcgacaggtcgagaacggcagccgccatggaggacagagcgccgcttctgctgccgcagtacacgttgcgggacggcggcgacggacgggaggagaagtgcggcggcggcgtgaggtggtggagggacctggcgcgggaggccggcaaggtcgggtacgtggccctgccgatggcggccgtgagcgtgtcgcagtacgcggtgcaggtggcgtccaacatgatggtcggtcacctccccggcgtcctcccgctctccgcctccgccatcgccacctcccttgccagcgtttccggtttcagcctccttattggaatggcaagtggattggaaactttatgcggccaagcctatggtgcaaaacagtacgacaaattgggaatgcacacctatagagctatagtcacactcatagttgtgagcattccaatatcacttctgtgggttttcatagccaaactcctcatcctcataggtcaagatcccttgatctcaaaggaagctgggagatatatagtctggttgattccaggactctttgcatacgcaatcagccagcctctcacaaaatttctgcagtctcagagtctgataattcctatgctttggtcctccattgcaacactgctcctgcacattcctatttgctggttattggtgttcaagaccagtttggggtatattggagcttctttggcgataagcttatcatattggttaaacgtaattatgcttgctgcttacatcagatgttcgaattcttgtaaggagacccgtttgcctcctacagttgaggccttcaaaggagttggtgtgtttctgcgcctagctctgccatctgcactgatgctgtgttttgaatggtggtcctttgagatcctcattcttctctcaggaattttaccaaatccagaactgcaaacttcagttctttcaatctgcctgacaactatcacgttaatctatactataccttatgggtttggagcggctgcaagcactagggtagcaaatgaattaggtggtggtaaccccgaaggagctcgatcagctgtccgggttgtcatgtgtattgccgtgatggaggcggctatcatcacagtaatattgttggcatcacagcacatcttgggctatgcatatagcagcgataaggaggttgttgcgtatgtcaatgcaatggttccatttgtgtgcatctctgttgctgctgatagcctgcaaggagttctatcaggtcacatctctatacttcctttagctagttgatctgcctttccttcaaaagagtaaagaaaaaaaaatcttcctggtcttaaaacctcaaaaacacatcttccaattataccagtaaagtatgaaacaaacttgttatcggtctttacaccaaactaaaacgccctgtaccccttagtttgatctctataattcaatctgtgtgctcttgtcaattttggtatgaagccctatcaggtggcaagtgaccattacagttttgtcagtcgtgccaatgtcatataccaggtaacacgccgcttctgttcttagtttcttccacggtactaatgctattctgtgttgtggaagcaaaattttgttactcggggagttacttgtttattccttcgaaaatgggctcttacgtgaacatggatgccggtgttttcatcaacacgcatctagcagagatgttaccgtattgctagaggatgcgggtggcagcacttgggcgcctatgtcaacctgggctcattctatctcgttgggatcccaacggcagtcttgctcggctttgttctaaagatggaaggaaaagggctttggataggcatttcctgcggctccattgtgcagtttttactccttgccaccatagcattcttcagcaactggcagaagatgtccgataaagcgagggagagagttttcagcgacgagctgtcagacaaggtaccttcggaatcggatggatcggaaatgccttaattttggcacgagtcctctgatcccttaacctgaacgtgaagaagcgcacgagatgatatacaagagaaagtgaaaagaaaaaaacacttacggaatttcctttttctgctgccttgctttggagggactctgaactctatgtacaggggatttgctgaacgctgaccacttctgtgttctttgctggtgttgtttgaaactgggacagttgtatcagaaacacgacatatgatgattatatggtagataggagcaaaaagagctttgcttttgtttggttacc

SEQ ID NO: 29593 - protein, 413 aa, Panicum virgatum
  misc_feature: Ceres CLONE 1892509
  misc_feature (48)..(209): Pfam Name: MatE Pfam Description: MatE
  misc_feature (270)..(411): Pfam Name: MatE Pfam Description: MatE
MEDRAPLLLPQYTLRDGGDGREEKCGGGVRWWRDLAREAGKVGYVALPMAAVSVSQYAVQVASNMMVGHLPGVLPLSASAIATSLASVSGFSLLIGMASGLETLCGQAYGAKQYDKLGMHTYRAIVTLIVVSIPISLLWVFIAKLLILIGQDPLISKEAGRYIVWLIPGLFAYAISQPLTKFLQSQSLIIPMLWSSIATLLLHIPICWLLVFKTSLGYIGASLAISLSYWLNVIMLAAYIRCSNSCKETRLPPTVEAFKGVGVFLRLALPSALMLCFEWWSFEILILLSGILPNPELQTSVLSICLTTITLIYTIPYGFGAAASTRVANELGGGNPEGARSAVRVVMCIAVMEAAIITVILLASQHILGYAYSSDKEVVAYVNAMVPFVCISVAADSLQGVLSGHISILPLAS

SEQ ID NO: 29594 - DNA, 2243 bp, Panicum virgatum
  misc_feature: Ceres CLONE 1892515
  misc_feature: Encodes the peptide sequence at SEQ ID NO. 29595
aaaatgggctggaaacccccacggccccacctcaccccaccgctacaccgaggcggagctccgtagaagacgacggcgtccgagcggccgcagcgcagcccgccgcctcaaaacctcggacacaagctgctccgttccctccccattaagcctccccccaccctcccccgtccccttccccatcactctcgccgccattccccttggcctgctgctgctgctggtggtggtggttccccaaatccaagcctccgactcggccgcacgtccgagctcctctcgagccggccttccgcgccgtcgtggtcccccttgcgcgcaaatagccatggatgagatccctgccaccgccgccgtcctcgacttccgacccggttcatctctcccacgcgactccgccgttccgcgccgtgacaccggcggtgcagaggaggcggcgggagttccgggtttggatgacaaaggcgccgttgcagcggagttgacggggtcaaaatcggccgtttccgagagccaggctgtgagtggtgatatgtccggaggtcacgccggcggtgatgccggaggcgtggatgttttctgctcagagaatggcgccgagctcgaatcggcggaaccgggtgttctggacgtaagattaggggctccagtggcgggacgccatggccggaagctggatggtacgggttttggctctgatcaagctggtgaagtggaggggatttcactggttgaggtgtccccatcagatgccagttcaagtttggatgccactaggtcgattggtggcaactccctcgtggaggggtctctgccagaggacagaggtgctcgaggatgtgaacaagaggtgcaggacggaccaaaagggacctctactgctgtgggcttccccaatggggatttgagtcctggatttggaattcagccgagtgatgatgtggatggtagaaatggccttgccggaggggaattagaattgtctactgatggtgacgatgccaagcaggccacagagatggctggtatcttgtgtaacgaaagagtggaggggatggtgactaatttgggggaacttgaggcctcaaatggttccacagaccgagtggacaggatgcagacgagtttggatgactctgaggcttcggacggctccatcacgcaggattctgatactgacgtcgagacagagtcgagtggttctagtatagaggaacaagacgcaggatacggagcccacatccctcaactggatcaagcaatctgcaaggtggccagagaaaacagcacgtcaggaacaaatagctctgataggatgatttcagtacccaaatcaacgcttgttctggcttcaggtgcagcaatgctaccacatccttcaaaggtatcgactggtggtgaagatgcatattttatagcttgcaatggctggtttggtgtagctgatggagttggtcagtggtcatttgaagggatcaatgctggactttatgcgagagaactgatggatggttgcaaaaaggttatagcagaaacccaaggcgctccagggatgagaactgaggaggttcttgcaaaggctgcagatgaagcacggtcccctggttcttccactgttttagttgctcactttgatggccaggtcctacatgcatcaaatataggagattctggttttcttgtgataaggaatggagaggtccacgaaaaatcaaaaccaatgacttatggtttcaatttcccattgcaaattgaaaagggtgatgaccctttaaaacttgtacagaaatatgacatcgatctacaagaaggtgatgtgattgtaacagcaacagatgggcttttcgacaatgtgtacgaggaagaagtagctggcactgtatccaaatctttagaggccgatctcaagcccacggagatcgccgagctcctggttgctagagcaaaggaggtggggcggcgtggatttggaagtagcccattttcggacgctgctctcgatgctgggtacttgggttactccggaggcaagctggatgatgtaacagtcgttgtatctattgttcggaaatctgaagtttaaactataaaacaagcacccgaaagttcagtgcagcccgagtttttgctacagctgcacgcgctagcaaatgcccatgagcattttgtgcgccatgagccacagacctggcttacgctaagccaaacgtgtatacagttatacataaaaaaaagattgtgtc

SEQ ID NO: 29595 - protein, 584 aa, Panicum virgatum
  misc_feature: Ceres CLONE 1892515
  misc_feature: SWISSPROT Homolog: EC 3.1.3.16 Phosphoprotein phosphatase
MDEIPATAAVLDFRPGSSLPRDSAVPRRDTGGAEEAAGVPGLDDKGAVAAELTGSKSAVSESQAVSGDMSGGHAGGDAGGVDVFCSENGAELESAEPGVLDVRLGAPVAGRHGRKLDGTGFGSDQAGEVEGISLVEVSPSDASSSLDATRSIGGNSLVEGSLPEDRGARGCEQEVQDGPKGTSTAVGFPNGDLSPGFGIQPSDDVDGRNGLAGGELELSTDGDDAKQATEMAGILCNERVEGMVTNLGELEASNGSTDRVDRMQTSLDDSEASDGSITQDSDTDVETESSGSSIEEQDAGYGAHIPQLDQAICKVARENSTSGTNSSDRMISVPKSTLVLASGAAMLPHPSKVSTGGEDAYFIACNGWFGVADGVGQWSFEGINAGLYARELMDGCKKVIAETQGAPGMRTEEVLAKAADEARSPGSSTVLVAHFDGQVLHASNIGDSGFLVIRNGEVHEKSKPMTYGFNFPLQIEKGDDPLKLVQKYDIDLQEGDVIVTATDGLFDNVYEEEVAGTVSKSLEADLKPTEIAELLVARAKEVGRRGFGSSPFSDAALDAGYLGYSGGKLDDVTVVVSIVRKSEV

SEQ ID NO: 29596 - DNA, 2551 bp, Panicum virgatum
  misc_feature: Ceres CLONE 1892523
  misc_feature: Encodes the peptide sequence at SEQ ID NO. 29597
agatcgtggccacgatcttgcctccctgcgccgcctgctctcccgtctcgctcggcgtcgcctgctctcccgtcccgccctgcgccgctggcgaccgtgccaccccggcgagctgcacccctcaccgaccgactcgcacccccgccccatcccacgccgccggctcgtttctgattttgcataccctgaattccccccccccagttgttggtttccagttagattgatcattccgctccgctcctcccgtcgccatcgacggttccgtgctctgcgagttcgatctgtttttttttttccagccgccgtcgaccactaggagagctccttctgatggcgccggagtcctgccacttgatccgctcggcctgccttccactccgcatgagctccctcagcacactcgggagcttccatctccggccccttgcgctggacccgtggcagcaaggcgtcgattgcgagtttcctcacgctcgacggcggcggcttcctcctcaccttgagcaggggaacgctttggagatccaccggcccaggtacacaagatcagaccgacgtggagcagctcacaagagtttctgatttttcggatgaatcgctgctgattcccccgcatggtgcaaggtgccatctaccctcacccttattggacaatttctatcataggtgccgatgctttgtccaggttgtagttcaaattaggttgttgtaaacggtatctgtgtgactcttatcgaactttcccttccctgttcttgtcagtgtatcctaacaaaatgtcgatccacagggttggttctcaaccgagcagtggggggtgacgccacacccgcacgcttccatgacttccatgacttatcctgtccaagtaaccacgatgtcaaagccctttataggcagatgtgcttcttgattagtgttagtttgatagtgatttatcttagactaatgttcaaccaacaattaatataacaaccatttcaaaaaaaaaacaattaatataacaccttcagctttcagttataaggacgcttaggcataattccattttctatgttatcaattttaacaggaggaatagaaactgaatcaatcacagagatctatggtgaatttcgctctgcaaagactcagttgggccacactctctgtgtcacatgttcaggtattgcgctgaaataccaattctaagatgccttatcaccataaccttaatgctggcatgatttttagaataacgtgctccattatgtctttgtctgtatattgaaaaggtgcctactatttacagctctttggtgcaaggaaaatatattagtctgctcttcttgcagtaattgtgtaatttgttttttagtttggcaaatgtggtggtgatttatgcagctcccattggaccaaggtggtggtgaaggaaaggctttgtatattgatgcagagggaacattcaggccgcaaagacttctccacatagcagacaggtttggcttgaatggtgctgatgtactggagaatgtggcttacgccagagcatataacactgatcatcaatcaagacttttgctggaggcagcttccatgatggtggagaccaggtgagtttatccatttatatagaaatttttgatatacatgtctagcaacagtgacaaactaaacttgctaaaaacattgtacatgggttcttcattggacaaaacctctgtactattcgaactgatatcttgtggggcagaccaatttgttacatttgctttagtttggaagatcctaatggtgtgggtttagggttgtatgataatgctagtgaaagcaagtgacaagccattttgtattatcaataatagttaggttatatttacgactgattttgccatgttcaatttcgatcttcagaattttttctcatagtagcgttatagtatctttgtgcctacaaattacatattctaatagcatgtctcttctacttttcaaaaacaatacaaatttttctattgggtgattgctgatgagctgaaagatctgctaaactcaggccattgacgtgagtcgtgtgactatgcttacggcaacatcactgcagaagtatttatcatgtattttgtttagacattacagtacatgcatgggtaaccttatgctgacaagacccgctttatgctctttcttctttctatataggaagaaccaagcacagaagcgctgtctttgtttcatccttggacctctgattacttggatgccagatttgtctgtacaccattttgttgagtgccctgatggatttttttgcagatagcatgtgttgtacaatagattctgagttttatgagaggatggtatatacagagcttctgtgtatagattcttatgaaaatgtaagtcggagtgtcggataacagaaatatgactctacattgtgtgtttttggtaattatgaaccggcttagaaaaaaagtggggagtctataagctcctggtcctaaatcaaacattttatgttttgtctcatagtttctgatgtaaagaatatttaatttaatct

SEQ ID NO: 29597 - protein, 72 aa, Panicum virgatum
  misc_feature: Ceres CLONE 1892523
  misc_feature (2)..(72): Pfam Name: Rad51 Pfam Description: Rad51
MQLPLDQGGGEGKALYIDAEGTFRPQRLLHIADRFGLNGADVLENVAYARAYNTDHQSRLLLEAASMMVETR

SEQ ID NO: 29598 - DNA, 573 bp, Panicum virgatum
  misc_feature: Ceres CLONE 1892548
  misc_feature: Encodes the peptide sequence at SEQ ID NO. 29599
ccccggccggccgtgctagctagctgcagccacagcccacagctatcgatcgcgcctccggcggacatcctcggcatcggcgatcggagacttgaagagacggccggggataatggaggcgccgccgggtcttgcgctgctcctgttcttcggcacgttgctggtgctgccgcagtcgtcgcacggcgcgacaagatactacaccttcaatgtgacgatgcagaacgtgacgcggctgtgcaccacccgcgccatcccgacggtgaacggcaagttccccggccccaagatcgtcaccagggagggcgaccgcgtcatcgtcaaggtggttaacaatgtcaaggacaacgtgaccatccactggcacggcgttcggcagcttcggacggggtggtcggacgggccggcgtacgtgacgcagtgcccgatccggacggggcagagcttcgtgtacaacttcaccatcacggggcagcggggcaccctcttgtggcacgcgcacgtctcctggatgcgcgccacgctctacgggcccatcgtcatcctccccaagcgcggcgtgccctacccctt

SEQ ID NO: 29599 - protein, 153 aa, Panicum virgatum
  misc_feature: Ceres CLONE 1892548
  misc_feature (33)..(149): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 51145
  misc_feature: Useful for making plants with altered carbohydrate content
  misc_feature: Functional homolog of the protein sequence given in SEQ ID NO 50393
  misc_feature: Useful for making plants with altered cell wall content and/or composition
  misc_feature: Functional homolog of the protein sequence given in SEQ ID NO 50394
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MEAPPGLALLLFFGTLLVLPQSSHGATRYYTFNVTMQNVTRLCTTRAIPTVNGKFPGPKIVTREGDRVIVKVVNNVKDNVTIHWHGVRQLRTGWSDGPAYVTQCPIRTGQSFVYNFTITGQRGTLLWHAHVSWMRATLYGPIVILPKRGVPYP

SEQ ID NO: 29600 - DNA, 638 bp, Panicum virgatum
  misc_feature: Ceres CLONE 1892559
  misc_feature: Encodes the peptide sequence at SEQ ID NO. 29601
acatccacattctggatgctgctttgcttcggcggccgccgccgagtctgaggatggcgcaagtgcaaggatcaccgccatggtctgaccttccgccagagctccttggcctggtgttcctacgcctccctacccgtgccgaccgagccttctttcctgtcgtttgccgcacatggtgctccgcggcgcggcagtgccgccagccctcgccgtcaccagtgccatggctcgtgctaccaggcggcaacgtcatcagcatccctcacggcgaaaccttccagctgctggagggcttgcgctaccacaactcttgtggcgagtggcttctcttgtcgcgggatgatggcagctgcttcttgatgaacccattcaccaaggccaccatgccgcttcccagcttgtcttcatacagctgctacgaagagcctgtggaagtcgccgaagattgtatggtcccagacgatgagatgcaaggcacgtggatgtacaacaaggacacaggtgacgtatccgtactcgcactagttgtgtgctccacacgcctcattgctgccatagtcgctgttggggatctcggtacaattgcactatgccggccaggggctgctgcatggtcagtgagtgcacacgaggactgc

SEQ ID NO: 29601 - protein, 194 aa, Panicum virgatum
  misc_feature: Ceres CLONE 1892559
  misc_feature (8)..(56): Pfam Name: F-box Pfam Description: F-box domain
MAQVQGSPPWSDLPPELLGLVFLRLPTRADRAFFPVVCRTWCSAARQCRQPSPSPVPWLVLPGGNVISIPHGETFQLLEGLRYHNSCGEWLLLSRDDGSCFLMNPFTKATMPLPSLSSYSCYEEPVEVAEDCMVPDDEMQGTWMYNKDTGDVSVLALVVCSTRLIAAIVAVGDLGTIALCRPGAAAWSVSAHED

SEQ ID NO: 29602 - DNA, 608 bp, Panicum virgatum
  misc_feature: Ceres CLONE 1892567
  misc_feature: Encodes the peptide sequence at SEQ ID NO. 29603
acaccagtttcaattgctcgctcgctcgcacgcgcaaacgccgcctcttcctcctcccgtcctccccccactcgccgcacccgtttccccagatcccaaggaacgaacccaccccgctcgccgcgggcattttctcgaacacccagcgcgcgcgcgggcgctcccccgccgccgcccatgggctccctcccggttaacgcctcgccggaatgcgccccgcaggggcgcgccacggtgtcggcgtcggacctggcgccgctcttctccgcgcagcgccggcacctggaccacttcttcgaccgcctcgacatgtcgcaggcggcggcgttcgcgcaagcgctgctcgacgcgcccggggccgtcttcttcacgggcgtcggcaagtccggcatcgtggcgcggaagatcgcgcagacgctggcgtcgctgggcttcgcgcgggcaggcttcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatcccgccgccgcccatggg

SEQ ID NO: 29603 - protein, 143 aa, Panicum virgatum
  misc_feature: Ceres CLONE 1892567
  misc_feature: SWISSPROT Homolog: EC 5.3.1.13 Arabinose-5-phosphate isomerase
MGSLPVNASPECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLIPPPPM

SEQ ID NO: 29604 - DNA, 1339 bp, Panicum virgatum
  misc_feature: Ceres CLONE 1892570
  misc_feature: Encodes the peptide sequence at SEQ ID NO. 29605
gtcatgcaggaagccaacccggccgcgaggaggagtcctctccgacgcgcaaccgcctcttccgccgccgccgctccgtggcgcccctcgcacgcgcgcgagcagcggacggtccgccggcctccatggtcatcgggcggaggacagccacggctgcggcgatgagcgcccacgcaagggcggggatggccgtggccgtgctgtggctccttgcggtagcggcggcggcgccggcgccgcggcggatcctggtggacacggacatggacaccgacgacctgctcgcgctgctctacatcctcaagcacagccgcgccgagttcgacgtcaaggccattaccatcaacgccaacgagtggagcgacgccgggcacgccgtcaaccacctctacgacatcctctacatgatgggccgcgacgacgtcgccgtcggcgtcggcggcgacggcgggatatccggcgtcggtgacgtccgccccgacgtcggcggctacctgccactgatcgaccagggaatgacgacggccggaggctgccggtaccggcaggccatcccgccggggcgcggcgggcggctggacgtcgacaccaactccggcgtccggaggggcttcctcccgcagggtccccgtgggtaccgcccgctccggcagcccacggcgcagcgggtgatggcggacacactctccgccggcccgaccacggtgatactcctcggcgcgcacaccaacctcgcgctcctcctcatgacgcgcccgcacctgcggcggaacgtggagcgcgtctacgtctccggcggcgccgtcagggccccgggcaacctgttcaccgccgccgccgccaacccggccgccgagttcaacttcttcggcgaccccttcgccgcgtaccaggtgctccactcgggcgtcccggtcacgatgatccccctcgacgcgaccaacacgatccccgtcacggaggagttctacgccgagttccggcggcgccggagcacgcacgaggcgcagtacagcttccaatcgctggacgaagtcctggcgcggcagatgaggcggcccggcggcggccatgccaacacgggctactacatgtgggactccttcgccgccggcgtggctctctccggcatgcgccatggcgaggccggcggcgtcaatgagtttgccgagcttgagtacatgaacatcaccgtggtaacctccaacgaaccgtacggcgcgcgcgacggctcgaacccttttttcgatggccgtgctactccgaagtttggactgcaagagggtggagttcacagtggccatgttcagactgggatcaaagatgccttctgcctggt

SEQ ID NO: 29605 - protein, 404 aa, Panicum virgatum
  misc_feature: Ceres CLONE 1892570
  misc_feature (38)..(371): Pfam Name: IU_nuc_hydro Pfam Description: Inosine-uridine preferring nucleoside hydrolase
MVIGRRTATAAAMSAHARAGMAVAVLWLLAVAAAAPAPRRILVDTDMDTDDLLALLYILKHSRAEFDVKAITINANEWSDAGHAVNHLYDILYMMGRDDVAVGVGGDGGISGVGDVRPDVGGYLPLIDQGMTTAGGCRYRQAIPPGRGGRLDVDTNSGVRRGFLPQGPRGYRPLRQPTAQRVMADTLSAGPTTVILLGAHTNLALLLMTRPHLRRNVERVYVSGGAVRAPGNLFTAAAANPAAEFNFFGDPFAAYQVLHSGVPVTMIPLDATNTIPVTEEFYAEFRRRRSTHEAQYSFQSLDEVLARQMRRPGGGHANTGYYMWDSFAAGVALSGMRHGEAGGVNEFAELEYMNITVVTSNEPYGARDGSNPFFDGRATPKFGLQEGGVHSGHVQTGIKDAFCL

SEQ ID NO: 29606 - DNA, 646 bp, Panicum virgatum
  misc_feature: Ceres CLONE 1892577
  misc_feature: Encodes the peptide sequence at SEQ ID NO. 29607
ggatggccagactctcatgaaccttgagattttcagcaacaacttcgatggcggttcatcaggtactttatataagcaccttaatcactgtatcacagcatctggtaagaggctgctaagaaggtggatttgtcatccacttaaggacattgatgctatcaataaaaggctcgatgttgttgaggccttcatccagaactgtgggctaggccctacaacacttggatatctccgcaaaatacctgatcttgagagattgttaggacaagttagatccactgttgggttatcatctgcagtcagattgccctttgttggagaaaagattttaaagaaacggatcaaaacatttataatgcttatcaatggcctccggaatgcacttgatttattaaatgacttacaaagagcggatcatggtgtctcagcactttataaggctgtagagattccaacattgagctcctttcgtgaattgatccataaatttgaagaggaagtacaaaatgaatttccacattaccaggaccttgatgtcaaagatggtgacggaaacactttggctgttaaagtggaacattttgttggaaaggcttcggaatggtctttggtgatcaatgctgtgagcactattgatgtgcttaga

SEQ ID NO: 29607 - protein, 214 aa, Panicum virgatum
  misc_feature: Ceres CLONE 1892577
  misc_feature (1)..(214): Pfam Name: MutS_III Pfam Description: MutS domain III
DGQTLMNLEIFSNNFDGGSSGTLYKHLNHCITASGKRLLRRWICHPLKDIDAINKRLDVVEAFIQNCGLGPTTLGYLRKIPDLERLLGQVRSTVGLSSAVRLPFVGEKILKKRIKTFIMLINGLRNALDLLNDLQRADHGVSALYKAVEIPTLSSFRELIHKFEEEVQNEFPHYQDLDVKDGDGNTLAVKVEHFVGKASEWSLVINAVSTIDVL

SEQ ID NO: 29608 - DNA, 2623 bp, Panicum virgatum
  misc_feature: Ceres CLONE 1892582
  misc_feature: Encodes the peptide sequence at SEQ ID NO. 29609
tcctctcccaactgacgaagtgacgacaccccttcccctctctctacagcttcgccattgccgtttgtccccgtccgcgccgtgacagctgtcggcctgtcaccgcgcgatggcgcgctccccttcctctccgaaggccgccgccctgctcctcctcctgccgctgctgctcctctgcgcgggcgccgccaccctcgcggcggcgcaggcgctgccgctggcgtcgtcgcaggccaaggcgctcctccgcgtgcgccgcctgctgggctacccgccggcgctcgagccgctgcggcgcgcgccggacccctgcgcgctgccgccggcgccgtccctcgccgtggcctgcgagggcggccaggtcacggcgctctcggtccgcggcgaccgcgacccgggcgccgcgctcccgcccaccttctccgccgacgcgctcttcaccacgctcaccaggctccccgcgctcgcgcggctctcgctcgtcgggctcggcgcctggggcccgctcccgggcgccaagctccgccgcctccaggcgctgcagcacctcaacctcagctccaactacttctacggcgccgtcccggccgacctcgcccggctctactctctgcagagcctcgtcctgtcgcggaaccggctcaacggctccgtgccgtccctcgctgggctccagttcctcgaggagctcgacctctcgcacaaccggctcgggtcggcgttcccggaggtgggggaggcagtggcgcggctggtcctggccgacaacaacttcaccgggaagattccggcgagggtgagcgctctgggccagctgcagtacctcgacgtgtccgggaaccggctgcaggggtggatcccctcctccaccttcgcgctcccggcgctgcgctacatcaacctctcccgcaaccgcctcgccggggagctgcccgcgaccacggcgtgcgcggaggcgctggcgttcgtggacgtctcggccaacctgctgaccggggcgcgaccggcgtgcatgcggggcaactcctcggcgcgcacggtgctcgtcgcgggcaattgcttcgccgacgccaagcagcagcggcccagcacgtactgcagccccggcgcgctggccgccgtgctgccgccgccgcagggggacggtggcggagggagggggaagggcggcgagatcgggatgatccttgcgattgccggcagcgtcgtcggtggcgcattgctgattgcgctggtgatggtcgtggtgctgaggagggccaggaggcagcacccggatgtgagcgtcctgcctaagtcgccggcggcgacgccagccaggaaatcggacggatggaaggctccggctaaggcgacccagaagattattactcctgctgataagaggcatgcatcgcaagctgctagggtgaatacactggaagtgccagcataccgtgtgtatacactggaggagctcaaagaagcaaccgacaacttcagttcctccaacctgatcaagactagtcctcttgtacagcattataatggtcagcttcaagatggttcaagagtcttggttagatgcctaaggctgaagccaaagtactctccccagaaccttgtccaatacatggagattatttctaaactctggcaccgtcatttggtctgcatcattggtcattgcattttcagtgatcaggagaatcctaatattgccagctcagtatacctcatttctgaaagtgtaacaaatggatctctaagaagtcatcttaccgagtggagaaaacgtgaaatgctgaaatggccacaacgagtttctgctgccattggtgttgcgagagggatccagtttttgcacaatgtgactgctccaggcatagtaaagaatgatctcaacatagaaaatatcttgttggacaagaccctcacatcgaaaatcaatgactttaatcttccaatgatttcaactagcaagaatggcaagatcttctcagagatcccatttgatgtccaggaagataatgatattggcagtgctcataatatcgaacaaggtgacaagcaagtcatctaccagttcggcctaattctcctggaagtgatcacaggcaaaccgacagattctcaaagtgaactggaatccctgaaagctcagctaagcgaggccctgactgaagatccggatagactgaaagacatggcagacccggccatccaaggtactttcgcagtggagtccctgtccacggtcaccgagattgctctcaactgcacgggcagtgaaccgagcgaccggccttccatcgacgacgtcctctggaatctgcagtactccatgcaagtgcaggatggatgggcgagcagcgagagcttagccttgagcgtcaaatcgcaggcctgaagagaagagaaatagagaagggtgcaatgcttttgcttggatccaccgatagcaatgaagttatatgcaccatcaatctgcctcttgtttttgtcgtggaagagggatccttggtgttctctatgtatataaggggattttttttcaggtacctttcagttacctgtaaaactcaggctctatttaatcatcgatgccatgagtatgtgttcatcaagtgacctgacttgatct

SEQ ID NO: 29609 - protein, 759 aa, Panicum virgatum
  misc_feature: Ceres CLONE 1892582
  misc_feature (463)..(735): Pfam Name: Pkinase_Tyr Pfam Description: Protein tyrosine kinase
  misc_feature (438)..(732): SWISSPROT Homolog: EC 2.7.11.1 Non-specific serine/threonine protein kinase
  misc_feature (133)..(271): SWISSPROT Homolog: EC 4.6.1.1 Adenylate cyclase
MARSPSSPKAAALLLLLPLLLLCAGAATLAAAQALPLASSQAKALLRVRRLLGYPPALEPLRRAPDPCALPPAPSLAVACEGGQVTALSVRGDRDPGAALPPTFSADALFTTLTRLPALARLSLVGLGAWGPLPGAKLRRLQALQHLNLSSNYFYGAVPADLARLYSLQSLVLSRNRLNGSVPSLAGLQFLEELDLSHNRLGSAFPEVGEAVARLVLADNNFTGKIPARVSALGQLQYLDVSGNRLQGWIPSSTFALPALRYINLSRNRLAGELPATTACAEALAFVDVSANLLTGARPACMRGNSSARTVLVAGNCFADAKQQRPSTYCSPGALAAVLPPPQGDGGGGRGKGGEIGMILAIAGSVVGGALLIALVMVVVLRRARRQHPDVSVLPKSPAATPARKSDGWKAPAKATQKIITPADKRHASQAARVNTLEVPAYRVYTLEELKEATDNFSSSNLIKTSPLVQHYNGQLQDGSRVLVRCLRLKPKYSPQNLVQYMEIISKLWHRHLVCIIGHCIFSDQENPNIASSVYLISESVTNGSLRSHLTEWRKREMLKWPQRVSAAIGVARGIQFLHNVTAPGIVKNDLNIENILLDKTLTSKINDFNLPMISTSKNGKIFSEIPFDVQEDNDIGSAHNIEQGDKQVIYQFGLILLEVITGKPTDSQSELESLKAQLSEALTEDPDRLKDMADPAIQGTFAVESLSTVTEIALNCTGSEPSDRPSIDDVLWNLQYSMQVQDGWASSESLALSVKSQA

SEQ ID NO: 29610 - DNA, 690 bp, Panicum virgatum
  misc_feature: Ceres CLONE 1892605
  misc_feature: Encodes the peptide sequence at SEQ ID NO. 29611
ctctcttttcccctccctcttcccggtccgaggagcgacctccgccgccgccgccatgccgaagcactaccgccctgcgggcaagaagaaggaggggaatgccgcgaagtacatcacgaggaccaaggcggtcaactacctgcaagtcagccttgcaattttcaggaagctatgtattctcaagggtgtttttcctcgtcaaccgaagaagaaggtggaaggaaaccacaagacatactaccacatgaaggatattgccttcatcgctcatgaccctttgatcgagaagttcaggcaaatcaaggtccacagaaagaaggttaagaaggctattgctaagaaaaacagggatcttgcggacagactgttgaatcggccaccaacatacaagcttgataagctggtccttgaaagatatcctacatttgttgatgctcttcgagacttggatgactgccttacattggttcatctgtttgcggcattacctgctgttgatggtgaacgtgttgaagtcaatcggatccataactgccgcagccatgaatggcaagcatacatatccagaactcattccctgaggaagacatttatttctgtgaagggcatatattaccaggctgaagttcaaggacaaaagatcacttgggtaactcctcatgctcttcagcaagtattaactgatgatgt

SEQ ID NO: 29611 - protein, 211 aa, Panicum virgatum
  misc_feature: Ceres CLONE 1892605
  misc_feature (8)..(211): Pfam Name: Pescadillo_N Pfam Description: Pescadillo N-terminus
MPKHYRPAGKKKEGNAAKYITRTKAVNYLQVSLAIFRKLCILKGVFPRQPKKKVEGNHKTYYHMKDIAFIAHDPLIEKFRQIKVHRKKVKKAIAKKNRDLADRLLNRPPTYKLDKLVLERYPTFVDALRDLDDCLTLVHLFAALPAVDGERVEVNRIHNCRSHEWQAYISRTHSLRKTFISVKGIYYQAEVQGQKITWVTPHALQQVLTDD

SEQ ID NO: 29612 - DNA, 1693 bp, Panicum virgatum
  misc_feature: Ceres CLONE 1892624
  misc_feature: Encodes the peptide sequence at SEQ ID NO. 29613
aataatctcccctgcctgcggacaagcgtgcgcctaaaccctagctcgcctcccgatggcgccgaagaagcgaaaagccgatccggccgagtccgccgccgccgcggagccagccgccgggaaccgcagccaggaaccggcgtcctccgagaacaagccccgcggcaccatctacttccccatcaccgacgacccggagcccaccgcctccgccgaggaggacgaggacgaggtcgccatcgacgatgagggcgaggcggaggacatcgggaagctcctcgagccgctgtcgcgggagcagctcgtgtcgctactccgcacggccgcggaggcgagccccgtcacgatggcggccgtgcgccgcgccgcggaggccgaccccgcgagcaggaagctcttcgtccacggcctcgggtggggcgccggcgccgacgacctccgttccgccttctcacgcttcggcgagctcgaggactgccgcgtcatctccgacaagcagtcgggcagatccaagggctacgggttcgtcctcttccgctcccgccgcgctgcgctccgcgccctccgccgcccccagctccaaatcggaggtcgtcttgctttctgccacctcgccgcctcaggtcccgcacccccagcctctcagtctcagaaccctacctccaacgccaacaccaacaccaacaccaattccaactccgacgccggtaccaccggcaatgcttctggctcctcatcctcgcaacccgataacatgccacgcaagatatttgttggtaatgtgcatgctgatgtggacgtcgaccgcctatttgagtacttctcgcagtttggtgagattgaggaggggcccttgggctttgacaagaacactggcaaacctaagggatttgcattgtttgtttacaagtctgtggagagtgcccgccgtgcattggaggacccagtgaagaattttgatggcaagatgctgaatgtgcagaaagctatagatgggaggaccaagggctcatctgggacaaatgcaaatgctaattctaatgccgccactgcctctgcggccgcagccgcacaaatgactgctcctgccactgctgccattagcccatatgatgcatcagcatatggtactactgctgttactgatttgggttttgcacaacaagctgctatgctgggattaggtgcacaacaacaggcatttgcgcagcccaatgcaatgcttgccatgatagcggcaatgcagaacccagccgcgctggggatgacaccagccatgcttgcagctatgaacccggcctttgctgctgctgcactgggtgctggggggcagcaggcacacacagctggtcttacaggttttggagctcagggatttgggacacaggcatttggagctggaggtgccactttcccaaatgcagtgggtgttcaagctgctgctgctgcatatcaaggagctggagctccccctggttatcaagggccacctgggtttcaggttggccaagcaactacccagactagtactgcagcagctgcggccgccgccgctagtgctgctggttatcaggctggggctgctgggcagggccaagtgcctggtgctcagatcgggggcactggttttcagggtggatactgaaggaactaggtatatcaactctaaacctgttacattgttttatgactc

SEQ ID NO: 29613 - protein, 529 aa, Panicum virgatum
  misc_feature: Ceres CLONE 1892624
  misc_feature (114)..(184): Pfam Name: RRM_1 Pfam Description: RNA recognition motif. (a.k.a. RRM, RBD, or RNP domain)
  misc_feature (238)..(308): Pfam Name: RRM_1 Pfam Description: RNA recognition motif. (a.k.a. RRM, RBD, or RNP domain)
MAPKKRKADPAESAAAAEPAAGNRSQEPASSENKPRGTIYFPITDDPEPTASAEEDEDEVAIDDEGEAEDIGKLLEPLSREQLVSLLRTAAEASPVTMAAVRRAAEADPASRKLFVHGLGWGAGADDLRSAFSRFGELEDCRVISDKQSGRSKGYGFVLFRSRRAALRALRRPQLQIGGRLAFCHLAASGPAPPASQSQNPTSNANTNTNTNSNSDAGTTGNASGSSSSQPDNMPRKIFVGNVHADVDVDRLFEYFSQFGEIEEGPLGFDKNTGKPKGFALFVYKSVESARRALEDPVKNFDGKMLNVQKAIDGRTKGSSGTNANANSNAATASAAAAAQMTAPATAAISPYDASAYGTTAVTDLGFAQQAAMLGLGAQQQAFAQPNAMLAMIAAMQNPAALGMTPAMLAAMNPAFAAAALGAGGQQAHTAGLTGFGAQGFGTQAFGAGGATFPNAVGVQAAAAAYQGAGAPPGYQGPPGFQVGQATTQTSTAAAAAAAASAAGYQAGAAGQGQVPGAQIGGTGFQGGY

SEQ ID NO: 29614 - DNA, 594 bp, Panicum virgatum
  misc_feature: Ceres CLONE 1892627
  misc_feature: Encodes the peptide sequence at SEQ ID NO. 29615
gaaagtaggccctcccctcacttggaagccttctctttgctgccttggcctgcggcggcgctccccctctcggctggctgccgggtccgttcatcccagcgacactctcacacccccgcccacctcgaagaattgctctctcgtattcctcctccctcccgccggactcagattaatctcttcccttgtcggagggaatcatgatggaggtgggcatgaatccgggggaggaattggatttcgggggcaaccaggaaaacgacgacgaggcgggggacatctcccccggcagcaaggagctcgccgccatggtcgaggcagcggccgcggcggagagcgttgagctggacgacggcgccgccgcgtcggcggcgcagtacggggacgaccgcacgccgagggacgggatggtgttcaagtcctacgaggaggtgctcaacttctacaagcgctacgccctgcgcacgggcttcggggtctgcgtcaagaagtcctccttcaccaaggctggcctctgccgccgtctcgtgctcgtctgcaacaagggggggaacggcaaggaggacgcctgctaccaggccaggccgacggcca

SEQ ID NO: 29615 - protein, 131 aa, Panicum virgatum
  misc_feature: Ceres CLONE 1892627
  misc_feature (80)..(129): Pfam Name: FAR1 Pfam Description: FAR1 family
MMEVGMNPGEELDFGGNQENDDEAGDISPGSKELAAMVEAAAAAESVELDDGAAASAAQYGDDRTPRDGMVFKSYEEVLNFYKRYALRTGFGVCVKKSSFTKAGLCRRLVLVCNKGGNGKEDACYQARPTA

SEQ ID NO: 29616 - DNA, 711 bp, Panicum virgatum
  misc_feature: Ceres CLONE 1892629
  misc_feature: Encodes the peptide sequence at SEQ ID NO. 29617
atcgatcactcgggtcgggcggcgccttccttcctccaccaccaccaccaccaggcagcaggctcttctcttctggaagcttccccaaatcgcgacggctccccctcccctccgccgcgccgcgccgccagcttcctccgggagtaagtaagccgtcgtccgtccggttcgacgccaggtggggtggtgtctgccttcccttccctcggtaccaccgccggttccgtggtgccttgtgtttctcccagctagagctagcctcgcctcggccgtttctccgcccgccggcacaatcagcaatcaaaggcagcgcgctgtctctccacggccgtggccctcccgccgggcggcatgcccagacgatcacacacggacacggccactcgtcaccttgcaactttgaaggagatagcaaagtgatttgctgtctcctggcaaccgttgcctgcaaggcccagtgatggcagatgctagttcaaggactgacacctcaactgttttacaagacaacgacaagaatcagaggatggaaaacggacaaattgtggcagctgtgccttctaattcttctgataggtctgataggtccgacaaacctttggaccaaaagaccttgcgacggctagcccaaaatcgtgaggcagcaagaaaaagtcggctgaagaaaaaggcatatgtgcaacagctagagagcagtaagctgaaacttgc

SEQ ID NO: 29617 - protein, 83 aa, Panicum virgatum
  misc_feature: Ceres CLONE 1892629
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
MADASSRTDTSTVLQDNDKNQRMENGQIVAAVPSNSSDRSDRSDKPLDQKTLRRLAQNREAARKSRLKKKAYVQQLESSKLKL

SEQ ID NO: 29618 - DNA, 625 bp, Panicum virgatum
  misc_feature: Ceres CLONE 1892629-R
  misc_feature: Encodes the peptide sequence at SEQ ID NO. 29619
ccgatgtggtagagaaagctccagatggtactccagctggtggtggtctgcttcatgttattgttcatgaagctcaagatcttgaggggaagcaccatacaaacccatatgcgaaaataattttcaaaggcgaggagaagaaaacaaaggtcatcaagaagaatagggatccacgatgggaggatgaattcgagtttgtgtgtgaggaaccacctgtaaatgataagctacatgttgaagtcctaagtaaagccccgaagaaagggctgatacatggcaaggaaactttgggctacattgatatcagccttgcagacgtgatcagcaacaagcggattaatgagaagtaccatctcatagactcaaaaaatggccagatacagattgagatgcaatggagaacttcctagacagcagaaagaacttgaatgcctgaatgtagtacaggaatgagatatggatgtcgatgttcctattactcagtttgcggaattctgtaattgagctctagtcgatatttgctccgtttctagacatctgttgttgagattttttttttctttggtcttatggaacttattctgtgagtaatacagatcatacaagtatactcagcattctgtcg

SEQ ID NO: 29619 - protein, 135 aa, Panicum virgatum
  misc_feature: Ceres CLONE 1892629-R
  misc_feature (17)..(100): Pfam Name: C2 Pfam Description: C2 domain
DVVEKAPDGTPAGGGLLHVIVHEAQDLEGKHHTNPYAKIIFKGEEKKTKVIKKNRDPRWEDEFEFVCEEPPVNDKLHVEVLSKAPKKGLIHGKETLGYIDISLADVISNKRINEKYHLIDSKNGQIQIEMQWRTS

SEQ ID NO: 29620 - DNA, 649 bp, Panicum virgatum
  misc_feature: Ceres CLONE 1892649
  misc_feature: Encodes the peptide sequence at SEQ ID NO. 29621
aaagggcgaggtgatagagagacaaggggagaggggatcacgaggcgtgcttcctcctccgcccaatccggccccaaccaaatccccgccagcgccgccgcctttacctccgccccggagctaaaagggtgggccaggctcggttcctggatcgcggggtcacgggacgcgcgccgcggccgggtgctgggctgctggtgctggtgggaggactgatcgggcgacctctggcctctgggtctgggcggcgctggcgggatagggagaggctagaggcggtgaccgtggggcccgggatggacatgcccataatgcacgatggcgaccgctacgagctcgtccgcgacatcggctccggcaacttcggcatcgcgcgcctcatgcgcaaccgcgccgacggccagctcgtcgccgtcaagtacatcgagcgcggcgagaaggtgcgcttgctgctgccgccgcttgctcgattgctgctcgcctgcctttgctcgatcggccccccgtttcagaggcttcttttcttgcttcccctgcagattgacgagaacgtgcagcgcgagatcatcaaccaccgctcgctgcgccaccccaacatcatccgcttcagggaggtcatcctcaccccgacgcacctcgccatcgtcat

SEQ ID NO: 29621 - protein, 117 aa, Panicum virgatum
  misc_feature: Ceres CLONE 1892649
  misc_feature (1)..(49): SWISSPROT Homolog: EC 2.7.11.1 Non-specific serine/threonine protein kinase
  misc_feature (84)..(117): SWISSPROT Homolog: EC 2.7.11.25 Mitogen-activated protein kinase kinase kinase
MDMPIMHDGDRYELVRDIGSGNFGIARLMRNRADGQLVAVKYIERGEKVRLLLPPLARLLLACLCSIGPPFQRLLFLLPLQIDENVQREIINHRSLRHPNIIRFREVILTPTHLAIV

SEQ ID NO: 29622 - DNA, 2160 bp, Panicum virgatum
  misc_feature: Ceres CLONE 1892656
  misc_feature: Encodes the peptide sequence at SEQ ID NO. 29623
actcctagctagcttgcagcaaccagctaatagaaatctctctcatggcgaactcgtgttctgctactacctggcaagctttacttgtctttatttctgtgattgcagttgaagtagcagatgctgggggtcaagatgagtgtccttctttctcctgcggtgatcttcacaatatatcctaccctttccgtaggccaagcgaccctcaggagtgcggtgtgccagcatacgagctagtctgtagcaacagcaaggctgcaattcacatcaatacggggacatactttctgaccaacatcaactatatggatcggtccttcttggttgtcgatgccaacttggatacgcacagcagttgccctcttcctcgttgggatcagcttccttactcttacgatggtgtcccaagaagtggttcacaatggatttacgatttggccaccgaatccgataattgggcatgcttcgttaattgttctcaagcaataacgaatattaactggtacaagcctgttccttgcctgactacgaacagttcctttgtttatgtctcggttatagcttgtgatgtgttgtctcttgatccttcttgtgggtacttggccatgattccgtttagtggtgactggtatccctggtacccagacttagagagtgccaattatacagacatcataaactgggtaaagaatggattttctgtcagatttccttcgggttatgatgatcgctacaatgcttcttggatattcaaaacatgccgaaatgattcttccagctacttccacaatcgattacatggcacaagcatcgtaaattggactcgtgctttcttctggagtgaagtaactttagctgaatgtgcaaactcttacagcacccaaaatgctatgttccagagggttgtgatagccattgtatctgctataagtattaccaagtttcattttgtactatgcaggttactactccctgcactggtagtatttgcattccttgcccacaagtactggaaaacaaggataacaattgatgcagttgagaagttcctccagatgcagcaaatgcttggtccgattaggtttgcgtacaccgacatcactgcaatcactagccatttcagagacaagctgggtcaaggaggatacggctccgtatacaagggcgtgctactcccaggcaatgtgcaggtagccatcaagatgctgggcaactccaactgcaatggggacgagttcatcagtgaggtctctaccattggcaggatccaccacatcaatgtggttcgtcttgtgggtttctgtgcagaggaaatgcggagggcacttgtctacgagtacatgcctcatggttccctggacaagtacattttctcatatgagagaagcttctcctgggataagcttaacgacatcgctttaggcattgcaaggggcatcaattacttgcatcggggttgcgatatgcagatccttcactttgacatcaaaccacacaacattcttcttgacagcaattttgtacccaaagttgctgattttggcctcgccaagttgtacccaagggatacaagctttgtgccagctagtgccctacggggaactattgggtacatagctcctgaaatggtgtctcgaagctttggtgccatatctagcaaatctgatgtttatagctttggtatgctgctgctagagatggctgggggccgaagaaatgcagagcagagtgcagcgagcacaagtaaggcatactacccatcctgggtctatgaccgtcttgccaaacaagaagttggtgagatatctgctgcgggggacatgcatgagctggagaggaagctttgcattgttgggttacggtgcattcagatgaaaccgcacgatcgtccaacgatgggcgaggtcatagagatgctcgaagggtggactgatggcctacaaatgccttctaggccattcttctgtgatgatgatgatgatgatcgtatggctgctgcagattcttacctattgtcttctgagataaccgcaatatgggaagaagatgagtgaaatatatgtatgtttgtggtctggaagtaagatcagggaaagcactagccttgtaaactgctgacttagcagctatttcttgtatcctgttaagccttttcatgac

SEQ ID NO: 29623 - protein, 669 aa, Panicum virgatum
  misc_feature: Ceres CLONE 1892656
  misc_feature (357)..(625): Pfam Name: Pkinase Pfam Description: Protein kinase domain
  misc_feature: SWISSPROT Homolog: EC 2.7.11.1 Non-specific serine/threonine protein kinase
MANSCSATTWQALLVFISVIAVEVADAGGQDECPSFSCGDLHNISYPFRRPSDPQECGVPAYELVCSNSKAAIHINTGTYFLTNINYMDRSFLVVDANLDTHSSCPLPRWDQLPYSYDGVPRSGSQWIYDLATESDNWACFVNCSQAITNINWYKPVPCLTTNSSFVYVSVIACDVLSLDPSCGYLAMIPFSGDWYPWYPDLESANYTDIINWVKNGFSVRFPSGYDDRYNASWIFKTCRNDSSSYFHNRLHGTSIVNWTRAFFWSEVTLAECANSYSTQNAMFQRVVIAIVSAISITKFHFVLCRLLLPALVVFAFLAHKYWKTRITIDAVEKFLQMQQMLGPIRFAYTDITAITSHFRDKLGQGGYGSVYKGVLLPGNVQVAIKMLGNSNCNGDEFISEVSTIGRIHHINVVRLVGFCAEEMRRALVYEYMPHGSLDKYIFSYERSFSWDKLNDIALGIARGINYLHRGCDMQILHFDIKPHNILLDSNFVPKVADFGLAKLYPRDTSFVPASALRGTIGYIAPEMVSRSFGAISSKSDVYSFGMLLLEMAGGRRNAEQSAASTSKAYYPSWVYDRLAKQEVGEISAAGDMHELERKLCIVGLRCIQMKPHDRPTMGEVIEMLEGWTDGLQMPSRPFFCDDDDDDRMAAADSYLLSSEITAIWEEDE

SEQ ID NO: 29624 - DNA, 1937 bp, Panicum virgatum
  misc_feature: Ceres CLONE 1892682
  misc_feature: Encodes the peptide sequence at SEQ ID NO. 29625
agtgatgagcccactcccaaacccacccaaaaaccctcgtcgtcttcctccaaatcacccgcttgatctccccttccccccgctccccgtccccgtccccaatccctcgaccctagggttccggcgaccgcccacagcaaatgtcggacggcggcggcggcggcggcggcgaagagtacaagcgcgaggagtcggtggccctgctggtcatcgtctccctcgccgcgctctccctcctctccctcatcgccgccttcgcttactactgctacatcacccggaaggtctcccgccgcctgcactcgctccagccccccaagcgctccggctctcctcccacgctgcctccgccgccgccgcagcagcagcagcaggggaaggagagcccgtccagcaactccgccagcgatggggctggggcagcggcggcggggatggcactggtggtcgccggggagaggggcgtgcaggtgttcagctaccgacagctgcacgcggcgaccggcgggttcgggagggcgcacatggtcggccagggcagcttcggggccgtgtaccgcggggtgctccccgacgggaggaaggtcgcggtcaagctcatggatcgccccgggaagcagggcgaggaggagttcgagatggaggtggagctgctgagtaggctccgatcgccatatctgttgggcctgattggccattgttctgaaggtggacaacggctacttgtgtatgagttcatggccaatgggggtctccaggagcatctctatccaaacagaggttcatgtggtgggatctcaaaattggactgggatacaagaatgagaattgcacttgaagcagcaaaaggtttggaatatcttcatgagcgtgttaatccacctgtcatacacagagacttcaagagcagcaatattcttctggacaaggacttccatgcaagagtctcagactttggtctagccaaacttggatctgatagagctggtggtcatgtctcaactcgagttttaggaacacaaggctatgttgcgcccgagtacgcattgactgggcatttgactaccaaatcagatgtgtacagttatggtgtagtccttttggaattgcttactggtagggtaccagttgatatgaagaggcctccaggagaaggtgttttagtgaattgggcattgcctatgctcactgaccgagagaaagttgtgcggatcttggatccagcattggaaggtcaatactccttgaaagatgctgtccaagttgctgccattgctgcaatgtgtgttcaaccagaggctgactataggccactaatggccgatgtagtgcagtcattggtccctcttgtcaagaaccgttctgctcagaaagtttgcaacaccaacgtgcaagcatcgaagccactcgactagaaaagcaagtctttaatctgcagtttggtgctcgtctctctggaactcctctcgtctataactaactaccgctgctgaaacaatgggaccagcacctttcttgacgtggtcctcttgctctgctggtgatctcctgattttgtaaggtgcgtcatgggctggtaggtttcgaattgaaaggaatttggttggagagtcctgagagcttatttgagtttcaagggaggttcagtcatgtgtaatttagtagccatgttaggtggttgggaatttgggatcggtacgtgtggttgtggagagttcatcattagatggtagtatttggtatgagcttgcagtactgtgttgtagagtactgcttgactttcgtttggcctgtcagttattttaggaaattagcttagaagatccttgtccacttgtacagggtctgttaagctaaatgcactgtaatcgtcgtaactatgaactatcgtccttggagttcatatatatgtaatgtatagtatgtctctgcctctc

SEQ ID NO: 29625 - protein, 424 aa, Panicum virgatum
  misc_feature: Ceres CLONE 1892682
  misc_feature (124)..(400): Pfam Name: Pkinase Pfam Description: Protein kinase domain
  misc_feature: SWISSPROT Homolog: EC 2.7.11.1 Non-specific serine/threonine protein kinase
MSDGGGGGGGEEYKREESVALLVIVSLAALSLLSLIAAFAYYCYITRKVSRRLHSLQPPKRSGSPPTLPPPPPQQQQQGKESPSSNSASDGAGAAAAGMALVVAGERGVQVFSYRQLHAATGGFGRAHMVGQGSFGAVYRGVLPDGRKVAVKLMDRPGKQGEEEFEMEVELLSRLRSPYLLGLIGHCSEGGQRLLVYEFMANGGLQEHLYPNRGSCGGISKLDWDTRMRIALEAAKGLEYLHERVNPPVIHRDFKSSNILLDKDFHARVSDFGLAKLGSDRAGGHVSTRVLGTQGYVAPEYALTGHLTTKSDVYSYGVVLLELLTGRVPVDMKRPPGEGVLVNWALPMLTDREKVVRILDPALEGQYSLKDAVQVAAIAAMCVQPEADYRPLMADVVQSLVPLVKNRSAQKVCNTNVQASKPLD

SEQ ID NO: 29626 - DNA, 651 bp, Panicum virgatum
  misc_feature: Ceres CLONE 1892685
  misc_feature: Encodes the peptide sequence at SEQ ID NO. 29627
agtagtcgcttcgcgtgacccctcccctccctcgcggccgcgctcctcgacctctccccgacgcaaaatccacaccccaggtaggcagctcaggcagcgcacgcggcacgcgctcccctcccttcccttcccctcgcctcgcctgccttcccaaacccaactccacccccgttccgctcgcgcgccgcgccaggcttgcctgccgggccgaagcgcgctgacctcgcgctctcccctcaccccagcagcagcagcagcagcagcaccccaccgcgccaggtccagcccccgccccgggcgctggccggcgaggccggcggcatgaagctgcgggcgctcctggagcgcctggcgcggcccttctcctcctcctcccgccgctcctcctccgagtcccgccgcgacaaggaggaggaggcggacctggaggcgatcgcggcgcgggagcagcgcgcgttccggtacgaggccctggcggcggcgacgcggggcttctcggagaagaaccggctcggccagggcggcttcggccccgtctaccggggccgcctcgaggacggccgcgacgtcgccgtcaagcgcctcggcgccgggtcgcggcagggcgcgcgggagttcaagaacgaggccacgctgctgtcccgggtgcag

SEQ ID NO: 29627 - protein, 109 aa, Panicum virgatum
  misc_feature: Ceres CLONE 1892685
  misc_feature: SWISSPROT Homolog: EC 2.7.11.1 Non-specific serine/threonine protein kinase
MKLRALLERLARPFSSSSRRSSSESRRDKEEEADLEAIAAREQRAFRYEALAAATRGFSEKNRLGQGGFGPVYRGRLEDGRDVAVKRLGAGSRQGAREFKNEATLLSRV

SEQ ID NO: 29628 - DNA, 1225 bp, Panicum virgatum
  misc_feature: Ceres CLONE 1892706
  misc_feature: Encodes the peptide sequence at SEQ ID NO. 29629
aaccactgcctccagcagcagcagcagcagcccacgcagctagctcagctcgatcgtcctctcctctccatctccatccatccattcgatctcgtgctccctcccactcctcgccacgcactaccgcggcctgaggagatgatgagcggtggtaggctgaacgtggcgacgtccgcgcagggcgacgacttcccgttcgcgccgatgcagcagcagcagccgccgccgccgccgccctacgtcgggttcgagtacggcgtgatgggaggcggcggcgggatgcagcaccacctctacgacggcctcgacttcgccgcggcggcgctgcagttccaggaggcggcgcctcaccaccagctgctcacgctgccgtccagcctcgcgcccatggcgccgccgccgctgcagatgcccatgccgcttcccgggatgcccggcgacgtgtacccggcgctcggcatggtgaagcgcgagggcgcggacggcgggggcggcgggcggatcgggctcaacctcggccgccgcacctacttctcccccggcgacatgctcgccgtggaccggctcctgatgcggtcccgcctgggcggcgtgttcgggctcggcttcggcggcgcgcatcaccagcccccgcgctgccaggcagagggctgcaaggccgacctctccggcgccaagcactaccaccgccgccacaaggtctgcgagtaccacgccaaggcctccgtcgtcgccgccgccggcaagcagcagcgcttctgccagcaatgcagcaggtttcacgtgctgacggagttcgacgaggccaagaggagctgccggaagcggctggccgagcacaaccgccgccgccggaagccggctgcctccacggcgtcgtccaaggacggggcgtcgccgcccgccaagaagcccagcggcggctccatgaccggctcctacaccactgacagcaagaacctgagcacggccaagtcgaccatgtcatcgaacacgggcagcgtgatcagctgcctggaccagggcaacaagcagcagctggcgaggccgacgctgaccctcggcgcgtcgccggacaaggaccaccagcaccagcagcagctcagcaccatgctccaggcccaggcggccgcgggcggcggccaccaccaccaccaccaccaccacccggagcagcacttcatcacctccctgcaggttcacagccacaacaatggcggcggcg

SEQ ID NO: 29629 - protein, 362 aa, Panicum virgatum
  misc_feature: Ceres CLONE 1892706
  misc_feature (166)..(244): Pfam Name: SBP Pfam Description: SBP domain
MMSGGRLNVATSAQGDDFPFAPMQQQQPPPPPPYVGFEYGVMGGGGGMQHHLYDGLDFAAAALQFQEAAPHHQLLTLPSSLAPMAPPPLQMPMPLPGMPGDVYPALGMVKREGADGGGGGRIGLNLGRRTYFSPGDMLAVDRLLMRSRLGGVFGLGFGGAHHQPPRCQAEGCKADLSGAKHYHRRHKVCEYHAKASVVAAAGKQQRFCQQCSRFHVLTEFDEAKRSCRKRLAEHNRRRRKPAASTASSKDGASPPAKKPSGGSMTGSYTTDSKNLSTAKSTMSSNTGSVISCLDQGNKQQLARPTLTLGASPDKDHQHQQQLSTMLQAQAAAGGGHHHHHHHHPEQHFITSLQVHSHNNGGG

SEQ ID NO: 29630 - DNA, 611 bp, Panicum virgatum
  misc_feature: Ceres CLONE 1892707
  misc_feature: Encodes the peptide sequence at SEQ ID NO. 29631
atcgctcgccgccagccgccgccgcctcgcccgtccgcctccgccgccccatcgcgccgtgggcatcctccccagctaagctgtcgcgccgccctccttgccacacgccccgccgcgggcagccatcctagccctcgttgtcgcgcctttgccgcccttgcgcggtggagagaggagaggagatccagccgcctcacggctgattcggtcgtctgattgctgcaccaacacagacccggcgtgctgcgtccctctagtaatattggagagaatcgagagtaacccctgcgacagagccagagggaaaacaccattgcacccaaagaaaagactttgccggccggccacgatggcgcctcaagcacttcaccccgtgaccgtcctggagcagtgccacgtctcgtcgtcgccggcgccggcggcggggcagccacgcgcgctgccgctcacgttcttcgacctcgttttctggggcttcccgcccgtgcaacgtctcatcttctacgacaacgccgacctcctcagcgtctccgacttcacgctcggcgagctgccacggttcaagaagtccctcgccgccgcgctgcaccacttctacccgttggccgggg

SEQ ID NO: 29631 - protein, 87 aa, Panicum virgatum
  misc_feature: Ceres CLONE 1892707
  misc_feature: SWISSPROT Homolog: EC 2.3.1.153 Anthocyanin 5-aromatic acyltransferase
MAPQALHPVTVLEQCHVSSSPAPAAGQPRALPLTFFDLVFWGFPPVQRLIFYDNADLLSVSDFTLGELPRFKKSLAAALHHFYPLAG

SEQ ID NO: 29632 - DNA, 636 bp, Panicum virgatum
  misc_feature: Ceres CLONE 1892707-R
  misc_feature: Encodes the peptide sequence at SEQ ID NO. 29633
ccttgatttatccggattttttgagaaagaggatgcttcggaaaggaaaatcagatttgcatcaaatcattccccggcttatttatttgagaagattgagagcattgtcagaaaaatggggttgcaagtacataagagcaatggcaagctaaaagtgagccaagattgcaagggaccagcaaattccagagggctagaatcattattagtttctgcagaggtgtttgagataaatgaatctctttatgttgtcgagctaaagaagtcatctggagactgctccctgtacagaaagttgtgtgagacgctttcagaggacttgggaatatgcaaaagccagcaactcctaaagcaagattctatcaaacaagaaatagttagatataatagtagcttctaacaaagagccccttactaactaggctgtagacagaaactaacgcaaacaatatactgaattttaaacagtatattgtccatgcacctattacaaatgtgctctcttacgccttttttcatgaatctagccttaagaggcttagattacgtcaaattggcaactgacatgtatggaactcctcctaagcaataatatgatgtaaacaagtaaactatacatatatgagtttcagagtc

SEQ ID NO: 29633 - protein, 132 aa, Panicum virgatum
  misc_feature: Ceres CLONE 1892707-R
  misc_feature (1)..(45): Pfam Name: NAF Pfam Description: NAF domain
  misc_feature: SWISSPROT Homolog: EC 2.7.11.1 Non-specific serine/threonine protein kinase
LDLSGFFEKEDASERKIRFASNHSPAYLFEKIESIVRKMGLQVHKSNGKLKVSQDCKGPANSRGLESLLVSAEVFEINESLYVVELKKSSGDCSLYRKLCETLSEDLGICKSQQLLKQDSIKQEIVRYNSSF

SEQ ID NO: 29634 - DNA, 2049 bp, Panicum virgatum
  misc_feature: Ceres CLONE 1892719
  misc_feature: Encodes the peptide sequence at SEQ ID NO. 29635
ggagcaaatcagccctggcgacgtcctccctcacgacgttctcaagcacgccgctacaccccacgccaccgcaccccacgacgctgcacgccgcgtcctgcgtctggcgccgtaacgcgccgcggccggcgacagcgaggggcggcgcttgggcggaaggaggacctgcccgatccgctccgtccctcgcggatctgcccggtttggcgcgttctcctcctcccccgcccgcccgccggccgccgcgcgcgtcctcctcctccgccggccggcgaggtgcgcgttctccttcgcccggctgccggctcgcgcggcatcctcctccgcctgccggcgcgcgtcgtcctctctccctctccgtcgcatcactcccgcgcgaccgtgaccatcagcaaagacgagtaagcggtggatcgagaggggctcgacgaccgcacatgccctatcgctgccacgcccctgcatcaggaaggatcgtccccctctacctcctacacgtgaagggcgccccaaaagatgacctcaatctccatctagctgcatcctccgtgaggttaactattctgtttgagaatttgagtacctgattctataagcttgcaatcatggtttaaagcacctcgtgaactctacctttaaattgatagctgagaataaggattgacagttctgtagttttaactcaatcatggaagaacttacatgatatgcttggacagcggagtgcgatgatttttttggtgggtggaatagggcaggcagtgcaagaggcaactagggaggataatggtgataggtacaaaaagagaagctcttgagttctccaattttgttgatataatttgtagtctaaggccataatataaggattcaaaggagatacatttaaaagagaaggaaaggaccacggcaagataccagatgcagtctaaaatctgccacggtgtgcacctctaatgcatacacttctatgaccaaatttgatttatgtgcttaccttttcacttcctgataaattaaggagaacagaatatattatcaattgtactaggcaactatggcaaggtgaaatcattgagttaacaccagaggaagatacatgatgcattcatcatcctagcattcaaagccactggaatatttttgacaatgcaaacaaccaatatttgtggtggttctccagacttattgatcagttcatgtctttcatggccatttagctggaattcgaatgactctgacagtgtatgctaagtcaaccaactaattggttaaccactttcagttaatgcatccgtggcattagcacgggcacactttctgaagatttgttgcaatttcatggtatgagcaacaagctgccacccaagtctgtcaatgctcgagctcggcagggcaatctcagtcacatgcaccgagcaacctgtggtgtacactgtctccctcctggagggctcattctgtgctgttcttcaggggaatgctaatgatgagctggagatctgcttggagagtggtgatccagatgtggaatcctttaaaggcacccatcttgttttcatcggtgctggatgggatccatttgaagttatcacaaattcaatgaaagctgttgagaggcacttgcagacgttttgtcacatggaaaaggaaaagatgccagacattcaaaactggtttggttggtgcacatgggatgcattttacaccaacgtactgctgaaggagtgagagggattacagagctttcaaaaaggtggagtttctcctgagtgtgtcagaattgacgacggctggcaatcagtcggtatggatcctgtgggaattgcatgcttaactgataactcaaccaactttgcaaacaggttgactcatattaaggagaaccacaagtttcagaaaaattggaaggagggtcacagggaagacgatccaacaaaaggcctcgcacatattgtcaatgaaattaatggaaaacatgagctgaagtatgtcaccattcgataatttgttgtcttattcagtttagaaatgacaaatttttatgtc

SEQ ID NO: 29635 - protein, 117 aa, Panicum virgatum
  misc_feature: Ceres CLONE 1892719
  misc_feature: SWISSPROT Homolog: EC 2.4.1.67 Galactinol--raffinose galactosyltransferase
MLELGRAISVTCTEQPVVYTVSLLEGSFCAVLQGNANDELEICLESGDPDVESFKGTHLVFIGAGWDPFEVITNSMKAVERHLQTFCHMEKEKMPDIQNWFGWCTWDAFYTNVLLKE

SEQ ID NO: 29636 - DNA, 2636 bp, Panicum virgatum
  misc_feature: Ceres CLONE 1892722
  misc_feature: Encodes the peptide sequence at SEQ ID NO. 29637
acgcggggccagggacagcgcgatggtggctcgacggttcgtggtccggcaggggcccgccgccggtgtctccggcgagggggaggcggaggagcacgaggtggagtacgacacggaccatggcatcgacgtcctccgcttccagatcttctcgctcacctccgtcccgcccgaccttcagaagatcgtggtggaggcggatgggtccgtggtggacgacggcaccgacctggagtccctctccgagcgcctgcgcgtcgtggccatcggcgaggatgagggggaggatgcggtggctgcggaggcggccagggcgcaggagaagtccgacgaggagctcgcgaggatgcttcaggcggaagaagaggcacttctcctacaacagtacagtgttcgaaatgatggtgaagaggtttttagacagagaattgagccttacatgaaccaggttctgatgtatgaagatccagtgcgacaagaagcagcacggaagacggttccaatacatgagcttgaggagaaggcattagtttcactggccaaggaagggaatttccatccttcgaaagctgaagagaatcacgcctttctgctgcaattgcttttctggtttaagcaatcattcagatgggttaacgcagcaccttgtgacagctgtggccgtgagacctccaatgttggaatgggcaacccacttccctcagaaatcgaatttggtgcttcgcgtgttgagctatataggtgtaaccattgttttagtaccacccggttcccaaggtacaacgatccgcataagcttctacaaactaggaggggtcgctgtggagaatgggccaattgcttcacattctactgtcgagcttttggatacgaagctcgtttgaccctggatttcactgatcatgtgtggacggaatgtttttcaaacttgtacgggagatggatgcacctagatccgtgtgaaggagtctatgataatcccctactgtatgagaaagggtggaacaagaagttagattatattattgcgatttcgaaagatggagtacatgatgttacaaaacgctacaccagaaaatggcatgaggttctctctaggcgaacaattacctcagaagaaaccatttcagctgttctatcatccatgacaagaaagtatcgcactggattgtcagctggtgctctctcagtcatagaaaaccgtgacaaggaagagtctgaggaacttagcaaagctgcttatcttgaagttgaaacaactttatccttacctggaaggctaagtggttctgtggaatggagaaaagcaaggtcagagttgggccaagcagattcacttagttgttcatcgtgccctgttcggaaatgtgttgatgctcatgtttcaaatatatatgatgctctgtctgctcttctttcgcatttttgtgatagaaaggtccctaaagaaagaattattgaagtttttcatgctttgaagacgttgatgctaaatcttaaagatgctaactttaattgtagaagagctacattagacaagaaaacacagcagctatttgaggagatatgttctttcattgaaagactatttgctgctgtttcactgaaagcagaattgggtactgatgggcaccaatctgtgactgtggttgaaaatccaataaactcatccttagcattaccagtagcgttggatgcagttgacgagatattgagtaattataagaataatatattttgcacagaaggtaaccaattcccaagagggaacagactaagctcaggttcagtccttgcaagcagggaacagctcccgatcggaattgtatgtgacggcgaacttgtgaacttttagtacccattcatcaaggtttgccatacataagtgtgtttgaaattgtttcaggcaacagcagcatttgatggtattcattcatcaaaatgggaagagcctgatggagctaaaggttgttggctgatttataaaatgcccgatggccaaacttgtgagttggactcatatgatttgatgtcagctaatgatgctccagagagggatccaatgcactgggttcttgaagcgagcacggatggaggctccacctggaatacaattgacactcgcagttctgaaatatttgagacccgtttcttccggaaaacatttacagtggataagagatgtaaagcaaatgctttccggttcaggtttctgtgcgtaagagaatcacattccactccaaggtttcagataggatctattgatctctatgggagaaccgtgtgaactttcccggaattgtaaagagctgagcaagtggtattcatagctttctagaactcctgatttctcgaacctgtgcagcatgaaggcgcatcataagattgtgaagtttgtttttattctggaagtagccttcccttgaatggtagaatgattgaggattgattgagtaattacggacatgaatatacgataatctattctggtgttattcaatgtactatcgattagcgatgacgttgagatacttttcatcatggggactacgcatccttttccaggccgcccgtgatggatacactatacatttttttttacaacaagaggcatgagtctttggagtattggttcc

SEQ ID NO: 29637 - protein, 610 aa, Panicum virgatum
  misc_feature: Ceres CLONE 1892722
  misc_feature (262)..(313): Pfam Name: Transglut_core Pfam Description: Transglutaminase-like superfamily
  misc_feature: SWISSPROT Homolog: EC 3.5.1.52 Peptide-N(4)-(N-acetyl-beta-glucosaminyl)asparagine amidase
MVARRFVVRQGPAAGVSGEGEAEEHEVEYDTDHGIDVLRFQIFSLTSVPPDLQKIVVEADGSVVDDGTDLESLSERLRVVAIGEDEGEDAVAAEAARAQEKSDEELARMLQAEEEALLLQQYSVRNDGEEVFRQRIEPYMNQVLMYEDPVRQEAARKTVPIHELEEKALVSLAKEGNFHPSKAEENHAFLLQLLFWFKQSFRWVNAAPCDSCGRETSNVGMGNPLPSEIEFGASRVELYRCNHCFSTTRFPRYNDPHKLLQTRRGRCGEWANCFTFYCRAFGYEARLTLDFTDHVWTECFSNLYGRWMHLDPCEGVYDNPLLYEKGWNKKLDYIIAISKDGVHDVTKRYTRKWHEVLSRRTITSEETISAVLSSMTRKYRTGLSAGALSVIENRDKEESEELSKAAYLEVETTLSLPGRLSGSVEWRKARSELGQADSLSCSSCPVRKCVDAHVSNIYDALSALLSHFCDRKVPKERIIEVFHALKTLMLNLKDANFNCRRATLDKKTQQLFEEICSFIERLFAAVSLKAELGTDGHQSVTVVENPINSSLALPVALDAVDEILSNYKNNIFCTEGNQFPRGNRLSSGSVLASREQLPIGIVCDGELVNF

SEQ ID NO: 29638 - DNA, 1438 bp, Panicum virgatum
  misc_feature: Ceres CLONE 1892724
  misc_feature: Encodes the peptide sequence at SEQ ID NO. 29639
acaccctctccagtcccctccagcctccgccctctcccgcgcgccgccggcgaccgccggatctcaaccgccggttgcgagaggttgttcagtttcacaatttaaaaaacctcaatttctggacgtgctcagcaaaataagttctttccgctgtagtcaattccgactggtagcaatggcaacagctccagccaatggtgattcgcagagtggccctcagcggaactatcaggttgttgttgctgccactcgtgacttaggcattgggaaggatgggatcttgccatggaagcttcttggtgaccttaagttcttcaaggatcttacgctttcaacatctgaccctgccaagaagaatgcagttataatgggaaggaagacatgggagagcattcctgttaagttgaggccattgcctggtcgtttgaatgtcatactcactcgatctggtagttttgattttgcaacagtagaaaatgttgttatctgcggaagcatgaagtctgccttagaactgctagcatcaactccatattgcttatcaattgagaaagtttttgttatagggggtgggcaggtactgagggagtatcttaatggacctgcatgtgaggccatccatctaactgacattcagtcgagcattgagtgtgacactttcatccccccaattgacttctcagtgttccaaccatggtattcatctttcccggtggtagaaagcaacattaggcattcttttgtgacctttgttcgtgttagaaaatcactggcagaaactaatgactcaaatggaaaggaatcaactgaggttgatagcaagaatgacaagtttgaaacagagaatttctcttttctcccgaagatgatatttgatcgccatgaggagtatcattatcttaatcttgttgaagatattataaggtccggtgctcagaaaaatgacaggacaggaaccggaacattgtcaaaatttgggtgtcagatgcgattcaacttaaggaaaaattttcctctgctgacaacaaagagggtattttggcgtggtgttgtcgaagaactcctgtggttcgtcagtggttcaacaaatgcaaaggttctacaagagaaaggtattaatatctgggatggcaatgcttcaagagaatatcttgacagtgttggcttggcacaaagagaggaaggtgatctaggtccagtttacggatttcaatggcgacactttggtgctgaatataaagacatgcatgctgactacactggaaaaggttttgatcaactaatggatgtgattgacaagatcaagaataatcctgatgatcgtcgaataattttgtcggcatggaatccttcagatttgaagaggatggctcttcctccttgccacatgtttgcacaattttacgttgagaatggggagctatcctgccagatgtat

SEQ ID NO: 29639 - protein, 420 aa, Panicum virgatum
  misc_feature: Ceres CLONE 1892724
  misc_feature (236)..(420): Pfam Name: Thymidylat_synt Pfam Description: Thymidylate synthase
  misc_feature (17)..(194): Pfam Name: DHFR_1 Pfam Description: Dihydrofolate reductase
  misc_feature (235)..(420): SWISSPROT Homolog: EC 2.1.1.45 Thymidylate synthase
  misc_feature (16)..(170): SWISSPROT Homolog: EC 1.5.1.3 Dihydrofolate reductase
MATAPANGDSQSGPQRNYQVVVAATRDLGIGKDGILPWKLLGDLKFFKDLTLSTSDPAKKNAVIMGRKTWESIPVKLRPLPGRLNVILTRSGSFDFATVENVVICGSMKSALELLASTPYCLSIEKVFVIGGGQVLREYLNGPACEAIHLTDIQSSIECDTFIPPIDFSVFQPWYSSFPVVESNIRHSFVTFVRVRKSLAETNDSNGKESTEVDSKNDKFETENFSFLPKMIFDRHEEYHYLNLVEDIIRSGAQKNDRTGTGTLSKFGCQMRFNLRKNFPLLTTKRVFWRGVVEELLWFVSGSTNAKVLQEKGINIWDGNASREYLDSVGLAQREEGDLGPVYGFQWRHFGAEYKDMHADYTGKGFDQLMDVIDKIKNNPDDRRIILSAWNPSDLKRMALPPCHMFAQFYVENGELSCQM

SEQ ID NO: 29640 - DNA, 635 bp, Panicum virgatum
  misc_feature: Ceres CLONE 1892724-R
  misc_feature: Encodes the peptide sequence at SEQ ID NO. 29641
aacattgcatcatattctctcctcacttacatgattgctcaagtttgtggtctttctcctggggattttgtccatgttataggggatgcacatgtctacagaactcatgtccgagctttggaggagcaaattcagaagatgccgaagccttttccaattttgaagataaatccttcaaagaaggacatagatacttttgtggcatcagacttcaagctggttggctatgatcctcaccagaagatagagatgaaaatggcaatataatggtgtctcagctggagtgccagcctaggagctcggcaaaattagttggactgctaccatactaaaaattaaccgaacatcgcactagcttgtttttggtgatggtgccgaatgttcgttccatgggagatgttccccacctccccggccaatttgtcattgtactctggttggcttatctgaactctacaacacacgctccccttttatccggagctggtgttgatgactcattgcgagtgagtgctgcttctgggcaaccgccctgttgcaagggtcgactggcgtgtgccccggcgacgatttacttcatgtacctcgtgagatactcgtgtacttggtaaaactcggaactgtttgatgcctgc

SEQ ID NO: 29641 - protein, 88 aa, Panicum virgatum
  misc_feature: Ceres CLONE 1892724-R
  misc_feature (1)..(88): Pfam Name: Thymidylat_synt Pfam Description: Thymidylate synthase
  misc_feature: SWISSPROT Homolog: EC 2.1.1.45 Thymidylate synthase
NIASYSLLTYMIAQVCGLSPGDFVHVIGDAHVYRTHVRALEEQIQKMPKPFPILKINPSKKDIDTFVASDFKLVGYDPHQKIEMKMAI

SEQ ID NO: 29642 - DNA, 1868 bp, Panicum virgatum
  misc_feature: Ceres CLONE 1892728
  misc_feature: Encodes the peptide sequence at SEQ ID NO. 29643
gttagcaagaccctgagcaaaggcttggtgtgtcagcctgaggctcagccagaagctcatggcggtgaccgccgctccgtctcttgccatccccacacccccgcgcccgaccccgaagccccgccgcgcacgcgccctctcgccgcggcagcgggacgtcgtctcctggacgtctgccatcgcgcgcgcggcggggcagggtgacctgccagcggcggccgcggcgctctccgccatgctcttgacccccgccgcgccggcccccaacgacgtcacgctccttaccgtcctgtccgcctgcgccgactcgccgtcctccccgctcgcccgccccttggcgctctccctccacgcccacgcgctcaaggtcttcccttcccacctcctcctctccacctgcctcgtgcggttctacctcgcgtcccgcctcccgcaccttgcgctccagcttttcgactcaatgcccatccgctccgtcgtcacctacaacaccatggtctccgggctcatgcgcaatggcctcgtggacgccgcgttcaaggtgtttgacggaatgcccgaaccggataaggtctcctggacggcgctcatcgacgggtgcgtcaagaacgggcgccacgacgaggccatcgactgcttccgctccatgctgctggacggcgtcgagccggactacgtcacgttgatagccgttgtctccgcgtgcgccgaggtcggcgcgctcgggctcgggatgtgggtgcaccggctcgtggtcaggcaggggctggagcgcaatgtccgtgtcgccaactcgctgatcgacatgtacgcgaggtgtggacaggcggagctcgcgtcgcaggtgttccgctccctgaggaagccgacggtggtttcttggaactcgatgatcgtcgggtttgcagccaatggccggtgcaccgatgcagtcgagctcttcgaggagatgcagaggcagggtttcaagccggatgcggtcacgctcaccggcgtgctcacggcctgcagccacgccggcctcactgagcaggggctgagctactacaacctcatgacgacacggtactgcgtcaccgcgcggatggagcactacgggtgcgtggttgacctgcttggccgtgccgggcggcttgacgaggcgatgcgcgtggtggagaccatgccgatgcgacccaatgaggtggtgctcggggcgctccttgcgggctgtcggatgcacggggacctggagatggctgagcagctgatgcagcacctcctcgagctggagcccaggggcgatgccaactacgtgctgctgtccaacatctacgcggctgtgggaaagtgggatggcgccgggaaggtccggagcttgatgaaggcgcgtgggctgaagaaacggccagggtacagcgccatggaggtcgacggcgacgtgcacgagttcgtgtctggcgatcgatctcatccgcaggccgaagagattggccagatgcttgggttgctcaggcacgagatggcgaggtatggttatgatgagcacggaggcagcagcttggaagggattgagcgctgagaactgcaataatgtggaagatgcaattgcaggcatcaccacagggttcatcattttgcgtgtggggtattttctgtgtaaaaagtgttagaacatctgctgtagatccgtaaaaagtgttgtactagaaaaactagcgcggcgaggccgcgccgacctgtgccagtgcagtggaatctttttttgtttattatttatgtaggccagtgcggtggaacctcttgtttttgtttattatttatgtaatagaaaaaacatgtgtaggttggtggcttgaatggagagaaggatgtggaagctctgagac

SEQ ID NO: 29643 - protein, 441 aa, Panicum virgatum
  misc_feature: Ceres CLONE 1892728
  misc_feature (214)..(248): Pfam Name: PPR Pfam Description: PPR repeat
  misc_feature (113)..(147): Pfam Name: PPR Pfam Description: PPR repeat
MLLTPAAPAPNDVTLLTVLSACADSPSSPLARPLALSLHAHALKVFPSHLLLSTCLVRFYLASRLPHLALQLFDSMPIRSVVTYNTMVSGLMRNGLVDAAFKVFDGMPEPDKVSWTALIDGCVKNGRHDEAIDCFRSMLLDGVEPDYVTLIAVVSACAEVGALGLGMWVHRLVVRQGLERNVRVANSLIDMYARCGQAELASQVFRSLRKPTVVSWNSMIVGFAANGRCTDAVELFEEMQRQGFKPDAVTLTGVLTACSHAGLTEQGLSYYNLMTTRYCVTARMEHYGCVVDLLGRAGRLDEAMRVVETMPMRPNEVVLGALLAGCRMHGDLEMAEQLMQHLLELEPRGDANYVLLSNIYAAVGKWDGAGKVRSLMKARGLKKRPGYSAMEVDGDVHEFVSGDRSHPQAEEIGQMLGLLRHEMARYGYDEHGGSSLEGIER

SEQ ID NO: 29644 - DNA, 2352 bp, Panicum virgatum
  misc_feature: Ceres CLONE 1892737
  misc_feature: Encodes the peptide sequence at SEQ ID NO. 29645
gccttcgagtccctctcctcgctctccctttccctttcgcgggttcatttaggctctagatgcgacgatgattcgaggcgcgaagcttattttgaccttaatccgaggctaaaccctggcgcggtggctcagcggcgtctcggatggggacgaagaaagtgaagtctgtcactggtcgtaatcacgcggggaatagatgataaggtcgtaaaaaaccacacaatcatcagccagaagccacactgttgtgccttcttttgagcccatcgagggccaggagtgactggtttccgttcagtgcgcgccgcacgagccgtggacatgggcagcgcctgctcgaggaagaggggccagctggtccacgaggatgatctctacggcgccaggttctccaagagcggcagcttcaagtggctcctgcacacgctgccccgcagcaactctgctgatgtgcatagaagagcgcaggagggaacgccgggctggtgcccgtcgcttgtagagctgtgcgtggccaaagtccgcgaggacatgagtagctactctgatttctccctgctgcccagggatcttagtcagcagatattcaatgagctggtggagtgtggaggcctcacggaagcatcgcttggggctttccgtgattgtgatctgcaggatatttgtctgggagagtacccgggagtgactgatgcttggatggaagtagtggcttctcaagggcagtccttgctatctgttgacatctcttgctcagatgtgactgatagtggattgaatcttcttaaagattgctcgagcatgcaaagtttggcatgtgattactgtgatcagatctcagaacatggacttaaaacattattaggcttttcaaatttgacatcactgagcattaagaaatgtgctgctgttactgctgaaggagcaaaagcctttgcaaacctagttaatttggtaaacttagaccttgagcgatgcccaaagattcacggtgggcttgtgcatttgaaaggcttgagaaaactggaaaaactgaacctgagatactgtaattgcatcaccgattcagatatgaaatatttatcagatctcacaaatttgagagaactacaactatcatcctgcagaatctctgattttggtgtatcttatctgagaggtctacacaagctagctcatctaaacctggagggctgtgcagtcactgcagcttgtttggaggttatatcaggattggcttcacttattttgctgaatttaagtaggtgtggcatatgcgacgaaggctgtgagaacttggaagatcttgtcaaattgaaggctctaaatttagggttcaaccacattacagatgcctgtttaattcacttaaaagatttgatcaacttggagtgcttgaatttggactcatgcaagattggtgatgagggtctatttcacctgaaaggcctcgtgcagctaaaaaacctggagctttcagacactgaagttgggagcaatggacttcgtcatctctctggtctacgtaatttgcagagcatcaatctctcttttacattgattactgacattggtttgaagaagatttctggtttgagttcactgaagaatcttaatcttgacaatcgccaaatcacagatactggtttagcagctcttacaagtctcactgggctgacacaccttgacctatttggagctcgtataactgacgcaggcacaaactgcttcagatttttcaagaatcttcagtccctggaggtctgtggtggatcgatcacggatgcgggcgtgaagaacatcaaggacctcaaagctctgacgctgctcaacctatctcagaatggcaacctcacggacaaaaccctggagctgatctctggcctgactgcgctggtgtcgctgaacgtgtccaactcccgggtgtccaacttgggcctccaccacctgacgccgctgcagaacctgcgctccctgtccctggagtcctgccgggtgacgccggccgagatcaagaagctccggctggccgccctccccaacctgatcagcgtgcggccggagtgatacggccaggcaggcactgtcgcagcagcgatctgtaactgtaagcaaatggtggcctggctggagcatgccgccctgtacatatttttgcaagaacaagcttgagcagtctgtacatattggtctttgtgtcgtgtcggcgtgcctgacgatcgccggactagactactccgccctatccccatataccccaggaatttgtgatgggaaggaacaattgtaaatatgccgtgcttcctctccatgtggggtgccgctgtgtaaatagtggattggtgcacttct

SEQ ID NO: 29645 - protein, 581 aa, Panicum virgatum
  misc_feature: Ceres CLONE 1892737
  misc_feature: SWISSPROT Homolog: EC 2.7.11.1 Non-specific serine/threonine protein kinase
MGSACSRKRGQLVHEDDLYGARFSKSGSFKWLLHTLPRSNSADVHRRAQEGTPGWCPSLVELCVAKVREDMSSYSDFSLLPRDLSQQIFNELVECGGLTEASLGAFRDCDLQDICLGEYPGVTDAWMEVVASQGQSLLSVDISCSDVTDSGLNLLKDCSSMQSLACDYCDQISEHGLKTLLGFSNLTSLSIKKCAAVTAEGAKAFANLVNLVNLDLERCPKIHGGLVHLKGLRKLEKLNLRYCNCITDSDMKYLSDLTNLRELQLSSCRISDFGVSYLRGLHKLAHLNLEGCAVTAACLEVISGLASLILLNLSRCGICDEGCENLEDLVKLKALNLGFNHITDACLIHLKDLINLECLNLDSCKIGDEGLFHLKGLVQLKNLELSDTEVGSNGLRHLSGLRNLQSINLSFTLITDIGLKKISGLSSLKNLNLDNRQITDTGLAALTSLTGLTHLDLFGARITDAGTNCFRFFKNLQSLEVCGGSITDAGVKNIKDLKALTLLNLSQNGNLTDKTLELISGLTALVSLNVSNSRVSNLGLHHLTPLQNLRSLSLESCRVTPAEIKKLRLAALPNLISVRPE

SEQ ID NO: 29646 - DNA, 2205 bp, Panicum virgatum
  misc_feature: Ceres CLONE 1892742
  misc_feature: Encodes the peptide sequence at SEQ ID NO. 29647
aaggctagctgcagcagccatggcctcctcctgtgctgtgacagcctcctcctcctccctgttcctcgtgctcctcttcctcgcctccggcgggctcgcgccaccgcatctccgggtccgggcgcagcagccctacggctcggcgatcgccgactgccccaaccagcacaacgcctccggcctgctcggctacttctgcggcgccggcggcgcgccgtcctgcccggccttcctcaccttcaacgcccgccccccttacagcaccctcgcctccgtcgcggcgctgctcggtgccgacgccgcgggcctcgccgcggccaacggcgtccccgcggcggcgccgctcgccgacggcacccgggtgctcgtcccggcgacctgcgcgtgcacggccacgccggagagccggttctaccaacgcaacgccacctacgtcgtccgccccggcgacacgctgctcatcatcgccaacaacaccttccagggcctgtcgtcgtgccaggcgctccaggcgcaggcgctgcgcggcgccgcgccggagacgctcaacgccagccagccgctccccgtgccgctccggtgcgcgtgcccgaccgccgcgcaggccgccgccggggcgcggttcctggtcagctacctcgtcgccgagctcgacgacgtcaccgccgtggccgcgcggttcggcgtcgccgtcgagaccatccaggaggccaaccggctccagccgccgtacaccatattcccctacaccaccctgctcatccccgtcagcgcccagcctaacgtgtcgcggatccagacgccgccgccgcccccgccgccgccgccggtggtcgcgcctcttccgggcaagaagagcggcggccatgccggggtttacatcggcgtcgcggtggcggtggctgccgtcgctgcgattgcctccgccggagctgtgcttgccgtgaaggcgaggaggaggaggcgagccggcgccgctctggacgccgacgatctggccgagaaggacggcaaaggcaaaggcagcgacacgaacacaacgccgtcgggcttcaccggcggcggcgagttctccctctccacgagcgaggcgttctcgagcctctccgtgacgggcatcaagtcctcgctgaaggtgtacacctacgcggagctccgggcggcgaccgacgacttcagcccggaccgccgcatcggcggcgggtcggtgtaccgcgcggcgttccacggcgacgccgccgccgtcgaggtggtcgaccgggacgtgtcgacggaggtggagatcatgcgcaaggtcaaccacctcaacctgatccgcctcgtcggcctctgccaccaccacggccggtggtacctcgtcaccgagtacgccgagcacggcgcgctccgggaccgcctcctcgcggccggcgccggcgcggcggcgccgccgctgacctgggcgcagcgggtgcaggtcgcgctcgacgtcgccgaggggctccggtacctgcacgagtacgcgcgcccgccgtgcgtgcacatggacgtgagcagcggcagcgtgctcctcgccggcgacgggccccgcgccaagctccggagcttcggcgcggcgcgggccatcacgggcgccaccgccggcgccggcgccgaggaggaggcgctgttcacaatgacgagccgcatcgcggggacgcgcggttacatcgcgccggagtacctggagcacggcgtggtgtcgcccaaggccgacgtgtactcgctcggcgtggtgctcctggagatcgtcacggggaaggacgccgaggagctggtgggggacggcgtgggcgacccgttcgccgcgctgcgggagctggttgaggagctcgacggcggcggcgacgcagtgctgcggaggctggaggagctcgtggacccggcgctgccggcggggagctgcccgcaggatgccgtggccatgatggtcaggctgatcgagaggtgcgtccggcgcgacgcggcggcccggccgagctccggggaggtggcgcggcgcctcctgaagctgtcgggggtctcggcggtcagctggcggaactcgccggagtcgccccggagctccggcagcgggaaaggcctaatgtactagatcagcagtagcctagccatgcctgccggccatagtgccgaattgttgtttcttttgcttggaaaaaaaaacatcgtgcgaattgtgaagcc

SEQ ID NO: 29647 - protein, 697 aa, Panicum virgatum
  misc_feature: Ceres CLONE 1892742
  misc_feature (386)..(668): Pfam Name: Pkinase Pfam Description: Protein kinase domain
  misc_feature (206)..(249): Pfam Name: LysM Pfam Description: LysM domain
  misc_feature: SWISSPROT Homolog: EC 2.7.11.1 Non-specific serine/threonine protein kinase
MASSCAVTASSSSLFLVLLFLASGGLAPPHLRVRAQQPYGSAIADCPNQHNASGLLGYFCGAGGAPSCPAFLTFNARPPYSTLASVAALLGADAAGLAAANGVPAAAPLADGTRVLVPATCACTATPESRFYQRNATYVVRPGDTLLIIANNTFQGLSSCQALQAQALRGAAPETLNASQPLPVPLRCACPTAAQAAAGARFLVSYLVAELDDVTAVAARFGVAVETIQEANRLQPPYTIFPYTTLLIPVSAQPNVSRIQTPPPPPPPPPVVAPLPGKKSGGHAGVYIGVAVAVAAVAAIASAGAVLAVKARRRRRAGAALDADDLAEKDGKGKGSDTNTTPSGFTGGGEFSLSTSEAFSSLSVTGIKSSLKVYTYAELRAATDDFSPDRRIGGGSVYRAAFHGDAAAVEVVDRDVSTEVEIMRKVNHLNLIRLVGLCHHHGRWYLVTEYAEHGALRDRLLAAGAGAAAPPLTWAQRVQVALDVAEGLRYLHEYARPPCVHMDVSSGSVLLAGDGPRAKLRSFGAARAITGATAGAGAEEEALFTMTSRIAGTRGYIAPEYLEHGVVSPKADVYSLGVVLLEIVTGKDAEELVGDGVGDPFAALRELVEELDGGGDAVLRRLEELVDPALPAGSCPQDAVAMMVRLIERCVRRDAAARPSSGEVARRLLKLSGVSAVSWRNSPESPRSSGSGKGLMY

SEQ ID NO: 29648 - DNA, 2003 bp, Panicum virgatum
  misc_feature: Ceres CLONE 1892753
  misc_feature: Encodes the peptide sequence at SEQ ID NO. 29649
atcacattgaggggaagggaggggagggtggttctgctttctagtacccgaccaacctgcacactgcacttgcatctgcctccctgaaagcctccccgccggctgctgcgactgcgaacccacctgcatttgctgaagcccggtggcccgtgtacctgtgactcgccgtatgccgcgtgcgtgtgtggggtattcaagaaatgctcggagttccattccccggctgaaatttctggaagggtttaagggtgtctaattgactgattatggatagaacaagaaaaggacattctgcagcttccataaatagtatttaagtgttgcaagaacaagaactgtttgcaatcagtgaagttcttcccccattttcctgcttgctactaacttatccattgaccagagcataagcagaattctggcctgagagatagagaagatggcagacactgaagctgccacggacctaggcagttcacggagatcacaagatgacaccgcaacattaatcccacacagtggcaacttggaagaatcaagccggaggggtgtgaagacaaccaggttcaaagatgatgatgaggttttggagatcactcttgatgtacagtgtgattcggtggcaatagaagatgtcagagcagttgatgatggtggctcagggcatggtggtgggtttgacggcctgtcactagtgtcaccttcctcatcaaggagcggcaaactcgcatcaaagctaaggcaggtaacaaacgggctaaagctgaagaactcaagcaataaggcacaacagacacagttgggaaagaacacgaggaagagattggacagaagcaagagtggtgctgctgtggcattgaagggcctgcagtttgtaactgcgaaagttggccaagatggttgggctgcagtggagaagcgcttcaatcagttacaggtcgatggtgtcctgctacattcaagatttgggaaatgcattgggatggaaggatctgatgagtttgcagggcaagtgttcgactcattggcaaggaagagagggatagtgaagcaggtgctgactaagaatgagctgaaagatttctgggagcaactcagcgatcaggggtttgacaaccgtctccggacattctttgacatggttgataagaatgctgatggaaggatcacagcagaggaggttaaggagattattacccttagtgcatcagcaaacaaactttccaagctgaaggaacgagctgatgagtacacagcactcatcatggaagaacttgaccctactaacctcggatacatagagcttgaggatctggaggcacttttgctgcagtcaccatctcaagctgctgcaagatcaagtacaacacatagctcaaagcttagcaaagctcttagcatgaggcttgctacaaacaaggacacaaatcaattttaccactactggcaagagttcttgtacttccttgaggagaactggaagcgtatttgggttatgactctctggctctcaatctgcattgccctcttcatttggaagtttatccaataccgtaatcgagctgtattcgacattatgggttattgtgtgacaactgcaaaaggtgctgcagagactctcaaattcaatatggccctggttctttttcctgtttgccgaaatacaataacttggattcggtccaagacaaagatcggagccgttgtgcccttcaatgataacataaactttcataaggtaatagcagcaggtgttgcagtaggtgttgctttgcatgcaggtgctcacctgacatgtgattttcctcggctgctccatgcaagtgatgctgcttatgaacctatgaagcctttctttggggacaaaagaccaccaaattactggtggtttgtaaagggaactgaagggtggacaggtgtggtcatggttgtacttatgactatagcttttgtattagcccaaccatggtttagacgtgacaggctcaaggattctaatcccctca

SEQ ID NO: 29649 - protein, 522 aa, Panicum virgatum
  misc_feature: Ceres CLONE 1892753
  misc_feature (128)..(226): Pfam Name: NADPH_Ox Pfam Description: Respiratory burst NADPH oxidase
  misc_feature (388)..(516): Pfam Name: Ferric_reduct Pfam Description: Ferric reductase like transmembrane component
  misc_feature (227)..(255): Pfam Name: efhand Pfam Description: EF hand
  misc_feature: SWISSPROT Homolog: EC 1.6.3.1 NAD(P)H oxidase
MADTEAATDLGSSRRSQDDTATLIPHSGNLEESSRRGVKTTRFKDDDEVLEITLDVQCDSVAIEDVRAVDDGGSGHGGGFDGLSLVSPSSSRSGKLASKLRQVTNGLKLKNSSNKAQQTQLGKNTRKRLDRSKSGAAVALKGLQFVTAKVGQDGWAAVEKRFNQLQVDGVLLHSRFGKCIGMEGSDEFAGQVFDSLARKRGIVKQVLTKNELKDFWEQLSDQGFDNRLRTFFDMVDKNADGRITAEEVKEIITLSASANKLSKLKERADEYTALIMEELDPTNLGYIELEDLEALLLQSPSQAAARSSTTHSSKLSKALSMRLATNKDTNQFYHYWQEFLYFLEENWKRIWVMTLWLSICIALFIWKFIQYRNRAVFDIMGYCVTTAKGAAETLKFNMALVLFPVCRNTITWIRSKTKIGAVVPFNDNINFHKVIAAGVAVGVALHAGAHLTCDFPRLLHASDAAYEPMKPFFGDKRPPNYWWFVKGTEGWTGVVMVVLMTIAFVLAQPWFRRDRLKDSNPL

SEQ ID NO: 29650 - DNA, 2087 bp, Panicum virgatum
  misc_feature: Ceres CLONE 1892754
  misc_feature: Encodes the peptide sequence at SEQ ID NO. 29651
aaatcatctccacctccaccccctccggcctccgcgtggccgtcttcccaggcctgctcccccaccatatcggactggtgcgtggcgcccttcctctccggtctctacttcccactgagacgctagctagctagccgagttggagacggccagcgacctccacctctggctctcgatctctgctgtgtctttgcatgacctgctgaaaagggtgcgtgccttccacgatcagtgcgcgtgcgctcgtccccgtgtcggttcgtggagcgtttcgtcgggcgtccatggaggagctgcgccgccgccgccggcagcgggtggtgggtgtcccgctgctgctggtactgatggtctccatgctcactgatctcggcagctgcaacgacgccggacaaggaactctgaacccagaggaaggtatcggctccgactccgaagccaggataatccatggcgaccgtacacgaaaaattctgcaggagcagcagaacaagtactggtctggatatttcagcaacaaggcggcatggccgggtttcaccaacaataatcctccagccggccgaggcggttttcagagcccgccgtcgacgttcacgccgcagtatccgcaatggccaccgtggccgtggacaccgaaggtttcgccgccgatgagctttcccccatcgcctgctccggcaccttccaagcctttgccgctgcccgcgcatgatggaaatccttcacacagcatcgcactgcccccacagccgccgtcaggcaccggtagtaagccggtagttgccggagttgtgcctggagcggggcactctggtcatgttcgcaggcctgcctatgtcatcgccgcggcaggggcctccctcctcgcggcggtgtcggtggcgctcttcgtcctgtgctgccggtccagcaaggtggtcaccgtaaggccgtgggcgaccggcctcagcgggcagctacagaaagcatttgtcacaggtgtgccatcgctgaagagatcggagcttgagctcgcctgcgaggacttcagcaacatcatcggctccttgtcggattacatggtgtacaaggggacgctgtcaagcggcgtcgagatcgcggtggtgtcgacgaccaagaactctgccaaagaatggtccaagcgctgcgaaacacagttcaggaagaagatagcaagcttgtccagagtcaaccacaagaacttcgtgaacctgctgggctactgccaggaagaacagcccttcaccaggatgatggtgttcgagtacgctccgaacggcacactcttcgagcatctccacgtcagagaagacggccacctggactggccgacgcgcctgcgggtggctgtgggcgtcgcctactgcctggagcacatgcaccagctgagcccgccggagatcctgcgcacgctggacacgtccaccatctgcctgaccgacgatttcgccgccaagatctccgacgtcttcttctgcgacgagccccgggaccgggaggaggcgagcctgccgtccctgtccccggcgctggcggacagggagagcgtggtgtacagctacgggatggtgctgctggagaccatgaccggccggttcacggcgtcggggggcggcctgctggagggctgggcggcggggtacctgagaggggagcggcagctcagggacgtgatggaccccgcgctgcggaggtccttccacgccgccaccgtggaccggctggacggcgtcatcaggggctgcaccgaccgcgagcccaggcggcggctgacgatgccggaggtcgccaggcggctgagggagatcaccgccatgccgcccgacgcggctaccccgaagttgtcgccgctgtggtgggcggagcaggagatcatctccacggaggtcaactgaaactgaagacatggaatgggaatgttttgtttgcaaggatttcatccaggtcgtttcaaatcctgaaattccgagaacaggatcccgttcaaatgcacctggaaactgctgtgtagttgagaagacaggttgattttgtaaatttttttctccgttttctggtattcatttgttttgtcctgtaaagtc

SEQ ID NO: 29651 - protein, 537 aa, Panicum virgatum
  misc_feature: Ceres CLONE 1892754
  misc_feature (260)..(506): Pfam Name: Pkinase_Tyr Pfam Description: Protein tyrosine kinase
  misc_feature: SWISSPROT Homolog: EC 2.7.11.1 Non-specific serine/threonine protein kinase
MEELRRRRRQRVVGVPLLLVLMVSMLTDLGSCNDAGQGTLNPEEGIGSDSEARIIHGDRTRKILQEQQNKYWSGYFSNKAAWPGFTNNNPPAGRGGFQSPPSTFTPQYPQWPPWPWTPKVSPPMSFPPSPAPAPSKPLPLPAHDGNPSHSIALPPQPPSGTGSKPVVAGVVPGAGHSGHVRRPAYVIAAAGASLLAAVSVALFVLCCRSSKVVTVRPWATGLSGQLQKAFVTGVPSLKRSELELACEDFSNIIGSLSDYMVYKGTLSSGVEIAVVSTTKNSAKEWSKRCETQFRKKIASLSRVNHKNFVNLLGYCQEEQPFTRMMVFEYAPNGTLFEHLHVREDGHLDWPTRLRVAVGVAYCLEHMHQLSPPEILRTLDTSTICLTDDFAAKISDVFFCDEPRDREEASLPSLSPALADRESVVYSYGMVLLETMTGRFTASGGGLLEGWAAGYLRGERQLRDVMDPALRRSFHAATVDRLDGVIRGCTDREPRRRLTMPEVARRLREITAMPPDAATPKLSPLWWAEQEIISTEVN

SEQ ID NO: 29652 - DNA, 1849 bp, Panicum virgatum
  misc_feature: Ceres CLONE 1892764
  misc_feature: Encodes the peptide sequence at SEQ ID NO. 29653
agtctcttttgctggttatcttcggcgaggcgacagggggcagaaggaagcagcttgtctggtctcggcggcgccgccttcctcctcctccttctctctactgtagcaggccccggagttgagctgaatttcgtcggattggatggacagccaggctcctcccgctgccgctgccgctaccgatgccaacaccagcgtcatgtgccagctggtcagccccgaaggagaccatctcggtgcggcgctctatctgccgcagaacgtcgggcccccgcagctccaggagattgtcaatcacctcctccacaatgaggacaagctgccctatgcattttacattggagatgaggagctctctgtccagctgggcacttacatgcagcaaaagaacgccaatgttgaggttacgctgcgcatagtatatcaaccacaagcacttttccggatcaggccagtcaaccgctgctcggctacgattgctggtcacacagaagctgtacttgctgtttcttttagccctgatggaaaatgtttggcgagtggttcaggtgacaccagtgttcgcttttgggaccttgatacacagactccattattcacatgcaaaggacacaaaaattgggttctctgcattgcgtggtcgcctgacgggaaacatcttgttagtggaagcaagtcaggagaacttatattatgggacccaaaaactgggaagcaattgggctctccacttatgggacacaggaaatggattactgctgtatcttgggagccagcccatttgcaagctccgtgccgccgctttgtaagtgcaagcaaggatggcgatgctcgcatttgggatatcaccacaaggaaatgtgttatttctcttacaggtcacactaattcagtgacctgtgtcaagtggggtggtgatggtttgatttatacaggttctgaagattgtttgatcaaagtatgggaaacatctcagggaaagttggtcaaaacattgcagggtcatgggcactgggtgaattcacttgccttgagcacggaatatgttctacgcactggaccatatgaccatactggcaagacatactcaaccgcagaggaaattaaagaggcagctcttgcgagatacaagaagatgaggggtaatgctcctgagagactagtttccggttctgatgatttcacaatgtttctttgggaaccagcaattagtaaacaacctaaagctcgcatgactggtcatcagaagcttgtgaaccatgtgtacttttcacctgatgggcaatggttagccagtgcctcctttgataaatctgtcaagttgtggaacggtatcacaggaaagtttgttgcagctttcagggggcatgttgcagatgtctaccagatcagctggtctgctgacagtaggcttctgctaagtggaagcaaggattcaaccctaaaggtttgggatattcgaacgcacaagttgaaacaggacctaccgggccacgcggatgaggtgtatgccgtggattggagccctgacggtgaaaaggtggcatctggtgggaaggatcgggtcctcaagctttggatgtgactgaccaagctgttacggtttgaagtctggatacgctacaaatacaagaagagtgatggaactcctgtgataaaaatagttttggtttaggaaccttatgtttagcgagttaatgtggtgagatttcaagctatttctgtttgtatttatttgtgtggtatctggagctagcatcgacatatccatccatgcaaagaaaaacataatggatttgtacaagcacctgattattgcatcaataggtatcagtacttgcaacatccc

SEQ ID NO: 29653 - protein, 480 aa, Panicum virgatum
  misc_feature: Ceres CLONE 1892764
  misc_feature (106)..(144): Pfam Name: WD40 Pfam Description: WD domain, G-beta repeat
  misc_feature (238)..(275): Pfam Name: WD40 Pfam Description: WD domain, G-beta repeat
  misc_feature (358)..(396): Pfam Name: WD40 Pfam Description: WD domain, G-beta repeat
  misc_feature (148)..(186): Pfam Name: WD40 Pfam Description: WD domain, G-beta repeat
  misc_feature (400)..(438): Pfam Name: WD40 Pfam Description: WD domain, G-beta repeat
  misc_feature (442)..(480): Pfam Name: WD40 Pfam Description: WD domain, G-beta repeat
  misc_feature (191)..(234): Pfam Name: WD40 Pfam Description: WD domain, G-beta repeat
  misc_feature (279)..(353): Pfam Name: WD40 Pfam Description: WD domain, G-beta repeat
  misc_feature (18)..(79): Pfam Name: NLE Pfam Description: NLE (NUC135) domain
  misc_feature: SWISSPROT Homolog: EC 2.7.11.7 [Myosin heavy-chain] kinase
MDSQAPPAAAAATDANTSVMCQLVSPEGDHLGAALYLPQNVGPPQLQEIVNHLLHNEDKLPYAFYIGDEELSVQLGTYMQQKNANVEVTLRIVYQPQALFRIRPVNRCSATIAGHTEAVLAVSFSPDGKCLASGSGDTSVRFWDLDTQTPLFTCKGHKNWVLCIAWSPDGKHLVSGSKSGELILWDPKTGKQLGSPLMGHRKWITAVSWEPAHLQAPCRRFVSASKDGDARIWDITTRKCVISLTGHTNSVTCVKWGGDGLIYTGSEDCLIKVWETSQGKLVKTLQGHGHWVNSLALSTEYVLRTGPYDHTGKTYSTAEEIKEAALARYKKMRGNAPERLVSGSDDFTMFLWEPAISKQPKARMTGHQKLVNHVYFSPDGQWLASASFDKSVKLWNGITGKFVAAFRGHVADVYQISWSADSRLLLSGSKDSTLKVWDIRTHKLKQDLPGHADEVYAVDWSPDGEKVASGGKDRVLKLWM

SEQ ID NO: 29654 - DNA, 742 bp, Panicum virgatum
  misc_feature: Ceres CLONE 1892791
  misc_feature: Encodes the peptide sequence at SEQ ID NO. 29655
acctagctcctgcttactactcacatagtcacatttcccactaaaccccgacggtgccgagacgcacgcatcgcgacgcctccccgcacgcaggcacggacccctgtctatctcatctcacgcacgcagcagcaggcgcggaaagcgacgcgccttcaccgcccctgcttgccgcctccctcccctccccgtatcgtcgtcctcctgccccggacgcggccaagcagcaagcgcccaaaccccccaaacccaagcctctggcggcgcccgcgccaccttgaagcaagcgcccgtgcgcgattggcgggtcggagcgtttgaagcggcgcgaggagtggagatgatggcggcggcgctggacgcaatggcggggacgcggtgggggcggtggctcggcctggtgacggcggtgtgggtgcagtgcatctccggcaacaactacaccttctccaactactcggacgcgctcaagacgctcatgggcctcacccagctgcagctcaacggcctctccgtcgccaaggacgtcggcaaggcgttcggcctcctcgcggggctcgcctccgaccgcgtccccacctggctcctcctcgccatcggctccctcgagggcctcctcggctacggcgcggagtggatggtcgtgtccgggaccgtcgcgccactcccctactggcagatgtgcgtcttcctctgcctcggcggcaacagcaccacctggatgaacaccgcccgtgctcgt

SEQ ID NO: 29655 - protein, 133 aa, Panicum virgatum
  misc_feature: Ceres CLONE 1892791
  misc_feature (16)..(132): Pfam Name: Nodulin-like Pfam Description: Nodulin-like
MMAAALDAMAGTRWGRWLGLVTAVWVQCISGNNYTFSNYSDALKTLMGLTQLQLNGLSVAKDVGKAFGLLAGLASDRVPTWLLLAIGSLEGLLGYGAEWMVVSGTVAPLPYWQMCVFLCLGGNSTTWMNTARA

SEQ ID NO: 29656 - DNA, 1393 bp, Panicum virgatum
  misc_feature: Ceres CLONE 1892811
  misc_feature: Encodes the peptide sequence at SEQ ID NO. 29657
acggtgaacctcaacctcctcctaaaccttggcgatggcggcgtcgccgtatctcctcctcctcctgctgctcgtccatccagcagccgcacccgcctcccgcgagctgccgccttcgcagccgccaccgccgcggccgcctcagaaggtgcaggtgtggcccaagccggtgaccgtctcgtggccgacggcggtgtacgcgccgctggccccgtcgttcagcatccgcgcctcgccgtcgcaaccgtcgctccgccacgccatcgcctactacggccgcctcatccgcagcgagcgccacacgccgattgtgccccccgccaactacaccctctcccgcgtccccatcggcctgctcgcgctctccgtctccgaccccgacctcccgctcggccccggcgtcgacgagtcctacacgctctccgtgccccccaactctggctccgccgacatctccgccgccacgacatggggcgccatccgtggcctcgagaccttctcccagctgtcctgggcgggcggcggcgccgccgcgggcggccagccgatcgtcccctgcgacatcgagatctccgaccaccccctcttcacccaccgcggcatcctcctcgacaccgcccggaactactaccccgtccgcgacatccttcgcaccatccgcgccatggccttcaacaagctcaacgtgttccactggcacatcaccgactcccagtcgttccccctcgtcctcccctccgtccccaatctcgccaatttcggttcctactcccccgaaatgcgctacacggaccaggacgtccgccgcgtcgtccgcttcgccgaggccttcggcatccgcgtcatccccgagatcgacatgcccgggcacgcggggtcgtgggcgggggcgtacccggagatcgtgacctgcgccaacaagttctgggccccggcggcgaagccggccctggcggcggagcccggcacggggcagctgaacccgctcaatcccaagacgtaccgcgtggcgcaggacgtgctgcgcgacctggcggtgctgttcccggacccgtacctccacggcggcgcggacgaggtgaacacggcgtgctgggaggacgaccccgtggtgcggcgcttcctggcggacggcggctcccacgaccggctgctggagctgttcgtgaacgcgacgcggccgttcctggtgaacgagctcaaccgcacggtggtatactgggaggacgtcctcctggggcccaaggtgtcggtggggcagacggtgctcccccgcgacaccaccgtgctgcagacctggaacaacggcgccgacaacaccaagcgcatcgtggccgccggctaccgcgccatcgtctcctccgcgtcctactactacctggactgcgggcac

SEQ ID NO: 29657 - protein, 452 aa, Panicum virgatum
  misc_feature: Ceres CLONE 1892811
  misc_feature (185)..(451): Pfam Name: Glyco_hydro_20 Pfam Description: Glycosyl hydrolase family 20, catalytic domain
  misc_feature (54)..(183): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
MAASPYLLLLLLLVHPAAAPASRELPPSQPPPPRPPQKVQVWPKPVTVSWPTAVYAPLAPSFSIRASPSQPSLRHAIAYYGRLIRSERHTPIVPPANYTLSRVPIGLLALSVSDPDLPLGPGVDESYTLSVPPNSGSADISAATTWGAIRGLETFSQLSWAGGGAAAGGQPIVPCDIEISDHPLFTHRGILLDTARNYYPVRDILRTIRAMAFNKLNVFHWHITDSQSFPLVLPSVPNLANFGSYSPEMRYTDQDVRRVVRFAEAFGIRVIPEIDMPGHAGSWAGAYPEIVTCANKFWAPAAKPALAAEPGTGQLNPLNPKTYRVAQDVLRDLAVLFPDPYLHGGADEVNTACWEDDPVVRRFLADGGSHDRLLELFVNATRPFLVNELNRTVVYWEDVLLGPKVSVGQTVLPRDTTVLQTWNNGADNTKRIVAAGYRAIVSSASYYYLDCG

SEQ ID NO: 29658 - DNA, 678 bp, Panicum virgatum
  misc_feature: Ceres CLONE 1892811-R
  misc_feature: Encodes the peptide sequence at SEQ ID NO. 29659
ctacctggactgcgggcacggcgggtgggtcggcaacgacagccggtacgacgtgcaggacaaggagcgcgagggcacgccgctgttcaacgaccccggcggcacgggcgggtcctggtgcgcgcccttcaagacgtggcagcgcatctacgactacgacatcctgcacgggctcacggaggacgaggccacgcgggtgctcggcggcgaggtggcgctgtggtcggagcagtcggacgccgtcgtgctggacgccaggctctggcccagggccgccgccgccgccgagacgctctggtccgggaacaagggcgccaacgggaggaagcgctacgccaacgccacggcccggctcaacgagtggaggtacagaatggtggcgcgcggcatccgcgccgagccgatccagccgctatggtgcccgctgcacccgcgcatgtgccacctctcggagtagcgtagcagcctgaagcaatgctcgtcgtgggctcgtggcaaacagcaagctcgctgcctgcaatggactgaatattggcagcacgaggtcaaacaggagcaggcagagatttgggtgggacttggtgaaaaaaggaatcatcagcatcgttctttcggatcgaagcaggaatgactgggcgaatcaagaacagaataaaaccaaggcatcctcaatctggc

SEQ ID NO: 29659 - protein, 151 aa, Panicum virgatum
  misc_feature: Ceres CLONE 1892811-R
  misc_feature: SWISSPROT Homolog: EC 3.2.1.52 Beta-N-acetylhexosaminidase
YLDCGHGGWVGNDSRYDVQDKEREGTPLFNDPGGTGGSWCAPFKTWQRIYDYDILHGLTEDEATRVLGGEVALWSEQSDAVVLDARLWPRAAAAAETLWSGNKGANGRKRYANATARLNEWRYRMVARGIRAEPIQPLWCPLHPRMCHLSE

SEQ ID NO: 29660 - DNA, 2155 bp, Panicum virgatum
  misc_feature: Ceres CLONE 1892827
  misc_feature: Encodes the peptide sequence at SEQ ID NO. 29661
tgtgttagaggttcccatagtactgggctcctctcccttccgagttcagccgccaccacgccctccgcctcccttccgccgccacgccgccgcctccgttctgccgccgccacgcatccgcctccccttgagcttcctctcctcgctcgcctggataagccgcggcgcggcgctgcaccaccactgcccactgccctacgatctcttctattactactactccaaggaggcctggagcgaacaccctcgccctccgctcggaatcccggcgaccggggcaagccgcagcaaaggctgcctatatctttgtccttctcgggtctgacacatgcttctcttccctttccttcccttcttgcagttgcgggtcgctcgtcttgtgtgggtgagaaagattatgctgctgcagatttcagtttgcggtgaaactggggttgcaattcgtcccacttgcagggtgacggagaagccttttctctcgacggcagtggcagcggacgagcgtttggaggacgggaagcttgctgtgcggctgtgtgcggctcaaaatcatagctcctcgcctgcttcttctcgccaagtgctctcctgcctcgccgatcccgcgggcacgatgagggtgaaggtgatatcgcgctccaccgaagagttcacgcgcgaccgcaggcaggacctgcagaaagtattccgcaactatgatccagggcttcgtagtcaagagaaagccgttgagtacactcgggcacttaatgctgcaaagttagagaagatatttgctaagccatttattggagctatggatggtcatattgatgcggtatcgtgcatggccaagaaccccaatcatttgaaagcaatattttctggttcaatggatggagatattcgcctttgggacatttctgcaaggaagacagtttgccagttccctggacaccaaggtgctgtaagaggtctaacaacatctacggatggtgatcttcttgtatcatgtggcgtggactgcactgttcgactctggaaagttccaatgcttaaaatggtggacactagtgaccatactagagatacttcccagccatcagcagtctacacctggaagcatgcattctggggtgctgaccaccagtgggacggtaatctttttgctactgttggtgctcaagttgatatatgggatcctaacagctttgaatggggtaaagatacagttctttcggtgcgctttgatcctggagactgtaatattttgattacatcagccagtgatcggagtctaacactttatgacctgcgcatgtcatctccagctagaaagctaataatgaagacaaggtgcaattcagtatgctggaaccctagggagcccatgaacttcactgctgcaaatgaagacacaaactgctactcctttgatgctagaaggctagatgaagccaaaattgttcacaaaggccatgtttcagcagtgatggatattgactactcaccaactgggcgtgaatttattactggttcctatgatagaacagtaaggatttttaattatcttggtgatcatagcagagagatttaccacaccaagaggatgcaaagggtattttgtgtgaagtacacctacgacgggacatatctagtctctggcagtgatgatacaaatcttcggctgtggaaatccaaagcttcggaacaacttggagttcttcttccacgggagcgcaaaaagcaagaatacctggatgctgtgaaggagcgatataagcacctcccagaagtgaagcggattgtgcggcatagacacctgccgaagccgatctacaaggcggccaacctacggcgtacgatggttgaagccgagaaccggaaagaggagaggaggcgaaagcacagcgctccagggagcatgcccgggcagcccttcaggaagcgaaggatcatcaaagaagttgagtaggcgtagggtttgcagggccgtgctgtttatgttggcccccaaacgtctagttatcgtggagattgctgtagtgtgtgtcactatgttgagaattaatgtatcgattgagaattgggaccactagctgaagttttgcattgttgtttacgtatatgcatggtgtatccagatggtcactgaattccaaaacatttctcctac

SEQ ID NO: 29661 - protein, 541 aa, Panicum virgatum
  misc_feature: Ceres CLONE 1892827
  misc_feature (450)..(537): Pfam Name: Sof1 Pfam Description: Sof1-like domain
  misc_feature (194)..(232): Pfam Name: WD40 Pfam Description: WD domain, G-beta repeat
  misc_feature (368)..(406): Pfam Name: WD40 Pfam Description: WD domain, G-beta repeat
  misc_feature (151)..(190): Pfam Name: WD40 Pfam Description: WD domain, G-beta repeat
  misc_feature: SWISSPROT Homolog: EC 2.3.1.48 Histone acetyltransferase
MLLFPFLPFLQLRVARLVWVRKIMLLQISVCGETGVAIRPTCRVTEKPFLSTAVAADERLEDGKLAVRLCAAQNHSSSPASSRQVLSCLADPAGTMRVKVISRSTEEFTRDRRQDLQKVFRNYDPGLRSQEKAVEYTRALNAAKLEKIFAKPFIGAMDGHIDAVSCMAKNPNHLKAIFSGSMDGDIRLWDISARKTVCQFPGHQGAVRGLTTSTDGDLLVSCGVDCTVRLWKVPMLKMVDTSDHTRDTSQPSAVYTWKHAFWGADHQWDGNLFATVGAQVDIWDPNSFEWGKDTVLSVRFDPGDCNILITSASDRSLTLYDLRMSSPARKLIMKTRCNSVCWNPREPMNFTAANEDTNCYSFDARRLDEAKIVHKGHVSAVMDIDYSPTGREFITGSYDRTVRIFNYLGDHSREIYHTKRMQRVFCVKYTYDGTYLVSGSDDTNLRLWKSKASEQLGVLLPRERKKQEYLDAVKERYKHLPEVKRIVRHRHLPKPIYKAANLRRTMVEAENRKEERRRKHSAPGSMPGQPFRKRRIIKEVE

SEQ ID NO: 29662 - DNA, 654 bp, Panicum virgatum
  misc_feature: Ceres CLONE 1892834
  misc_feature: Encodes the peptide sequence at SEQ ID NO. 29663
atttttgtatttgcctgttcttccccgttacccaaaccctcgacacccggccaccgccgccgccgcaggcaatctcgcgagttcgcaaggcttgacccgccgttgccaaggacgcgcccgtgaggccgctgtcgaggagaccggcgccgccgtccaatctccaatagccgccgtggcttatggaaactcatgggatgggctgtcatgggactgttggaagctctgatggcacagaagagagggaaaacagctcaattaacttatgctctgaaggtgtcaacctcaatttgatacaaccaaatttagaggaagatgttagtacagaaagtttgcttgctaataaaaaactgtggtcaaatgtctggaaagaatttgagttagctatgctagatgatggtacttataaagcaatatgcaagcactgtaaaaaagatttagcagccggtaatagagctggtacaagccacttgaagtaccacattggagtctgtcctaagcttcagttatcaaggagaagaaaatttggtagtccaaagttggatattcctatctttggagatgatacttttcttatgcttgaaagagctatggaatttcgtgatgcttttgatagatggcatgaatgtgatagctcctacaagttcttaccttcaa

SEQ ID NO: 29663 - protein, 158 aa, Panicum virgatum
  misc_feature: Ceres CLONE 1892834
  misc_feature (59)..(105): Pfam Name: zf-BED Pfam Description: BED zinc finger
METHGMGCHGTVGSSDGTEERENSSINLCSEGVNLNLIQPNLEEDVSTESLLANKKLWSNVWKEFELAMLDDGTYKAICKHCKKDLAAGNRAGTSHLKYHIGVCPKLQLSRRRKFGSPKLDIPIFGDDTFLMLERAMEFRDAFDRWHECDSSYKFLPS

SEQ ID NO: 29664 - DNA, 593 bp, Panicum virgatum
  misc_feature: Ceres CLONE 1892834-R
  misc_feature: Encodes the peptide sequence at SEQ ID NO. 29665
atgatgatcagattcttcttgagaagacatggagatactacgaccaggggaatctggagaagatcatagacagttctctaggcgacgacctagatgtcgaccaagcctgcaggttcctgaagattgggctcctctgcacccaggacgtcacgaagcggcgtccaggcatttcaacagtggtggccatgctgaaaggcgaggtggaagtgaacactgagatgatcaacaagcccgacgtgatcagggacttcagggacctgaagctccggagcagggccacatcatcgaccatgctgacctccatcatggcgcgctcatccccgctatcgtctgaagagacgacgcgcacctccatcaccttcacagcaatatcagagcgcgactgatgatcggggatgcgattgactgtgtctgcaaccgtttagctagagcaaattgtatgtagcataggccagaatcctttttggtggttgtatgtttcgtgtgcatatagatgtgcgttttcccctgttatagagcatatgaacaaattgattatactttcagagccagaatcaacctgtgaagtaaataaatggaagtctgctcatttc

SEQ ID NO: 29665 - protein, 127 aa, Panicum virgatum
  misc_feature: Ceres CLONE 1892834-R
  misc_feature: SWISSPROT Homolog: EC 2.7.11.1 Non-specific serine/threonine protein kinase
DDQILLEKTWRYYDQGNLEKIIDSSLGDDLDVDQACRFLKIGLLCTQDVTKRRPGISTVVAMLKGEVEVNTEMINKPDVIRDFRDLKLRSRATSSTMLTSIMARSSPLSSEETTRTSITFTAISERD

SEQ ID NO: 29666 - DNA, 3070 bp, Panicum virgatum
  misc_feature: Ceres CLONE 1892839
  misc_feature: Encodes the peptide sequence at SEQ ID NO. 29667
aggttcctcctcttcctcgaaatcctatcctcctccgccatcctcccaggcgcgcacgcgcgctgctcgcccgccggccgccgccgccggggcgatcttccagggcctagagctcgcacccgccccagcccctccaccgacctcagccatctcattttccaactccggtgagcttcttcatcacgcattcgcccccgccctccttcctcttctccggccgcacccgccgcctgctccccccgtgtcccggagttgtcgtccgaatggcggcgtggcaggagagggccttgcggcgttgcctcctcgtgccgctataactgtttatccttcctgcggagccgttggtcgcccctcgtcgtgcgctcgccctggtcctttgccagttgccactcgccggagatggcgctgcaggcccagcagctgccctccttctccttctccttctccttcacccctccgactctccggaccttccaccctagccgccccctcaaatatgcgccgtcctccagatgcttccttcactcccactcccaattccacaccccgcggccgcgaaggtacccagtcgcctgccctccgcatcttttcttgcaaggacagggaaacgaaggcgacgacgacggggaggagtcggtggaaagctggggtggacctgctagccccttccgagatgatactgatggggagggcggcgacgcctcggaggacgaagacgagcttcaagaatccgacgaggatgaggatgagaaggaaggcggagagggattgggcgagtgggacccgcctgtcagtccctttcgaacgcagcgcgaggaaacgcactaccaagaagaagagggagaggacgatgcagaaggatgccagtggttggacccgacctccttcttaccaagccaagaaggggtgagcggcgtttgcagaagcaccagcatggcaaccatggaagcaatcctcacctttgccaggagcccggcagcggcgggagactcagcattcaccgaattcttgtccggttacagccacgagacctcagcgagggggcctgcgtggaattgatgaggaggatgtctgaagaggggctggcattgggctgtgtccacctgttccagtggttgcgggggaagcagccggtgctggtgtcaccacaggtgtggctggcaggtattgttgcgcttgggcggtgccagatggctgatgaggtcttggagattgtggcaagattgcctcctgcgagggagttccgcgaggcagttgtttacaatgccgctatatctgctgttgcctactgcgagagatatgatggtgcctggaaaatttttgagctcatggaaaagaacaatatccaacctgatcacaggacatcctcaatcatgcttaatattatgaagaatactaaggcatctgctaaggatgcatgggagtttttccaacggatgaacagaaaaggagttaactggagcttggatgttgctgctgctttggtcaatatcttttgttgtgaggggctcagaaaggaagttttaatcatccagtcagaaatggagaagagaggaattgcatcaaacacaagcatatataacatgttaatgacggcattctgcaaatctaaccaaattgaagaagctgaggggctctttgttgagatgaaagaaaaaggtttgcaaccaacaataacaacttataatatccttatggatgcttacagtaggagattgcagccagaagttgttgaattgttacttctggagatgcaagatttgagtttaattccaaatgctggatcatacaattgtctcataagagcctatggtcggcaaaagaaaatgagtgaaaaggctgaagatgctttcttgaggatgaaagcacatggcattaagccattatcttcttcatacactgcactactttgtgcatatgcagttaatggactacatgaaaaagctcataccatgtatatggatatgaaaagtgaaggacttaaacctacgttagaaacatatacagctttaattgacactcttaggagagctggtgacacagagaagctaatggagacatggaaaaatatgattgatgaaaaggttggtggaacaagagtcatattccacatgatacttgattgtttagcaaaacatgggttataccatcaggcaagggatgttatatatgaatttggaaagattggtttaaagcctactgttatgacatacaacattttgatgaatgcttatggcagaggggggcagcattacaaattgccccaactcctgaaagagatggctgctcttgaactaaaaccagactccattacatattgtacaatgatatatgcatatgcccgtgttcgcgacttttcgagggcattctattaccacaagaagatggttcgaagtgggcaaatacctgatcctaagtcgtacagaaaactgttgaacactttggatgtgaaggctgcaagaaagaatataaaggataagagtgcaatacaagggatcataaaaggcaaggctggcttaaagcctaggaaggaaaagaaagacgagttttggaagaacagaagaaagcggtctatgctgaactcaacttatggacaccaaagaaaaagatttttgtgaatttaccttcggtgtacattcaattgtgttcaagatttacatcctatttcatggtccctgcattttcgctcttgaaagttgaaatgttaagttggagcctgtgctatagatatgcattttccttttctgctctcagtaacctgaatcaactttaagggtttgtctttgaacatgattggccttgaaaaccattcagcttaacaggttcttatagagaactatggagaggatgtctacaaatcaaagacaagcgaaatctacagtctgaatgcaatgctgctacctcctctcattgaaacgaaaaaagtttccttgacagctggcgtcaaaaagagtttccttgacagctccaactgtcagtaatatctgcaaaacggaggcaaagaaaaacaataaagttgaaagagcaataaagttgaaagagtatgaagcgcagttctcttgtgtgttcg

SEQ ID NO: 29667 - protein, 585 aa, Panicum virgatum
  misc_feature: Ceres CLONE 1892839
  misc_feature (238)..(272): Pfam Name: PPR Pfam Description: PPR repeat
  misc_feature (344)..(378): Pfam Name: PPR Pfam Description: PPR repeat
  misc_feature (484)..(518): Pfam Name: PPR Pfam Description: PPR repeat
  misc_feature (449)..(483): Pfam Name: PPR Pfam Description: PPR repeat
  misc_feature (132)..(166): Pfam Name: PPR Pfam Description: PPR repeat
  misc_feature (273)..(307): Pfam Name: PPR Pfam Description: PPR repeat
MPVVGPDLLLTKPRRGERRLQKHQHGNHGSNPHLCQEPGSGGRLSIHRILVRLQPRDLSEGACVELMRRMSEEGLALGCVHLFQWLRGKQPVLVSPQVWLAGIVALGRCQMADEVLEIVARLPPAREFREAVVYNAAISAVAYCERYDGAWKIFELMEKNNIQPDHRTSSIMLNIMKNTKASAKDAWEFFQRMNRKGVNWSLDVAAALVNIFCCEGLRKEVLIIQSEMEKRGIASNTSIYNMLMTAFCKSNQIEEAEGLFVEMKEKGLQPTITTYNILMDAYSRRLQPEVVELLLLEMQDLSLIPNAGSYNCLIRAYGRQKKMSEKAEDAFLRMKAHGIKPLSSSYTALLCAYAVNGLHEKAHTMYMDMKSEGLKPTLETYTALIDTLRRAGDTEKLMETWKNMIDEKVGGTRVIFHMILDCLAKHGLYHQARDVIYEFGKIGLKPTVMTYNILMNAYGRGGQHYKLPQLLKEMAALELKPDSITYCTMIYAYARVRDFSRAFYYHKKMVRSGQIPDPKSYRKLLNTLDVKAARKNIKDKSAIQGIIKGKAGLKPRKEKKDEFWKNRRKRSMLNSTYGHQRKRFL

SEQ ID NO: 29668 - DNA, 2029 bp, Panicum virgatum
  misc_feature: Ceres CLONE 1892841
  misc_feature: Encodes the peptide sequence at SEQ ID NO. 29669
acttttcttctcttcccatcatcatttctttctttctccccacgatttgtttgctcccttctctctctcccgtcctcgtcctcgtcttgctcgagccgcgcggcgatcgcatcgagccggagagagggtagaggcgcggccgcaaaaccctagagcagcgagggagggtggtcttcgcggaagcaggaggaccggaagagagagatgcagggcgccagccacatgctcctggaggagccggtgcgcctcgcctccgtgctcgcccccgccaagcccaaagtgttcccgtccctcaccaagattgttgggacgctcgggcccaagtcgcactcggtagaggttattcagggatgcctcactgctggaatgtcagttgctcggttcgatttgtcatggatggatgctgagtatcaccaggagacccataacaatctgaggaaagcggcgcagaatgtgaagaagttgtgccctgtaatgcttgatactctgggtccagaaattcaggttcacaattccactggtgggccaattgagttgaaagctgggaaccatgttatcataactccagatatatctaaagctctatctgctgagatcttaccaattaaatttggtgatctcgcaaaagacgtgaagaagggcgatactctttttatgggtcaatatctcttcacaggaagcgaaacaacgtctgtctggttagaggttgtggacacttccggtgaaaatgtgaattgtcttgtgaagaatacagctacacttgctggtcccattttcactttgcatgcttcacaagtccacatcagtttgccaacattgagtgaatatgataaacaagtcatttcaacttggggttcccgtaacaacgttgatattatttctctttcccatacccgctctgctgaggatgtaagggagcttaaatcctttttacaatcacatgattttcctgagacacaaatatatgcgaagattgaaaattctgagggtttggatcatttcgatgaaattctcaaagaggctgatggcatcattctttctcgaggagacctgggaattgatcttccaccagaaaatgttttcatgttccagaagacagctattcataaatgcaatctagagggtaaacctgtgatcgtcactagagttgtggacagcatgattgacaatctacgccctacacgtgcagaggccactgatgttgcgaatgctgtgctagatggaactgatggtattctgctcggtgcggagacacttcgagggctctatcctgttgatgcagtgagtactgtgggcaggatatgtgcagaagctgagactgtgtataaccagccacttcaattcaagaaagtaatgtggcatgttggtgatccgatgccccatgaggaatctgtggcatcagcagcggttggttctgcgattaaagtaaaagctgctgcaattgtcgtattcacattctcagggagagctgctaggttaatttctaagtacaggccgacaatgccagttttagcagttatcttcccgcgtgaaggatccgatccatcaaagtggcgttcatatggaaccactcaggcaaggcaatgttttgcagtgagaggcgtgtaccctttgatggggagtactgatgaggccgaaactggtgggctcacaaaggaagagtatgggataaaactggcactgaactatggtcggtcagttggcatagtgaagcctttcgacagggtgataatctttgaaaagattggtgattcttctgttgtcaagatcattgagtgtgaaggttaaacattagatacccactacccatgctattggttcatgtgatgcatgggagattacctccagtttttctcacttatttgaccaaagataactggagagtacagcatgtgcacctgttgtctttttaggtgattttgcctcttttccaatttcaaatgtttgaaagttttggtccaataaaccaagattgtctcagagacctatatactggaattacacataggattgttgacacaataccatg

SEQ ID NO: 29669 - protein, 527 aa, Panicum virgatum
  misc_feature: Ceres CLONE 1892841
  misc_feature (31)..(379): Pfam Name: PK Pfam Description: Pyruvate kinase, barrel domain
  misc_feature (394)..(524): Pfam Name: PK_C Pfam Description: Pyruvate kinase, alpha/beta domain
  misc_feature: SWISSPROT Homolog: EC 2.7.1.40 Pyruvate kinase
MQGASHMLLEEPVRLASVLAPAKPKVFPSLTKIVGTLGPKSHSVEVIQGCLTAGMSVARFDLSWMDAEYHQETHNNLRKAAQNVKKLCPVMLDTLGPEIQVHNSTGGPIELKAGNHVIITPDISKALSAEILPIKFGDLAKDVKKGDTLFMGQYLFTGSETTSVWLEVVDTSGENVNCLVKNTATLAGPIFTLHASQVHISLPTLSEYDKQVISTWGSRNNVDIISLSHTRSAEDVRELKSFLQSHDFPETQIYAKIENSEGLDHFDEILKEADGIILSRGDLGIDLPPENVFMFQKTAIHKCNLEGKPVIVTRVVDSMIDNLRPTRAEATDVANAVLDGTDGILLGAETLRGLYPVDAVSTVGRICAEAETVYNQPLQFKKVMWHVGDPMPHEESVASAAVGSAIKVKAAAIVVFTFSGRAARLISKYRPTMPVLAVIFPREGSDPSKWRSYGTTQARQCFAVRGVYPLMGSTDEAETGGLTKEEYGIKLALNYGRSVGIVKPFDRVIIFEKIGDSSVVKIIECEG

SEQ ID NO: 29670 - DNA, 686 bp, Panicum virgatum
  misc_feature: Ceres CLONE 1892846-R
  misc_feature: Encodes the peptide sequence at SEQ ID NO. 29671
ggatgagaacacacttggtccctacacgtttgacggagtgaataagccccgtgacctgtacgagaagctgcgcatccctgtggacaacctgttctttgcaggagaggccacaagtgtcaagtacactggcacagtgcacggcgccttctccactggtctcgtggcagctgaggagtgcaagatgcgggttctggagcggttcagggagctggacatgctggagatgtgccaccctgccatgggcgaggacagccctgtctctgtcccactgctcatctctcggctctaagcggatctgcagttgtttatggtattagcacctgcgagaatgtcggacatcccactgattgctcaagggaggcagtacaaggagaaagaatctcctcttgcttctcctctgcatgaggcatgtgttgacatcacttgtgcggtgtgctgtattaatcttatctgtttgggaacccttatgtatattggggtctgtgtttgatcaagttacacgagctatcggggccatctttatagaagctgccttatgtatgatgaacactgtgatacacatgtgtttggagtgaagtggttgattggctgatatctctctgccacccattgctggctctgagatcagatgatatgtttgaacttgccatttttgttgtacattggattgctaaagcttatttgtc

SEQ ID NO: 29671 - protein, 95 aa, Panicum virgatum
  misc_feature: Ceres CLONE 1892846-R
  misc_feature: SWISSPROT Homolog: EC 1.5.3.11 Polyamine oxidase
DENTLGPYTFDGVNKPRDLYEKLRIPVDNLFFAGEATSVKYTGTVHGAFSTGLVAAEECKMRVLERFRELDMLEMCHPAMGEDSPVSVPLLISRL

SEQ ID NO: 29672 - DNA, 674 bp, Panicum virgatum
  misc_feature: Ceres CLONE 1892846
aattcctcctcctccggtcctccccccctgctgctgctcatcaacaccgggggcgagttgagggagaagaagagcacaagcaagcaaccgccggcgcagcagcagaggcacccctcggccctcgctcccatgccgcttccgctttccctttcccctgcagccggccgcttccttccagccctgcccggcgtcttcctcgccgacccctgttgctgccgctgcaaggacgcatcgaggagatgcagataggagcaggtgcaggttgtaacggaaaggatagtgaaggaggagatcacaaggtggcattgaggcagaagaaattgaaggaaaagtcgttcaagtggagatcaaccaatagcgacatgaacaaggtagaggcaggggagtctgatgaagtatacgatgatacagtcctctgctctctatctacagcaagcttcagcagcttggttagtcggaaaagagtgaggaaccttggaaaggtggctgagcattgtgatgctgtcgatcctccagttccaagaaagttaagatcagccataaagaagcgagtcggtcgatttgtttctgcatcatctcggcatgtcaaaaagagacgtaatctttcggctgtcagtgctcaaatttcttttgtggaccagaaaacaagattcaatggaagctcgttatttaca

SEQ ID NO: 29673 - DNA, 1064 bp, Panicum virgatum
  misc_feature: Ceres CLONE 1892853
  misc_feature: Encodes the peptide sequence at SEQ ID NO. 29674
aaaagaggctgcccactgctcgcatactatctcgcgcgcaccaccaccaccaccaccaccgtctccggcgacgaccacgccgccggccatgccgtcctcctacgccgccgccgcagccggatcctcttcccgcaagacgaaccgcacctccaccgccgccgcagccactgcccgcccaccagcaccctcgccgtcgccggcacccgcgcccccggcggcgaaccctagcgcggcctctgactccgatccctcctcctactcctcctcctccggggatgaggccgatctcacggcctccgactcggcgaccgcctccgtagtctccgcctacctctcggttgccggcgagggggccgacctctcgaaggtcggcattttcctctcctccgccgcgcgccgccgatcgccgccgtgcctgatctgcttcgaccccatccgcccctccgatccagtctggtcatgctcctcatcctgctttgccatcctccacctcccctgcatccagtcatgggcccaccagtcagcctccggcgcagccgtgccgtgcccaacctggggctgccccaagtgccgcttcgcctaccccaaatcgcagactccgacctcctacctctgcttctgctccaagacagtagacccgactccggacccctggatcctcccccactcctgcggcgacgtgtgcggccgccgcctcaatgcaaatctcgactcaggatgcgagcacacctgcctactgctgtgccacccggggccgtgtccaccatgccctgctgttgtccctaatgcgccctgcttttgtggggcgcaccgggagcctcgacgctgcgcacatcagcgttactcttgtgcagggaaatgtaacaaacgccttagctgtggactccaccggtgtccagtgaattgccatgacgggccctgcccgccgtgtgcagtgaggggaaaacacaaatgtgaatgtggagagacaatggaggagaaattatgctctgaaagtgttttccagtgcaagagggagtgtggtgggatgttagattgtgggaagcataggtgtgagagggggt

SEQ ID NO: 29674 - protein, 325 aa, Panicum virgatum
  misc_feature: Ceres CLONE 1892853
  misc_feature (264)..(283): Pfam Name: zf-NF-X1 Pfam Description: NF-X1 type zinc finger
MPSSYAAAAAGSSSRKTNRTSTAAAATARPPAPSPSPAPAPPAANPSAASDSDPSSYSSSSGDEADLTASDSATASVVSAYLSVAGEGADLSKVGIFLSSAARRRSPPCLICFDPIRPSDPVWSCSSSCFAILHLPCIQSWAHQSASGAAVPCPTWGCPKCRFAYPKSQTPTSYLCFCSKTVDPTPDPWILPHSCGDVCGRRLNANLDSGCEHTCLLLCHPGPCPPCPAVVPNAPCFCGAHREPRRCAHQRYSCAGKCNKRLSCGLHRCPVNCHDGPCPPCAVRGKHKCECGETMEEKLCSESVFQCKRECGGMLDCGKHRCERG

SEQ ID NO: 29675 - DNA, 630 bp, Panicum virgatum
  misc_feature: Ceres CLONE 1892853-R
  misc_feature: Encodes the peptide sequence at SEQ ID NO. 29676
gaagttggagtgcgatgcggaggctgccacatgcgggtctacttgcgagaaagtgcttggttgtggacggcacaggtgccctgagcggtgccatcgtggtccttgtgatgagacttgccggcttgtgatcacaaagtcctgccgttgtgggggtctgaagaaggaggtgccgtgctaccaagaattgacgtgtgaaaggaaatgtcaacgcttgcgaaactgtggacgccatgcttgtaaacgacgttgctgtgctggcgattgtccaccctgctctgagacttgtgataggaagctcagatgtgggaaccataaatgcctttcaccatgccacagaggtgcttgttctccttgtcctctgatgaagactatttcttgcgcctgtgggaaaacatgctttgaggttccttgtgggactgaaaaaaatcagaaaccacccaaatgctcaaagaaatgcaatatacctcgcctttgcaggcacaagcttgaatgccggccccacaaatgccactatggagcctgcccaccttgcaagctgacctgtggagaagaactttcctgtggccacacatgtaaagaaaggtgtcatggccctatttctcctccaaaccccgagttcacactaaaacc

SEQ ID NO: 29676 - protein, 209 aa, Panicum virgatum
  misc_feature: Ceres CLONE 1892853-R
  misc_feature (101)..(120): Pfam Name: zf-NF-X1 Pfam Description: NF-X1 type zinc finger
  misc_feature (21)..(41): Pfam Name: zf-NF-X1 Pfam Description: NF-X1 type zinc finger
  misc_feature (74)..(93): Pfam Name: zf-NF-X1 Pfam Description: NF-X1 type zinc finger
KLECDAEAATCGSTCEKVLGCGRHRCPERCHRGPCDETCRLVITKSCRCGGLKKEVPCYQELTCERKCQRLRNCGRHACKRRCCAGDCPPCSETCDRKLRCGNHKCLSPCHRGACSPCPLMKTISCACGKTCFEVPCGTEKNQKPPKCSKKCNIPRLCRHKLECRPHKCHYGACPPCKLTCGEELSCGHTCKERCHGPISPPNPEFTLK

SEQ ID NO: 29677 - DNA, 771 bp, Panicum virgatum
  misc_feature: Ceres CLONE 1892855-R
  misc_feature: Encodes the peptide sequence at SEQ ID NO. 29678
accactgccactagcaagcagactctcttattgcatgctgatggaaagaagcatagggcaaaagcaaaagccttccatgcttcccagaagcaagcaaatggagctgaacaaactgcagatgtcaaggaaactggggctgtgcctacaatagaatctgctcaagcaaatggtggtgataacagtggtgatcatgaaagagatgaagaaaaggatggtggcaaaagaaagagattggatgacatggccatagaggagccagataacacaaaaaggcagcatttaacaagttcgaacattggagaggtgatacaatctaaagatgggaagtcagaaaacaaaacaaagagcactgcaggtggtgctgactgtataagtgttcataaacaaaagatcaagtggaagaaggttattactaaggcactgaagacgaacccagatggagttatgaagcttaagaagctacaaaagctagttgtcaaggagctgcaggaatgtggtgtgactgaagacaaggaggggctccgtgctaccttgatggataaaatagcttcaagctccagattttctgttgatggcaagcgtgttagattggtggcgaagaatgaagaggaatcctagatactggttgttagtcgatttttggcattgttgttgcgtatgattctttggcgtctactcctgatggcttgtagccaagttttggttaaattgaatgtaatgcatggattgttgatgaaatcggagaattttctggcattattggatcttggc

SEQ ID NO: 29678 - protein, 205 aa, Panicum virgatum
  misc_feature: Ceres CLONE 1892855-R
  misc_feature: Functional homolog of the protein sequence given in SEQ ID NO 51317
  misc_feature: Useful for making plants with altered alkaloid content
TTATSKQTLLLHADGKKHRAKAKAFHASQKQANGAEQTADVKETGAVPTIESAQANGGDNSGDHERDEEKDGGKRKRLDDMAIEEPDNTKRQHLTSSNIGEVIQSKDGKSENKTKSTAGGADCISVHKQKIKWKKVITKALKTNPDGVMKLKKLQKLVVKELQECGVTEDKEGLRATLMDKIASSSRFSVDGKRVRLVAKNEEES

SEQ ID NO: 29679 - DNA, 1390 bp, Panicum virgatum
  misc_feature: Ceres CLONE 1892855
aaaaaagcccaagccccgacgccgccacccggcctctccaccatccgccgctcgcctcctcttcctcctcctcccgccgcctcctctcaccctccgcgccgctccaccctctgccactccccgtctcctccccgctacatgggagcgcgggctccctaggttgttcccgccgccgccatgttcgagggggtggtgagccaggtgctcgccggcctcctcggccgctacgtcaagggcatccagaaggagcagcttaagatcggcatctggaacgaggaaatactgctggaaaatgtagagctgattctggaagcctttgactacctgcagctgccattctcactgaagagcggacgaattgggaagctaagcatcaggattccatggaaaaagcttggatgggatcctattattattgtcatagaagatgtctttgtttgtgcatgcccgcgggaggattcggagtggagctccgattctctggataagagagactagctggaaagttggctaaacttaatgacattgagcttgctaaattttccagaagagttacagataaccaaacggggcagtcatttttgtcatatatatcagcaaagatactggacaatatccaagtttcaatgcaaaattttcatattgtatacatggatacccacaacaatcaagggaacttcgtattcggtgtggaattctccagtctctcaatacaaacagatactcagaagcaaagttttaccatgtcattgatgcggtcaagacaggatgaagtaaataagataatagagatatcagatgttggaatttactgtcatcagttagaagaacagcaggacccatgcaatgttggtgcttttggaaatggccattcaagggatgattatcttgtacatccattttctgttactatatctgtgcttgctaacaaagccgcaaagcttgacggtgcccctcagtatgatatgactgtagagctttctgcattggccctatcggttgatgaaatccagctcaagcaaatcttaagtctttgtgattacttcactatctgtgcgttgcgaacaaaatatggtcgttaccgtccatctcaaagctctttatctaagagaagtaaaggttggcagagaatgtggtggcagtatgctcagaattccatattagcagacgttcacagaagactgaagaaaacttcatggcgttatttgaagcagcgactaaattatcgcataggatatgtcaaattgtaccaaatgaaattggagcttctgcagaaaggacagattgttggtacagacattctacaagagctggaaaatatggacaaagaatgtgatatagatgacatacttaactacagaacaattgcagagcaacaactgcaagaaat

SEQ ID NO: 29680 - DNA, 1852 bp, Panicum virgatum
  misc_feature: Ceres CLONE 1892859
  misc_feature: Encodes the peptide sequence at SEQ ID NO. 29681
cgttcttcgcgctctctctacagtatttcgtttctgcttatccccattccactgcgtactccgccagtttctgctgttccttcctactcccaagtcctctcgacgaggcaacgaaagaagctgatcctctccctatcctctcgacgaggagtcactagtcactagtcagtcaccgctcctttttcacggagctcgaaaaccgttaccccggcgtgggccgcggctgctgcctctgcgccggtacgaactcggcaggggaggggacggggcgcggctttactgctgcctctgctttcagcaactcgtagctgctgctgcatttctgctcctctctttaaagagcccgtctttactgtggccactcctctcctccctcttcctcttccttccttccctccgcgcccgcctctgccttccgtccctttgctctttattcccctgccgatccccggcgcaggaggggatcccggccggccggcctctccgatcgctctgtggcttcctttcctgcctggggtcagggctgcaggccttgcgttctgttgggtttctggtttcacccttgtgccatccatcctaattcctaaagccacaggggtttaacgaccggccgcggcgagctctccgtgctgctgcctgcgtgccatgtcgcggtcgcgcacggtgcggatcttctgggacgaccccgacctgacggactcctccggcgaggaggaagggtgcggcagccggagggtcggcaggatggtccgggagctgccgcccatggccttagcagcggctcccgctgcccccgcgccggagcagtgcgccgccggggatggcgaccgcgggaagaggctcggcggcggcggctctggcgcgcgtaggcggctggccaagggcggccccggcgcgacgagcaccaagttccgcggcgtccggaggcggccgtggggtaagttcgcggcggagatccgggacccgtggcgcggcgtgcgcgtgtggctcggcaccttcgacaccgccgaggaggccgcgcgcgtctacgacaccgccgccatccagctccgcgggcccaacgccaccaccaacttcgccgccgcccagtccggctccggggccggccaggaccaggacgcggacccggacccggcgacccccgggtacgagtccggcgccgagtcctcgcccgcggcgtcgtccccgacgtccgtgctccgcaaggtgccgtccctgtcctccctcgcggaggactccttcaaggacgactccgacgccgccccgtgcgagccggccgccggcgagcgctgcggcctggccgtcctgggggaggaggcgctcggcgagttcgtgcccttcgaggacgcgccggtctacgccaccagcgggttctgggacatccggcccgacgcggggttcctctacgcggagccgtcgtggaacgcctccgcctactaccccgcctcgtccggcgaggcgcccggctgggccgcggcgtcgccgacggcgcaggagaacgactacttcgaggacctgcgcgacctcttcccactccacccgcttcccgcgattttctgaaacgttcttcgtctacacgggctgcttcgtttttggacgtcgagagttgtggtgtgcctgcctgcctgcgcgcaccggtcgtggtctagtactagtagtactttgtacgccttttgccgtgccgtgtttttgtcgtgtcgatgagtgagaaagtgtaccatgccgccgccgatgagtacgtactgtgtagtagagagttttgaggtgcgggtacgagtctgttgtctactcgcttgtgtatggagagatgaatgtggtaaagtgtttttgctgtgccgtcagatttgtacgc

SEQ ID NO: 29681 - protein, 304 aa, Panicum virgatum
  misc_feature: Ceres CLONE 1892859
  misc_feature (87)..(138): Pfam Name: AP2 Pfam Description: AP2 domain
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: Functional homolog of the protein sequence given in SEQ ID NO 50249
  misc_feature: Useful for making plants with altered lignin content
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Functional homolog of the protein sequence given in SEQ ID NO 50227
  misc_feature: Useful for biocontainment applications
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: Functional homolog of the protein sequence given in SEQ ID NO 51051
  misc_feature: Useful for making plants with altered alkaloid content
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MSRSRTVRIFWDDPDLTDSSGEEEGCGSRRVGRMVRELPPMALAAAPAAPAPEQCAAGDGDRGKRLGGGGSGARRRLAKGGPGATSTKFRGVRRRPWGKFAAEIRDPWRGVRVWLGTFDTAEEAARVYDTAAIQLRGPNATTNFAAAQSGSGAGQDQDADPDPATPGYESGAESSPAASSPTSVLRKVPSLSSLAEDSFKDDSDAAPCEPAAGERCGLAVLGEEALGEFVPFEDAPVYATSGFWDIRPDAGFLYAEPSWNASAYYPASSGEAPGWAAASPTAQENDYFEDLRDLFPLHPLPAIF

SEQ ID NO: 29682 - DNA, 2146 bp, Panicum virgatum
  misc_feature: Ceres CLONE 1892862
  misc_feature: Encodes the peptide sequence at SEQ ID NO. 29683
ctgcaacctctcctttccctcctcccccaatccgcccctcgcgcctcgcaatccggagcggcggcggcggcggcggctggggcgaggcacgaatcccggccttcgcttccgcgtcccggcgggcctgcagaaattgttaggcaagcgtatgtgcgtgcaaacttttctgtatgcatataagagagcagtcattcctgcagtaaatggcacttcgagtcttgagtgttaaatagggtgccttgcctagtggaaagtggttggattctattatataatctgagactccacctgaccgatatggcctccaatggtaatggaaatctgaaagctgacactcgacaagtcgaaccaacagcttcggatgatgttcctggggcaacaagcctgaacacccttgctactcaaggtgtttcacaacggagaaagcggtggagtggatttaggaacttctggaatagcctttcgagtggccccagattaaagaagcttggcccctccccttcgttcaggtttcaacagctcgcgcttcaacgtgatgagttctcacgttccgtccattctgataaccatggtagtcatgatcatttccaatttctcaggaagattaattggggccatctttggatgatggccaaggattggataaaggagcctatgaacatggcccttttcgtttggattgcttgtgttgctgtgtcgggagcaattctcttccttgttatgagtggaatgctaaatcatgctttgccaaaaaaatcgcaaagagacacctggtttgaagtgaacaaccaaattctgaatgcattgttcacactcatgtgtctgtatcagcacccacaacggatctacaactttgtgcttctgtgtcgatgggagcaacaggacattctaaggcttaggaagatatattgcaaaaatggagcatataagcctaatgagtggatgcacatgatggttgttgtaatccttcttaatttgaattgctttgctcagtatgccctttgcggtctaaacctgggataccgcagatctgaacggcctcctattggtgttggcttgactatatctgttgcaattggggctgcagcattcgctggcctttataatatcatcagcccacttgggaaggattatgacacagaacaggcggacattgatcaagaagcacaaattgaagtcacctcaactgagagcggcaggccaacttcacgatttatgtcatttgagaggagatactctttcatccatactgaagaacgtcgtttcgtggagagtaggcctgagtgggttggcgggatactggatttctgggaccagatatctcttgcatatttgtcacttttctgcagctgctgtgtctttggctggaacatgcagaggcttggctttggcaacatgtatgtccatatcgcgacgtttctgctcttttgcctagcaccattttttatcttcaccctggcagctggcaacattaacaacccctcccttcaatcggcattggggctcactggtcttttcctatgcttcttcggtttactgtatggtggcttttggagaatacaaatgaggaagagattcaacctgcccgaaaataccttctgctgccgcaatcctgatgccacagattgtttccagtggttgttctgctgctcatgttcccttgcccaggaggtcagaaccgctgatcactacgatattacagaggacaggtcacacagagggcaagtgacagaggaaagtccgcgcataatgtccccgttgcgacgtgaagatggttcgcccttgttcaggtcccatccgagttcgccttacaggagtggcaatgctagtccgtcgatcttcatcctggagagcccatcagctccacgcaggtcatctggctccacacctcagggtggttcaccaacaagcgatagggcgatgaaggcaccaaccccatccgttctccacagagatgctggaccgcgtcatgacatgggggcatccaatgaaggagctaccagcccaatgagatgatacatgtatatctttttgtaaaaaaatactatatcttgtgtgtatgaaattttctgtgcggttactgtttcatacaaaatgtatagagtatccatttattctcctatcttaagtgctgttatatctcagc

SEQ ID NO: 29683 - protein, 572 aa, Panicum virgatum
  misc_feature: Ceres CLONE 1892862
  misc_feature (330)..(462): Pfam Name: PLAC8 Pfam Description: PLAC8 family
MASNGNGNLKADTRQVEPTASDDVPGATSLNTLATQGVSQRRKRWSGFRNFWNSLSSGPRLKKLGPSPSFRFQQLALQRDEFSRSVHSDNHGSHDHFQFLRKINWGHLWMMAKDWIKEPMNMALFVWIACVAVSGAILFLVMSGMLNHALPKKSQRDTWFEVNNQILNALFTLMCLYQHPQRIYNFVLLCRWEQQDILRLRKIYCKNGAYKPNEWMHMMVVVILLNLNCFAQYALCGLNLGYRRSERPPIGVGLTISVAIGAAAFAGLYNIISPLGKDYDTEQADIDQEAQIEVTSTESGRPTSRFMSFERRYSFIHTEERRFVESRPEWVGGILDFWDQISLAYLSLFCSCCVFGWNMQRLGFGNMYVHIATFLLFCLAPFFIFTLAAGNINNPSLQSALGLTGLFLCFFGLLYGGFWRIQMRKRFNLPENTFCCRNPDATDCFQWLFCCSCSLAQEVRTADHYDITEDRSHRGQVTEESPRIMSPLRREDGSPLFRSHPSSPYRSGNASPSIFILESPSAPRRSSGSTPQGGSPTSDRAMKAPTPSVLHRDAGPRHDMGASNEGATSPMR

SEQ ID NO: 29684 - DNA, 609 bp, Panicum virgatum
  misc_feature: Ceres CLONE 1892870-R
  misc_feature: Encodes the peptide sequence at SEQ ID NO. 29685
ctgggattggtttaggagctctcctttcaggtgctcggcacatttcagatgacatgcttcaagcaggagctgagtgcctggcatcatacatcacagatgatgaaattcaaaaaggaatcctcttccctgaagtctccagtataaggcacatcaccgcacgtgtcggcgcagcagttgtccgtgccgccgttgctgaagacctagctgaggggtgccgcactgtgggtcctaaggagcttgggagcatgtcagagtcgcaaacggtggagtacgtcgctcggaatatgtggtaccctatttacagcccccttgtgaacaacaaataaatcgggaaaatcacacgggctgcacggaagcagatgcccatgacattccatccgaaggaatgtatcagacctaggcatttgttttggctacttgtttaggcttcttgttatcactaaagaatgctcaattttgagatccgttgatcttcatactgccacagtaagtgtacttatcatgattattgtaataagcatcagacactggagcttctagttctttccatcctgaaaataaatgtcatgaaatcagaggcaaaatgaattttatctgcaagatgttcgc

SEQ ID NO: 29685 - protein, 107 aa, Panicum virgatum
  misc_feature: Ceres CLONE 1892870-R
  misc_feature: SWISSPROT Homolog: EC 1.1.1.39 Malate dehydrogenase (decarboxylating)
GIGLGALLSGARHISDDMLQAGAECLASYITDDEIQKGILFPEVSSIRHITARVGAAVVRAAVAEDLAEGCRTVGPKELGSMSESQTVEYVARNMWYPIYSPLVNNK

SEQ ID NO: 29686 - DNA, 558 bp, Panicum virgatum
  misc_feature: Ceres CLONE 1892870
cagcgcacgcggagatccgccaccaccggctggttgttgcgggactgggagcgttggggctaccatggcggagacggcgatcacgacggtgctcgccaaggtgtcggagctggtggcgtgggaggcggcggtgctgctcgaggtgggcgacgacgtgcgcctcctccgcgacaagctcgagtggctccataccttcatccgcgacgccgaccgcaggcgccgcctccgcgacgacgagttcgtcgccgtctgggtgcgccagacccgggacgtcgccttcgaggccgaggacgcgctcgacgacttcctccaccgcgccggccggagggggagggccgcccggaaccgcgccgcaccgggatgcgccgccggctggtggcccgggtgcgccggcgaggtcgcgctccggcatgacctctacggccgcatccgccagatcaagaagcgcctcgacgagatctccgccaaccgcgccgcctacaacatcgagcacacccccgcgccggcctgggccacctcctgctcctccgccaccacgctcgccgcctgggacgacct

SEQ ID NO: 29687 - DNA, 587 bp, Panicum virgatum
  misc_feature: Ceres CLONE 1892905-R
  misc_feature: Encodes the peptide sequence at SEQ ID NO. 29688
tcaacgacatcatccactctatcatcaacatggatgctgatgtgatcaccattgagaactcacggtccgacgagaagctcctttccgtcttccgcgagggtgtgaagtacggtgcaggcattggccctggtgtctacgacatccactcccctaggatcccgtccaccgaggagattgccgaccgcatcaacaagatgcttgcggtgctcgacaccaacatcctttgggtgaaccctgactgcggtctcaagacccgcaagtacaccgaggtcaagcctgccctgaccaacatggtctccgccgccaagctcatccgcacccagctcgccagcaccaagtgagaactctccctgcagcggctttttcattcaattacaaggagggtgttcatcaaagccatttgtcttgaataatctgggtctcgtgaatccgctccatctgtggttagcttagttcttttttttcttggcacgatgatcacacactgcttatacctctgctactcttacgaatttggtggttttgaggcaagttgcccgtgtacttgtattgtaaacccggttggacatctgcagtgtttcatctgc

SEQ ID NO: 29688 - protein, 112 aa, Panicum virgatum
  misc_feature: Ceres CLONE 1892905-R
  misc_feature (1)..(103): Pfam Name: Meth_synt_2 Pfam Description: Cobalamin-independent synthase, Catalytic domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
NDIIHSIINMDADVITIENSRSDEKLLSVFREGVKYGAGIGPGVYDIHSPRIPSTEEIADRINKMLAVLDTNILWVNPDCGLKTRKYTEVKPALTNMVSAAKLIRTQLASTK

SEQ ID NO: 29689 - DNA, 645 bp, Panicum virgatum
  misc_feature: Ceres CLONE 1892905
gcataaccttccaccgaccgccgcacgcgcgttccgccgccggtgctgggccgcggcggcgccgatctgcccgacgactttgccgtgccgacgcaccactgcagcatctaccgtcgcggcgcccatggtgcgccgtcgatcctaaccgcattacaaggggaccttgggggtacctgacctcatcgatgccgccttcgagctccgtaatggaggcaggaattcttctctaaggacgggtaatctttgtcaataaatcgcaggaacagcagcagctttcttcaatcgcgagatataatgcagcagacacaatcactgaagcaactaaaatcatggctactgatgatgttgctgaacaaacacaatgaagaaaatcagaatgcttgccttgtttctgagcgaaatccacaaggcctccctccaatttcgcagtcttggcaaacatttgttatgttgggaactgaccacctgaacatcgtcttaccaaatgcaatggttacttttgcagtttcattaaagagcacctctctctcattcttaagaatgtaaggtatccaaatatctttggaaaccaccatgcaatccaatggaaggacatccatgggttgaaaagaagacaccaaatacggaaattcgcttgtgttgcta

SEQ ID NO: 29690 - DNA, 2308 bp, Panicum virgatum
  misc_feature: Ceres CLONE 1892906
  misc_feature: Encodes the peptide sequence at SEQ ID NO. 29691
cctgtgtgctcacccaagctcactccctcggtccctccccccacagactcaacaacaacgaggcatttgattgttccgttccgtcgcgtcaccacccgccaactcaccctcctctgctcctgttccattccactaatcgagcggtccctgatggcggtgatgacggacacgcccgcggcgacggcgctgcgcgcgccggccccggccgccgccgccgtgcccagcgacaaggacgccgagaagctgcggttcatcgaggagatgacctccaacgtggacgccgtgcaggagcgcgtcctggccgagatcctcgccaggaacgccgggaccgagtacctggcgcgctgcgggctcgccggcgccaccgaccgcgccgcgttccgcgcccgggtgcccgtcgtcacctacgaggacctgcagccggacatccagcgcatcgccaacggcgaccgctcgcccatcctctccgcgcaccccatctccgagttcctcaccagctccggcacctcggccggcgagcgcaagctgatgcccaccatcagggaggagctcgaccggcgccagctgctctacagcctcctcatgccggtcatgaaccagtacgtgcccggcctcgacaagggcaaggcgctctacttcctgttcgtcaagtcggagacgacgacgcccggcgggctggcggcgcggcccgtgctgacgagctactacaagagcgagcacttcaggaaccgcccctacgacccgtaccacgactacacgagccccacggcggccatcctctgcgccgacgcgttccagagcatgtacgcgcagatggtctgcggcctctgccagcgccacgccgtgctccgcgtcggcgccgtgttcgcgtcaggcctcctccgcgccatccgcttcctgcagctccactgggagcagctcgccgcggacatcgaggccggcgcgctgaccccgcgcgtggccgacccggccgtccgcgacgccgtggcgggcatcctccgcccggacccggagctggcccggttcctccgcgccgagtgctcccgcggcgactgggcgggcatcgtcacccgcgtgtggcccaacaccaggtacctggacgtgatcgtcaccggcgcgatgcagcagtacatccccaccctcgagtactacagcggcggcctgccaatggcgtgcaccatgtacgcctcctccgagtgctacttcgggctcaacctccggcccatgtgccacccgtcggaggtgcgctacaccatcatgcccaacatgggctacttcgagttcctccccgtggacgaggccagcggcgtggcgccgggcggcgcggcgcagctggtggacctggccaaagtggaggccggccgcgagtacgagctggtcatcaccacctacgcggggctctaccgctaccgcgtcggcgacatcctccgcgtggcgggcttccacaacgcggcgccgcagttccagttcgtccgccgcaagaacgtgctgctctccatcgagtccgacaagacggacgaggcggagctgcagcgcgccgtggaccgcgcgtcggcgcacctccgcgcgcgctgcggcggcggcgcggcggtggtggagtacacgagccacgcgtgcacgcgcagcatcccgggccactacgtcgtgtattgggagctgctggccaccgccgacgccgacgccgggccggcggcggtggacggggagacgctggagcggtgctgcctggagatggaggaggcgctcaactcggtgtaccggcagagccgcgtggcggacggcgccatcgggccgctggagatccgggtggtgcggccgggcacgttcgaggagctcatggactacgccatctcccggggggcctccatcaaccagtacaaggtgccccgctgcgtgtccttcccgcccatcgtcgagctgctcgactcccgggtcgtgtcgcgccacttcagccccgcgccgccgcactgggagccggcgccgccgcgccgctccgactagcggccccaccgcggtgcacgcagcgcgtcacgttcgccgtagtactagctagtatatttattagtggcttgtttttgcattttttttcttggtcgtgtcgggccaggtagtgattttcagctcctgctgattaggccacagtatcgtgcttctgagttagaggtgtgtgtgtttgggtagtaagtagtgtacgtgccatgtaatgcgggtgggtgaagaaggctttccctgcaggtaggggctagctagctcgatcattagctagctagctgctgccgggtgctgttaattgctagtggtgcttatt

SEQ ID NO: 29691 - protein, 616 aa, Panicum virgatum
  misc_feature: Ceres CLONE 1892906
  misc_feature (30)..(590): Pfam Name: GH3 Pfam Description: GH3 auxin-responsive promoter
MAVMTDTPAATALRAPAPAAAAVPSDKDAEKLRFIEEMTSNVDAVQERVLAEILARNAGTEYLARCGLAGATDRAAFRARVPVVTYEDLQPDIQRIANGDRSPILSAHPISEFLTSSGTSAGERKLMPTIREELDRRQLLYSLLMPVMNQYVPGLDKGKALYFLFVKSETTTPGGLAARPVLTSYYKSEHFRNRPYDPYHDYTSPTAAILCADAFQSMYAQMVCGLCQRHAVLRVGAVFASGLLRAIRFLQLHWEQLAADIEAGALTPRVADPAVRDAVAGILRPDPELARFLRAECSRGDWAGIVTRVWPNTRYLDVIVTGAMQQYIPTLEYYSGGLPMACTMYASSECYFGLNLRPMCHPSEVRYTIMPNMGYFEFLPVDEASGVAPGGAAQLVDLAKVEAGREYELVITTYAGLYRYRVGDILRVAGFHNAAPQFQFVRRKNVLLSIESDKTDEAELQRAVDRASAHLRARCGGGAAVVEYTSHACTRSIPGHYVVYWELLATADADAGPAAVDGETLERCCLEMEEALNSVYRQSRVADGAIGPLEIRVVRPGTFEELMDYAISRGASINQYKVPRCVSFPPIVELLDSRVVSRHFSPAPPHWEPAPPRRSD

SEQ ID NO: 29692 - DNA, 2475 bp, Panicum virgatum
  misc_feature: Ceres CLONE 1892918
  misc_feature: Encodes the peptide sequence at SEQ ID NO. 29693
acaccacaccaccgcggcggcggcggcggcgccagcttccacactgcctccccttgcttccttcccccgcgccgccacaacccaaaccctaaaccatggcggacgccgtccagtaccgcctcgagcggatgaccgacgagctcgacgacctcgagcgccggggcctcttcaaccgcgccgagctcgccgacgtcgtccgacgccgccgcgacttcgagttccgactccgccgacgctccccgctccgacaggacttcctcgactacatcgcctacgagctccgcctcgactcgctacgcaacctccgaaagcgcgcaatcatacgcgacgccccctctgaatccgacgacgaccatggcagcgccgacgaggaaggcacgaagaagaagaggaagaggaggaacaagaagtggaagaggtccatctccgacgtcgcgggggtcctccgcatactcgacatctacaggatggccaccgtcaggttcaagggagacctcgacctatggttccgatacctcgagttctgccgcggcaagcgccacgggagaatgaagcaggttctggcgcaagctattcgcttccatcccaaggtccctgggctttggatctatgcggcagcgtgggaattcgaccagaacctcaatgtcgctgcagcacgtgcactgatgcagagtggcctcaggtcctgtccacaatcagaggatatgtggattgagtatcttcgcatggagcttacctacctgaacaagctcaaggcgcgaaaggtggctctcggagaggatgtgaagacgctgcaaaagagcgataatgatgctggcaagtggaaagacgagaacaaagaacttttcatgccactgaatgaacaagatgatgggcccgaggactccaagcgagctggagatgctctggaggagaaggaagacatgttctggcggcaaggactgttaatcatccaaaccatatatcatggtgtggtggaagctcttccatcaagcttaaccttgcggaagaaattcttggagatattaaacagtgtggacttggcacattctgatgagttgaagatagaggtcctggatgacgtcaagaaagatttctcccattgtgaggactactgggattggtttgctaggcttcagcttacttatttaaataatcccaacggcttgaagggaaaggatgctctatcgaataagttgaacaaatcaattcaggtatatgatgaagctgtcagaaggctgccaacttccaaaatgtattccctttatgcaaaattttggatggatgttctataccctgacacagaagattccattgcatcattccaaaattctgaatttgattcttcggaattcacttcatctatactgaaagtttatgaaagtgctgaatcatgtgggtgtcttactgaggatcttgcttgccaatatgtatcattttgtttgaaactcgaaagactggaggaagctaagaatctcgcagaaaagctttgcaacggtcctctttcagatgctgcaaatttgtggagcctgagagcttctatggagataaattcggttgctactgcaggcagtactccgttcagcaaggagaaattgagttgtttatttgatctattcaacactgttctttccaaattacccgttactcagactgagggattgtggcacatggccatgaaactgttttctaatgagaagatatattttgagaagttggtgaaatgtgcaatgctttcgttaagtttggctggtgggaatgattcgggcgcatcggttgcttctgctatcatcggatggtatttgcaaagagatggtatgaaacaagctaggaagatgtataagaggcttctcgctctaccacgtccgagcctaaagttgttcaagtactgcatagagctggaaactaacctcgcatcgctaggagacaatagtgcccttgcaaatgcccgtaagctttatgattcagcaatcgactactatccccaggaaagagaagtgtggagaaactactacaacctggaattgaaggtgggaacatcggaaaccgccaatgctgtttacaggcgtgtgctcgtaaggtgctcagtgactccactgccctgaccactcccagtagctagcagcatgcggcctgtgttaacttgtaataccatttttgattggatttgtttgttccctgtgagcatatttgggtcagcaattaagctgatgcaacaaaattttggcttgtctctgattgctgtatttgggttccaccgtggtcctgaaaatcggtggatgaaaacgtgtacgattgccagatgtagttgtttggatgcctatgcccataagaaaggcacattagctgtcctgaaaatcttggctcgtctctgattgctgggtttgtttatgcgtggaactgagctgttttagcctgtgcaaggaggcatacacaatgtacactaagacattgaaggggccatttgtttcgatc

SEQ ID NO: 29693 - protein, 669 aa, Panicum virgatum
  misc_feature: Ceres CLONE 1892918
  misc_feature (9)..(91): Pfam Name: U3_assoc_6 Pfam Description: U3 small nucleolar RNA-associated protein 6
MADAVQYRLERMTDELDDLERRGLFNRAELADVVRRRRDFEFRLRRRSPLRQDFLDYIAYELRLDSLRNLRKRAIIRDAPSESDDDHGSADEEGTKKKRKRRNKKWKRSISDVAGVLRILDIYRMATVRFKGDLDLWFRYLEFCRGKRHGRMKQVLAQAIRFHPKVPGLWIYAAAWEFDQNLNVAAARALMQSGLRSCPQSEDMWIEYLRMELTYLNKLKARKVALGEDVKTLQKSDNDAGKWKDENKELFMPLNEQDDGPEDSKRAGDALEEKEDMFWRQGLLIIQTIYHGVVEALPSSLTLRKKFLEILNSVDLAHSDELKIEVLDDVKKDFSHCEDYWDWFARLQLTYLNNPNGLKGKDALSNKLNKSIQVYDEAVRRLPTSKMYSLYAKFWMDVLYPDTEDSIASFQNSEFDSSEFTSSILKVYESAESCGCLTEDLACQYVSFCLKLERLEEAKNLAEKLCNGPLSDAANLWSLRASMEINSVATAGSTPFSKEKLSCLFDLFNTVLSKLPVTQTEGLWHMAMKLFSNEKIYFEKLVKCAMLSLSLAGGNDSGASVASAIIGWYLQRDGMKQARKMYKRLLALPRPSLKLFKYCIELETNLASLGDNSALANARKLYDSAIDYYPQEREVWRNYYNLELKVGTSETANAVYRRVLVRCSVTPLP

SEQ ID NO: 29694 - DNA, 685 bp, Panicum virgatum
  misc_feature: Ceres CLONE 1892929-R
  misc_feature: Encodes the peptide sequence at SEQ ID NO. 29695
tggccaagtgtgacccaaaggcatgggaagtacatggctggctgcttgatgtaccgtggtgatgttgttcctaaggatgtcaatgctgcagttgcaaccatcaagaccaagagaactgtccagtttgtggactggtgccccactggattcaagtgtggcatcaactaccagccaccctctgttgtccctggaggtgacctggcaaaggtccagcgtgctgtgtgcatgatcagcaacaatacagctgtcgcggaggtgttctctcgcatcgaccacaagttcgacctgatgtacgccaagcgtgctttcgtgcactggtacgtcggtgagggtatggaggaaggcgagttctcggaggcccgtgaggacttggctgcccttgagaaggactacgaggaggtcggcgcagagggtgcggacgacgaaggcgacgagggagaagactattgagcagttggttaataagtagttcgtgggtggttaatggtttgggttgtcgagtatactctgcatggttccattccattgcgtactgctgccgtgtgtgtttccattttgttttatgtggtaaattgttcgtagcccccggttggccatgattgttcatatcgtcttgctttggtttgcaatgctattcgtccaaattcagtgtatattgcattctgttgaaagtgtattgtgctcg

SEQ ID NO: 29695 - protein, 149 aa, Panicum virgatum
  misc_feature: Ceres CLONE 1892929-R
  misc_feature (2)..(92): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
WPSVTQRHGKYMAGCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDEGDEGEDY

SEQ ID NO: 29696 - DNA, 602 bp, Panicum virgatum
  misc_feature: Ceres CLONE 1892929
acgacggccggcattccctctccctccctctccatcccagaagagaagggagcgcagcgggggcggcggccgaagcaaaaaacgacacccaacgggcggatttttaagtgctcgcacacccgccggcccccttcccttccccttccgcccgcccgcgccgcccccgcttcgccttcttttacccgtcggccaaagggaagcggcccgcgccgcgcgccgtcgttccggtcgctaggctagccgcgctgctcggcagccgggagttggggagcgcttgcttgccgggtgcccatggcggcggcgcgggcgtgcttggtggcgctggccgtggcggcggcgctattcctcgagggaactgcggcggcggggaatgccggggcggcgccgctgaagcagcggcggcggcagcttctgcggcagcggcaggtgcgcagccacctcaagcgcctcaacaaggcgccgctcgccaccatcgagagcccagacggtgacttgatagactgcgtgcacatctccaaccagcctgccttcgatcacccgttcctcaggaaccacaccatccagatgcggcctgcgtaccacccggaaggcctgtatgatga

SEQ ID NO: 29697 - DNA, 2404 bp, Panicum virgatum
  misc_feature: Ceres CLONE 1892932
  misc_feature: Encodes the peptide sequence at SEQ ID NO. 29698
atggcgcgccgccacctcgcttaccccctccacctcccgctcctctcccgcaagcccctcgcgccagcccttctcgcccaccgcgcgcgatgcagctcctccaccctcgacacccctgcccccgcccccgccgtcgaggcgccggcggaggccgcggacacctcgccggcagcggcggcgcccgccaacccgcccctccgcgaggagcccctccacgagacggtcctgcacatgatccggcgccgccagtggaccacgcgcctcgagaactccatccgcctgctctcgcccaccctcgacgcgccgctcgtccacggcgtcatctccggcgccgccgccgcgggccgcgccgacctcgcgctccagttcttccgcttcgcctaccgccgggccggcttccgcccggaccgcgacaccttcgcgctcctcgtcccggcgctcgcctcccgccgcatgctcaaccacgcgcgctgcctcgtcctcgacaccatgccctccttctccatcgcgcccgacgaggccacgctcgcctcgctcatcgccgcctacggcaaggccgccatcccgcaggaggccgtcaggctcttccggatgatgcccgacctcggcatcccccgcaccgcgctctcctacaacgccgtcctcaaggccatactctgccgcggccgcgaggccatggccaggcggatctacaacgccatgatcgccgagggtgtcgccccggacttgtccacctacaacacattgatctgggggttcggcctctgcaagaagatggagaccgccgtcagggtgtttggggacatgaagactcatggggtcgcgcctgatgcaaccacttataacaccctgctcaatgcttgggtgcgggcaggtgatctggagagtgcacgcaaggtgttcgatgaaatgactggggaggggattgaacggaactcggtctcatacaatgtcatgatcaaggggtatgttgaagccaaaaaggtggaggaggcagtggcattgttcacggagatgggcgagaagggtgtgaggttgagcgagaagacattcgctgcattgctgccaggcctttgtgatgatcaggggagggtggcggaagcccggaaggcagtggatgacatggcagagcggcggctcacgcctaaggacaagtcggtgtttctgaggctggtgacgacgctgtgcagagctggggatttggatggggcattggaggtgcaccggaagagcgggcagttcaagcatcttctcgtggatccgagacagtatggagtgttgatggaaagcctttgcgcaggcgggaagtgtgatagtgctgttgaggtgctagatgagctgatggagaagggcacactgctgagcccaaagagtcctgtgcttgaagcatcagcgtataacccggtgattgagtatctgtgcaacaatggtagcaccaccaaggccgagacattcttcaggcagctgatgaagaaaggtgtggatgacaaggctgcattcaacagtcttatccgtgggcatgcaaaagaaggtgtgcctgaggcagctcaggagattcttgccattatgacacgccgtgaggtcccaactgaccctgaatcacacacgctgctagttgatagcttcctgaagaagaatgacccagcagatgcaaagacagcattggatggcatgatgcaacagggtcacctgccgagcccagctctgttcaagtctgtcatggaggctctcttcaatgatggacgtgttcagactgcaagtagggtcatgaagagtatgatcgagaagggggttactgagaacatggacatggcgcataagatacttgaagctctcttcatgaggggacatgtggaggaggggatcggtcgtgtcaatctgatggttgaaaatggctgtatgcctgatctagataagttactggttggcctttgtgagaatgacagagtgatggaggcgcagaagctggctgatttcgcgttggacagggactttgatgttagcttctcaacctacgacagagtcctggaggccctgtacactgaggagaagacattgcctgcctactccatgctttgcaagatcaagaacaaaggaggtgttgtcaatcagaaaggttgcgatgctttgatggagagcttaaaatctgaagggtactcaaagcaagcagatattttgtctaggatcttgacagagaatgcaccatcgacttccaagaggggcaaaagggttgccatgggtgcttagcggattctgccttcttgtggaaactatccattttttttctttttgacttgaagaaagatgtggtttctttcttttcattgatgcttcttgagctatttgtcaagtgggtgttttcatcctataagacaagaagcaggtacatttactttctgtttgg

SEQ ID NO: 29698 - protein, 671 aa, Panicum virgatum
  misc_feature: Ceres CLONE 1892932
  misc_feature (237)..(271): Pfam Name: PPR Pfam Description: PPR repeat
  misc_feature (202)..(236): Pfam Name: PPR Pfam Description: PPR repeat
  misc_feature (167)..(201): Pfam Name: PPR Pfam Description: PPR repeat
MIRRRQWTTRLENSIRLLSPTLDAPLVHGVISGAAAAGRADLALQFFRFAYRRAGFRPDRDTFALLVPALASRRMLNHARCLVLDTMPSFSIAPDEATLASLIAAYGKAAIPQEAVRLFRMMPDLGIPRTALSYNAVLKAILCRGREAMARRIYNAMIAEGVAPDLSTYNTLIWGFGLCKKMETAVRVFGDMKTHGVAPDATTYNTLLNAWVRAGDLESARKVFDEMTGEGIERNSVSYNVMIKGYVEAKKVEEAVALFTEMGEKGVRLSEKTFAALLPGLCDDQGRVAEARKAVDDMAERRLTPKDKSVFLRLVTTLCRAGDLDGALEVHRKSGQFKHLLVDPRQYGVLMESLCAGGKCDSAVEVLDELMEKGTLLSPKSPVLEASAYNPVIEYLCNNGSTTKAETFFRQLMKKGVDDKAAFNSLIRGHAKEGVPEAAQEILAIMTRREVPTDPESHTLLVDSFLKKNDPADAKTALDGMMQQGHLPSPALFKSVMEALFNDGRVQTASRVMKSMIEKGVTENMDMAHKILEALFMRGHVEEGIGRVNLMVENGCMPDLDKLLVGLCENDRVMEAQKLADFALDRDFDVSFSTYDRVLEALYTEEKTLPAYSMLCKIKNKGGVVNQKGCDALMESLKSEGYSKQADILSRILTENAPSTSKRGKRVAMGA

SEQ ID NO: 29699 - DNA, 417 bp, Panicum virgatum
  misc_feature: Ceres CLONE 1892935
  misc_feature: Encodes the peptide sequence at SEQ ID NO. 29700
tccctaagtatgatatctacggcatacacgctgaggacatggcgtaccccgtcccaacctgagaccctccccctcactggagctgctgggcttttcgcctcccatgtcgcgacccacatcgtgaagaattaccctgactacaccatcctcgtcctcgacaagcgtgactactgctcgaaccagaagaagcggctccccgcgagctcattgccaaagttctagtttgtcaaggtagacatcgcatgcgccgaccttgtcaacttcatccttgtcacatacaccattgagactgtgatgcattatgaagccaagacgcatgttgacaattcctttgggaactctttcaagttcaccaagaacaatatctatggtacagatgtccttcttgaggcctgccggcagatcactggtctgatc

SEQ ID NO: 29700 - protein, 70 aa, Panicum virgatum
  misc_feature: Ceres CLONE 1892935
  misc_feature: SWISSPROT Homolog: EC 4.2.1.46 dTDP-glucose 4,6-dehydratase
  misc_feature: Functional homolog of the protein sequence given in SEQ ID NO 51125
  misc_feature: Useful for making plants with altered carbohydrate content
  misc_feature: Functional homolog of the protein sequence given in SEQ ID NO 51136
  misc_feature: Useful for making plants with altered cell wall content and/or composition
MISTAYTLRTWRTPSQPETLPLTGAAGLFASHVATHIVKNYPDYTILVLDKRDYCSNQKKRLPASSLPKF

SEQ ID NO: 29701 - DNA, 594 bp, Panicum virgatum
  misc_feature: Ceres CLONE 1892938
  misc_feature: Encodes the peptide sequence at SEQ ID NO. 29702
acacacccccttcctcctcgccatcctcccacctccgctctcccagtctccggccgcgttccagcaccagcgctgaagccgctagctagccgttgctcggctcccccgacaccaccaaggctttcccttcgatcgatcgaccagcaactagccggatgacgaagcagggcgtggtggtgccggcgcccgcggaggcggccgtcgcggtgccgcccagctcggcgccgctcctcccgtacccgccgccgcgggccgccatgcgcaagaagtgcctgcagatgggacctggcgccggcggctgggtcgagtccatgcgcgcctcctcgcccacgcacgccagggccgccgccggcgccgacgaggaccgccgcgccgcctggatggtggagcacccgtcggcgctgagcaagttcgaccaggtggtggcggcgtccaagggcaagcagatcgtcgtcttcctcgactacgacggcacgctctcgcccatcgtcaacgaccccgacgccgcctacatgtccgacacgatgcggcgggcggtgcgcagcgtcgccaagcacttccccacggcgatcgtcagcggccggtgccgcgaca

SEQ ID NO: 29702 - protein, 146 aa, Panicum virgatum
  misc_feature: Ceres CLONE 1892938
  misc_feature: SWISSPROT Homolog: EC 3.1.3.12 Trehalose-phosphatase
  misc_feature: Functional homolog of the protein sequence given in SEQ ID NO 50299
  misc_feature: Useful for making plants with modulated flowering time
  misc_feature: Useful for making plants with modulated low light sensitivity
  misc_feature: The sequence is a functional homolog of SEQ ID NO 16 in US patent 7214858
MTKQGVVVPAPAEAAVAVPPSSAPLLPYPPPRAAMRKKCLQMGPGAGGWVESMRASSPTHARAAAGADEDRRAAWMVEHPSALSKFDQVVAASKGKQIVVFLDYDGTLSPIVNDPDAAYMSDTMRRAVRSVAKHFPTAIVSGRCRD

SEQ ID NO: 29703 - DNA, 2376 bp, Panicum virgatum
  misc_feature: Ceres CLONE 1892954
  misc_feature: Encodes the peptide sequence at SEQ ID NO. 29704
agacgaccgtgcaagctaatacggagattattttcaaccccaaacctcaaacaggtcaaaccgcccggcagcatctgttgttgtacaaagcacacgcacccttcctcctcgtcgatcgccacggccaccaaccgtcagagctactcccagatcgccgccatggccgcgcacgcccggccgacgctgctcctctccgccctaacattactcctagcagcactactgcacgcggcggcggccgcgacaagctgcgcgccgagggcgtgtggcaacctgaccatcgcctacccgttctggctcccgggccaggcttcctcctcctcggcgccctgcggcccggcggcgttccaggtcgactgccgcggcgggcaggcctcgctggcgaactccttccgcggcgcctacaagatcctccgcgtctcctacggcaaccgcaccctcgtggtcgccaacgataacgtccagaccaacgccagcggctgccccgtgccgcgcatcgacgtctccgccagcctcagcctcgcgccgttcacggccagcagcgccaacgcccagctcgtcttcctcttcaactccaactgcaccgccggcgccggcgccaacggcggcgcgccgccgccggggttcgtgaacgtgacgtgcccgggtacgcgggccctggtgcggctcgacccgaggtacaacacctccgcggcgagggcggtcgccggggactgcgagtactcggtcgtgccggtgctgggttcccccggcgcgagcgcgggcgacgactaccccgagctgctgaggggcgggtaccagctggagtggcgggcgtcggccggggactgcgcggcgtgcaacgccagcggcgggcggtgcgggttcgacgccgaggccgacgcgttcgcctgcctttgctccgacgggtcgtcacgcccggcaagatgcgatgcaaacaagtccggcaagaaggtcattctgatagtatccttgtcgatcacattcggcctgctgttggcattcctcatcgtcatcctcaagttccgtcgacgaatccgcagcttcagtttacccagcatcatggacagccgacgcagcactagcgacactgcaaacgtcgagaaactcctgcagaagtacggcgatctcgcacccaagaggtaccggtactcggagctcaagaagataaccgaatccttcaagcacaagctcggcgagggcgggtacggcgccgtgttccgcggcgtcctgaacgcctccggcggcaacagccgcgcgcgcgaggtcgccgtcaaggtcctccaccactcccggcccaacggcgaggagttcctgaacgaggtggtcagcatcggccggacgtcgcacgtcaacatcgtcacgctcctcgggttctgcctcgagggctccaggcgcgcgctggtctacgagtacatgcccaatggctcgctggacaggtacatctactccggcaaccccggcgcagcggcggcgctggggtgggagacgctgcacgaggtcgccgccggcatcgcgcgcgggctcgagtacctgcacgagggctgcaacacgcggatcatccacttcgacatcaagccccagaacgtgctcctggacgcggacctccgccccaagatcgccgacttcgggatggcgaagctgtgcagcccgcaggagagcatcctgtcgatggcggacgcgcggggcaccatcgggttcatcgcgccggaggtcttctcccgggggttcggggtcatctccaccaagtccgacgtgtacagctacgggatgctgctgctggagatggtcgccgggaggagcaacgtcaaggcctacgccgagacgaagtcgggcggcgacctcttcttcccgctctgggtctacgaccacctgctccaggacggcggcgtgctccagcaggaccgcggcgcgggagccgctggtgaggaggtcgcgatgaggaagatggcgctgatcgggctctggtgcatccagaccgtgccggcgagcaggccgtcgatgagcagggtgctggagatgctggagaggagcatccacgagttggcgatgccgccgcggccgtaccacgtttccccgtccaattccccgtcaccgtcgcacccgtcgagctacccgtcttctacctcggatttcaccctgcgtagctcaagagtgcgtacaccggagagcacagcgtaacaaaaggattggagtaggagaattgaatacaatacagaacaagaagcaaagataggttggcaacacattgtttcgcacagttagggacaaatacgaggatggacagtgatgtaacagcaatgcaatgtgcagttcaatgactgtagttaggctagatactcttagtataatgaatatcagtaggtccgttaatgc

SEQ ID NO: 29704 - protein, 673 aa, Panicum virgatum
  misc_feature: Ceres CLONE 1892954
  misc_feature (339)..(622): Pfam Name: Pkinase Pfam Description: Protein kinase domain
  misc_feature: SWISSPROT Homolog: EC 2.7.11.1 Non-specific serine/threonine protein kinase
MAAHARPTLLLSALTLLLAALLHAAAAATSCAPRACGNLTIAYPFWLPGQASSSSAPCGPAAFQVDCRGGQASLANSFRGAYKILRVSYGNRTLVVANDNVQTNASGCPVPRIDVSASLSLAPFTASSANAQLVFLFNSNCTAGAGANGGAPPPGFVNVTCPGTRALVRLDPRYNTSAARAVAGDCEYSVVPVLGSPGASAGDDYPELLRGGYQLEWRASAGDCAACNASGGRCGFDAEADAFACLCSDGSSRPARCDANKSGKKVILIVSLSITFGLLLAFLIVILKFRRRIRSFSLPSIMDSRRSTSDTANVEKLLQKYGDLAPKRYRYSELKKITESFKHKLGEGGYGAVFRGVLNASGGNSRAREVAVKVLHHSRPNGEEFLNEVVSIGRTSHVNIVTLLGFCLEGSRRALVYEYMPNGSLDRYIYSGNPGAAAALGWETLHEVAAGIARGLEYLHEGCNTRIIHFDIKPQNVLLDADLRPKIADFGMAKLCSPQESILSMADARGTIGFIAPEVFSRGFGVISTKSDVYSYGMLLLEMVAGRSNVKAYAETKSGGDLFFPLWVYDHLLQDGGVLQQDRGAGAAGEEVAMRKMALIGLWCIQTVPASRPSMSRVLEMLERSIHELAMPPRPYHVSPSNSPSPSHPSSYPSSTSDFTLRSSRVRTPESTA

SEQ ID NO: 29705 - DNA, 2344 bp, Panicum virgatum
  misc_feature: Ceres CLONE 1892956
  misc_feature: Encodes the peptide sequence at SEQ ID NO. 29706
gtcgccttgtcggcgccccccatctccagccagatcccctcccacccctcctcactcccactcccactcccaatccgagcccagatccgcgcgagaaatgctggggcgggcggcggggctgtcggcgccgcggtggcgcggcgggtcgctggacctgcgcgccgcgctgcgctcggggggcaacctcctcttcgcgctcttcgtggcggccgtgctcgccttcacgctcctcgccgcggtccacagccccgacgacccgctcctccacccgtcgtcgcaccagctcaccgacttcctcacctccgccacctccacgtccaccttcctcaccgacgactccgtgctccgcaccggggaggacttcaacgcttcctcatcctcctccggcgccaccgccgaggccggcgtcgaagcggaagtcaaggagaccgtcccgttcatcaagctctccgacgtcgcgtccgaggccgagaagacaaagcccgtggctgagaagacggagcccgaggctgagcgggccgtcaccgtcgacaccgatgtcggcacgggcgagggggcggcggcggcggaggaggagacccctgtcaccgaggcggtctcctgcgacacggaggcgccggtggattgcacgggggacagggatctcttcaacctgctcatgcgcacggccatcgagcagttccccgacctccacttctaccgcttcggccgtcccgtagcggtgccggatagccccatggaatgcgacctcgcctggcgcttccgccccgctgctgatgctatcggcaccggccggaccacatactacaaggactaccgccgcttcacgctcacccgcgacatcaacacctgcaccctcgttgtcagcagcgtgggcgaataccactcgggtgtagttgccaagcgaaatggcaagcacaaaggaaagaaggggaagaagggcaagcgtgaggcacccgtcaccgactttgtgccggccaagacgcaggttaggctggatgagaatgctgccaacaatgaggctgccggggctgtggctgagccggtgtttgttgttggtgaggctgtcaatgacagcttgccagtggtcgcctctgagagtgatttcagccgcggaaggtacctcatttacatgggtggcggcgagaggtgcaagagcatgaaccacttcatttgggggttcttgtgtgctctaggtgaggctcaattcttgaaccggactcttgtaatggacctcaatgtctgcctcaatgcacggtatacttcgagtggcaaggatgaagagaaagattttaggctctacttcgatttcgagcacctgaaggaatcagcatcagtgatcgatcagagccagttctggcaagattgggggaagtggcagaaaaaggataagctgaagaacttctataccgaagacatcaggatgaccccgatgaaactcagagacgtcaaggacacactgatcatgaggaagtttgggaatgttgagccggataactattggtcacgtgtatgtgaaggtgagactgagggagtgatcaaacgcccatggcatttcctatggaagtctcgtcgcttgatggagattgtatctgcgattgcctcacggatgagctgggacttcgattcggtccacattgtgagaggggagaaagcacagaacacacaactatggccaaaccttgatagagatacctctccggacagtctgcttatgacactcaatgacaaggttggtgctggccgctatctgtacattgctaccaatgagcccgacaaatcgttctttgacccacttaaggaaaagtataaaacacgcttcctggatgatttcaaggacttgtgggatgagaatagcgagtggtttactgaaaccaaggagctgagcaatggtaagccagtggaatttgatgggtacatgagggttgcagttgatactgaggtgtttctgagggggaagaggcatttggagacattcaacgaccttacgcgtgattgcaaggatggcgtgaatacatgcccagcttcctcctgaacatctgatgggctaaggtgagctgatattctgaaatattatgcatcacagaatattgccaacattgttgttggtgtatcttatgcacctgccttgttgtagttaggtagccagtatcagctttttttaaaccactattgctgatttgtgtgtccagattacagtagtctgttgagtgcattggacttgtgctgagacaactagttgatggtacctgcagatgtgctttgtatctcttctatacggctcatcaatttttctcacgaagaccatgttaccctccattctctaaatgttacatgttttggc

SEQ ID NO: 29706 - protein, 645 aa, Panicum virgatum
  misc_feature: Ceres CLONE 1892956
  misc_feature: Functional homolog of the protein sequence given in SEQ ID NO 50635
  misc_feature: Useful for making plants with modulated light quality sensitivity
MLGRAAGLSAPRWRGGSLDLRAALRSGGNLLFALFVAAVLAFTLLAAVHSPDDPLLHPSSHQLTDFLTSATSTSTFLTDDSVLRTGEDFNASSSSSGATAEAGVEAEVKETVPFIKLSDVASEAEKTKPVAEKTEPEAERAVTVDTDVGTGEGAAAAEEETPVTEAVSCDTEAPVDCTGDRDLFNLLMRTAIEQFPDLHFYRFGRPVAVPDSPMECDLAWRFRPAADAIGTGRTTYYKDYRRFTLTRDINTCTLVVSSVGEYHSGVVAKRNGKHKGKKGKKGKREAPVTDFVPAKTQVRLDENAANNEAAGAVAEPVFVVGEAVNDSLPVVASESDFSRGRYLIYMGGGERCKSMNHFIWGFLCALGEAQFLNRTLVMDLNVCLNARYTSSGKDEEKDFRLYFDFEHLKESASVIDQSQFWQDWGKWQKKDKLKNFYTEDIRMTPMKLRDVKDTLIMRKFGNVEPDNYWSRVCEGETEGVIKRPWHFLWKSRRLMEIVSAIASRMSWDFDSVHIVRGEKAQNTQLWPNLDRDTSPDSLLMTLNDKVGAGRYLYIATNEPDKSFFDPLKEKYKTRFLDDFKDLWDENSEWFTETKELSNGKPVEFDGYMRVAVDTEVFLRGKRHLETFNDLTRDCKDGVNTCPASS

SEQ ID NO: 29707 - DNA, 590 bp, Panicum virgatum
  misc_feature: Ceres CLONE 1892970
  misc_feature: Encodes the peptide sequence at SEQ ID NO. 29708
aaatgacttcaggttctccgcatccggtcccccgctacttcctgtaactgcagttaggcccctctgacacttcggtcccgtttcttggaggtggccgcagctctccggcggaaggcggcggagatggcttcggcggcgcagtgcttcagctcctactcctcgtccccggccacgtgggctctgcggcagcgcggtggcgcccgggtgcttcagctctcttcccggcggagcttctgcgtctccgcggcagccggcggattcgacaaccagaaccgcgagtatgtgatcgtcggcggagggaacgcggcggggtacgcggccaggacgttcgtcgagcatggcatggctgatggccgcctctgcatcgtctccaaggagccagttccaccatatgagcggccagcattgaccaaaggctatatctttcctccggacaagaagccggcacgcctacctggttttcatacatgtgttggatctggtggacagcgacagactgctgaatggtacaaggagaatggtatagaggtgttgtatgaggatccagttgtagcatttgatggcaaacacagaccttgaaaacttcgtca

SEQ ID NO: 29708 - protein, 151 aa, Panicum virgatum
  misc_feature: Ceres CLONE 1892970
  misc_feature: SWISSPROT Homolog: EC 1.6.5.4 Monodehydroascorbate reductase (NADH)
MASAAQCFSSYSSSPATWALRQRGGARVLQLSSRRSFCVSAAAGGFDNQNREYVIVGGGNAAGYAARTFVEHGMADGRLCIVSKEPVPPYERPALTKGYIFPPDKKPARLPGFHTCVGSGGQRQTAEWYKENGIEVLYEDPVVAFDGKHRP

SEQ ID NO: 29709 - DNA, 1961 bp, Panicum virgatum
  misc_feature: Ceres CLONE 1892979
  misc_feature: Encodes the peptide sequence at SEQ ID NO. 29710
acaaaaggggagccgaggacgcgcgcccgctcgctctcccgcacggcacagcgcaactcgacaccgcaccagctgcgcccacgcacgtacgcgccgcgccccgtgccccgggggctttccaatcctttccacgctgtcgccgcgcgcgctctcctgcgctgctccgtccgtccccccttccggcgttcacaccgcctgctcagcctcgcgtcttacaaagaggcgcaggtgcgtaccctccgatccccctgagaggcggcacggcggagagagcggcggcggcggcgcgagaagctgctcgtgtcggcgactcgattcgaaagccgccggctttcgcagagctgctgctgctgcagcagcagcagcttgtgccgcggggggccatgagctgcctgggctggttcaagcggaggtcgaggagcggcggggcgtcgtcggggaagcgcggggcgtcggcgccgccgtcgtcgggcccggcgaccaccacgacgacgaccacggtgtcgggggtgagcacgagccggtcggacgactccggcgcggtgcggccggtgagcaagtcggcggggtcggccgcctcgtcgcagtcgcagcggagcatctcgtcgctgtacgaggagcggggccacggccagctgcgagtgttcgactacgaggagctccgggccgccaccgccgacttcggccgcgcgcagaagctcggcgagggcggcttcggcagcgtctacaagggcttcgtccgcgcggccgacggcaagggggaccgcatccccgtcgccgtcaagaagctcaaccagcgcggcctgcagggacataagcagtggttggcagaagtacagtttcttggtgttctggagcacccaaatcttgtaaagttacttggatattgcgccgttgactccgaaagagggccacaaaaattgttggtgtatgagtttatgccgaacaagagcttggaagaccacttgttcaggcgagctaatcctcctttatcgtggaacaaaaggcttcaagttatcttgggtgctgccgaaggattggcctacctgcatgaaggggtagaagttcaggtaatctaccgggacttcaagacgtcgaacattttactggacaaggacttcagagccaagctgtcagacttcgggctagccagggaaggaccaactggagcaaacacccacgtctcgactgcggtcgtcgggacgcaagggtacgcggcgccggagtacgtcgactcggggcacctgacggcgaagagcgacgtgtttagcttcggcgtggtgctgtacgagatcctgacggggcggcggtccctggaccggaacaagccggcggcggagcagaagatgctggagtgggtggcccagttcccgccggacagccgcaacttccggatgatcatggaccccaggctccgcggcgagtactcggcgaaggccgcgcgggagatcgccaagctggccgacagctgcctgctcaagaacgccaaggatcggcccaccatgggcgaggtggtcgaggtgctcaggcgcgccgtgcaggcggccgagccggatagccggtcacccggtgccggcgccgtcagggggaggagaggcgacgcggccgcgccgtccaggaggtgattgctattgctatgccacggtgtcatcgccggcaaaggctctggttggcttgagtcgaagctagctggtcatggaacgatggaagggagactgatatgcggctgtcgtcagacgtgacactgacagcacacagagaatgttagttttgggtctgtgtcggtgagtggcgggggcttacaaatatttttctggcacattacttggacaaatagagacgattcggcggattgaagttttagttttcttttccctttccctttcgaaagtgagaattttagaagaattttgcaccggctctaaaaaaagaatgaattttgcactgggtttgttctctcg

SEQ ID NO: 29710 - protein, 413 aa, Panicum virgatum
  misc_feature: Ceres CLONE 1892979
  misc_feature (100)..(381): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50301
  misc_feature: Useful for making plants with modulated heat sensitivity
MSCLGWFKRRSRSGGASSGKRGASAPPSSGPATTTTTTTVSGVSTSRSDDSGAVRPVSKSAGSAASSQSQRSISSLYEERGHGQLRVFDYEELRAATADFGRAQKLGEGGFGSVYKGFVRAADGKGDRIPVAVKKLNQRGLQGHKQWLAEVQFLGVLEHPNLVKLLGYCAVDSERGPQKLLVYEFMPNKSLEDHLFRRANPPLSWNKRLQVILGAAEGLAYLHEGVEVQVIYRDFKTSNILLDKDFRAKLSDFGLAREGPTGANTHVSTAVVGTQGYAAPEYVDSGHLTAKSDVFSFGVVLYEILTGRRSLDRNKPAAEQKMLEWVAQFPPDSRNFRMIMDPRLRGEYSAKAAREIAKLADSCLLKNAKDRPTMGEVVEVLRRAVQAAEPDSRSPGAGAVRGRRGDAAAPSRR

SEQ ID NO: 29711 - DNA, 685 bp, Panicum virgatum
  misc_feature: Ceres CLONE 1892998
  misc_feature: Encodes the peptide sequence at SEQ ID NO. 29712
  misc_feature (454)..(454): n is a, c, t, g, unknown, or other
gtatgttcacatcaacaaacccaactcgcccgcctcctcgcacctcgccgattggcacggcacggccgcacagatcgagctcatcgccgcacaggtcacgggcatcggagcgagctaggccgccgccgccgcccatggacgacgcggcgcctcacgtcatggtcctgccgttcccggcgcagggccacgtcaccccgctcatggagctgtcgcaccgcctcgtcgaccgcggcttccgggtcaccttcgtcaacaccgagcccatccacgccctcgtgctcgccgccctgcgcccgccggcggcggccggcggcggcggcaccgcgcttccggacgggatccggctggtgtccgtcccggacgggctggccgacggcgacgaccgcagggacctccgcaggttcgtggacgcgctctcgcggtgcgtcccggactacgtggagcggctcctcanggagaccaaggtcaagtggctcgtcggcgacgtcaacatggggatgtgcttcgaggcctccaggaagctcggtgtccgggtggccgccgtcttccccgcctccgcggcgtgcctcgcgacgctcttcaaggttcccagctgatagaaggcggcttcttcgacgacaagggtatggtcgcatgaaccaccatccttttttctgatttcttgctcgagctgtcttgtacaaaa

SEQ ID NO: 29712 - protein, 153 aa, Panicum virgatum
  misc_feature: Ceres CLONE 1892998
  misc_feature: SWISSPROT Homolog: EC 2.4.1.218 Hydroquinone glucosyltransferase
  misc_feature: Functional homolog of the protein sequence given in SEQ ID NO 50296
  misc_feature: Useful for making plants with altered carbohydrate content
  misc_feature (107)..(107): Xaa is any aa, unknown, or other
MDDAAPHVMVLPFPAQGHVTPLMELSHRLVDRGFRVTFVNTEPIHALVLAALRPPAAAGGGGTALPDGIRLVSVPDGLADGDDRRDLRRFVDALSRCVPDYVERLLXETKVKWLVGDVNMGMCFEASRKLGVRVAAVFPASAACLATLFKVPS

SEQ ID NO: 29713 - DNA, 1895 bp, Panicum virgatum
  misc_feature: Ceres CLONE 1893009
  misc_feature: Encodes the peptide sequence at SEQ ID NO. 29714
gtcggacagaaaaaaaatcccgtcgccccctcctcccgttcttggctactcccttcttccccttccctctcctctctctagggttagaatttctccatggattcttgaattttggtactgaaattgaatgggaaaggaggccctctcctccttgtgccctccgaggtgctctagcggcgtgcagcgcttgggggcaggcggcggcggcctctgctctctgccctgctgggcagcgcgcatgcagcacagggcccaggcggggctctgcgcgtggcgggcggccaggcgcacggctcccagcggcgcccggtgacgcgctggacgagcggtgccttggtgggggcgcgcggcttcagccagactcgcagcgcttgaggagaaggcatcctcggcatcagctggcgacggcgctgagggcagacgagcccacccagcagcggccaggaagggcggccggcaaggccagcagcaggcagcgccatcagcaagctgcagcacggcgtgcggcccacgaggacaaggcacatagccccagcatcaggccgaccgcagacacctctcgtgaagttcaccggaccggaggaaactgcaagcagcagcaatggcggaggtgaggaaccggaaggtgctgctgaagcgctacgtgacgggttaccccgccgaggacgacatggaggtcgtcgacggcaccgtgcacctcgccgtgccgcaggggctccaggcgcccgccgtgcggctgaagaacctctacctctcctgcgacgcctggatgcgcggccgcatgtctaagcgcgacgaccccgtcaccgtcgtcaatgacttcgtcctaggcgaggctttgaccaactttggcgttagcatggtgattgactccacacacccggattaccatgccggcgatctcgtgtgggggatgagcgggtgggaggagtacacgctcatctctgagccggcgtcgctcgtcaggatcaaccaccccgagctgccgctttcctactacacaggcgttctcggcatgtcgggcctcactgcgttcgctgggctgttcgacgtgtgcaagcccaagaaaggcgacaccttcttcgtctcagcggcgttcggtgctgttggccagatcgtcggccagctggccaagctcgccggctgctacgtcgtcggcagcgtcggctccgacgagaaggtgagcctcctcaagggcaagctcggcttcgacgacgccatcaactacaggaaggagcccgacctgggcgccgcgctgagccggtgcttcgcggagggcatcgacatctacttcgacaacgtgggcggcgcgacgctggatgcagcgctgctctgcatgcggacgcgcggccgcgtcgccgtgtgcgggatggtgtcgcagtacaaccttgacgacccggccgccggggtgcgcatgcgcaacctgccgttgctcgtcgccaagcgcatccgcatggaggggttcaacgtcgccgactacctcgccgacggcccctactaccgccggttcgaggaggagatggccggctacctccgtgacggcagagtgacatacgtggaggacgtcgtggaagggctccatggcgcgccggccgcgctcgtggggatcttccaggggcggaacgtcggcaggcagctcatcgttgttgcgcgggagtgacgatcagtgggttgcattatattggccgtcagcccaaacactgatcgatgatgcttcagttcatttcgatcattgtttaatttctttctcaatcatgtatatatgcttgctttgagtgatgacaagagggtatcatatcggtatgcaactatgcatcgatgcatgccatttctttcgatcttgctcaggatgatgtggaaaaaataatattgaataaaaatatatatttgtaatc

SEQ ID NO: 29714 - protein, 352 aa, Panicum virgatum
  misc_feature: Ceres CLONE 1893009
  misc_feature (156)..(309): Pfam Name: ADH_zinc_N Pfam Description: Zinc-binding dehydrogenase
  misc_feature: SWISSPROT Homolog: EC 1.6.5.5 NADPH:quinone reductase
MAEVRNRKVLLKRYVTGYPAEDDMEVVDGTVHLAVPQGLQAPAVRLKNLYLSCDAWMRGRMSKRDDPVTVVNDFVLGEALTNFGVSMVIDSTHPDYHAGDLVWGMSGWEEYTLISEPASLVRINHPELPLSYYTGVLGMSGLTAFAGLFDVCKPKKGDTFFVSAAFGAVGQIVGQLAKLAGCYVVGSVGSDEKVSLLKGKLGFDDAINYRKEPDLGAALSRCFAEGIDIYFDNVGGATLDAALLCMRTRGRVAVCGMVSQYNLDDPAAGVRMRNLPLLVAKRIRMEGFNVADYLADGPYYRRFEEEMAGYLRDGRVTYVEDVVEGLHGAPAALVGIFQGRNVGRQLIVVARE

SEQ ID NO: 29715 - DNA, 689 bp, Panicum virgatum
  misc_feature: Ceres CLONE 1893010
  misc_feature: Encodes the peptide sequence at SEQ ID NO. 29716
aaactcaagcaactactagtagagagttgcacacggccgctagcttccccctcctcctccgagccatgtcgccggcaacagttctcgtgttgctgctcgccgtggccaccggtgcttggtcgtcggcggcagccgtgcggctgcaccggagccacgactacgagagggtgttcgaccggcagcaagccgaccgggtggaggccctgcccggccagccgtcggaggtcgggttccggcagttcgccgggtacgtgacggcgaacgagtcccacggccgcgcgctcttctactggttcttcgaggccacgcacgacgtgcagaacaagccactcgtcttgtggttcaacggaggaccgggatgctcgtccgttggatatggggcgctggaggagctgggtcctttcctggtgcagaagggcaagcctgagatcagcctcaacccctactcgtggaacaaagaagccaacctgttgttcgtggagtccccagccggcgttgggttctcctacaccaacaccaccaaggatctcagccagttcggcgacgagctcaccgccactgacgcccatgggttcctggtgaactggttcaagaggttcccgcagttcaggggccacgacttctacatcactggggagagctacgcttgggcactacgtcccgcagctggcgaccaagatcctggaggg

SEQ ID NO: 29716 - protein, 207 aa, Panicum virgatum
  misc_feature: Ceres CLONE 1893010
  misc_feature (48)..(207): Pfam Name: Peptidase_S10 Pfam Description: Serine carboxypeptidase
  misc_feature: SWISSPROT Homolog: EC 3.4.16.6 Carboxypeptidase D
MSPATVLVLLLAVATGAWSSAAAVRLHRSHDYERVFDRQQADRVEALPGQPSEVGFRQFAGYVTANESHGRALFYWFFEATHDVQNKPLVLWFNGGPGCSSVGYGALEELGPFLVQKGKPEISLNPYSWNKEANLLFVESPAGVGFSYTNTTKDLSQFGDELTATDAHGFLVNWFKRFPQFRGHDFYITGESYAWALRPAAGDQDPG

SEQ ID NO: 29717 - DNA, 3122 bp, Panicum virgatum
  misc_feature: Ceres CLONE 1893037
  misc_feature: Encodes the peptide sequence at SEQ ID NO. 29718
ctgaaagcaaagcagacagtctgcacaagaacatccaaatcgctgcagatctcgctactctgttttccaaatcgctaatcttgtgctattttccacacaaattcctgcagattattgcagaagaggatccaccgcagagagaagatgcttccgaggcatagattcttcaagttcagattctccttgtagctgcaaatgaatgagcaaaaaatctcatctgctctctcagcttcatctgctctctcagctgcgacgagagaaacaaaaatccctctgatctctgccagcgagccagtttggttggtttctttctacacatagtcctcccaccacatctctctcatcagtctagtagctttgcccttttccaggccaggtgataacaagggaaggcgagaggtcgattttttgggtacttattctctgcaccagtaattttgcatccatcgtttattcctctgcttggcgcttccgtcctgtgcatagctatcaagtgttgcgtcgtcttgtcagagctcgcaatcaacaggggcacatgacagcgtctgtaattggtgctgcaggcgcatgcgcgaaaaactgaggtgatcgatcccacccatcgagagaggttgcacttcactttggagggggagggaggcatccggttccatcactcaatcaatctcttcttctggtggtgtgcgtgtcgctcgctgccacatataagcggcgtcagatgagtgcacggccctgctgcctcctcggcgccgcgcaccacgcgcacgcgggggtctcttcttcctcctcctcctcctggccgtccatggcgccgtggatcgtcgtcgtcgactgctccagcctcagctggctcctcttccgcgtcttcttcacctacgacatccacaacttcgccaagcccaccatctagcacacagcaccaagtcatctcctacttaattacagtagtagcctgttcggcacagcaacttgtctcttgtgtttcctgcaaccgatcgagcgatcgagctcgagcatgtccgggccacggcgctgcggcagccggcggccggcggtggtgggggacaacaccaacggatacgttgagaccgatcccacgggtcgctatggccggttcgacgagcttctgggcaagggcgccatgaagtcggtgtaccggggcttcgacgaggagcttggcgtggaggtggcgtggaaccaggccagcctcagcgacgtgctccggacccccgacgcggtgcagcgcatgtactcggaggtgcagctgctgagcaggctccgtcacgacgccatcatcggcttccacgcctcgtgggtggacctgccccgccgcaccttcaacttcatcaccgagctcttctcctccggcacgctccgctcctaccgccgccgctacccgcgcgtcagcctccgcgccgtccgctcctgggcgcgccagatccttcggggcctcgcctacctccacggcctcgacccgccggtcatccaccgcgacctcaagtgcgacaacatcttcatcaacgggcacgagggccgcgtcaagatcggcgacctgggtctcgccgccgtgctccgggaggccggcggcgcggcgcacagcgtgatcggcacgcccgagttcatggcgcccgagatgtacgacgaggagtacgacgagctggtggacgtgtactcgttcggcatgtgcgtgctggagatgctcaccctcgagtacccctacagcgagtgctccaaccccgcgcagatctacaagaaggtcaccgccggcaagctgcccgacgccttgtaccgggtgcaggacgccgaggcccggcagttcatcggcaggtgccttgtcgccgcgtccaagaggccgtccgcggcggagctgctgctcgaccctttcctccaactcgacgatcattatcagcatcatgccaccgtcgtgatgccacagccaacaatatcattgccgcctgctgctgctccttgttcaacccgcagcatcagtagttccgatgatgtctcgtcaataatgggtgatgatcatgtggggggtgaggatgccgcagatcctccagtggccagcaggactagtgacatgaccatcaccggcaagctgaacgccgaggaggacaccatcttcctcaaagtccagatcgccgacgagacggggaacgatgttcggaacatctacttcccgttcgacatggtgagcgacacggcgacggaggtggcggaggagatggtgaaggagctggagatcagggaccgggacccatcggagatcgccgccatgatcgaccaggagatcgagaggttgcttcccgggcgaaagcagcagcacgagtacactgtgtacgcggcacaggatgatgacgacgaaaacgtgaagcgccctcctccgttctactacctctcctcttcccccacctcctcccaaggctctgtctgtggagcgggacccggaggcttctctggcccacaaggcagcgcctggtccaaagattatggatacttggcttctttaagcgacgatgatgatgacatgagctccatgcactctggtaagtactctgctctgcactacgcctcagggaatgaagaagaggcccagtcaccacatcaagtcatcggagatacggcctcaaaggcccagcccaagaacaccagattcggcccaggagagagcagcagctccctgctgactcggcagcagcagcggcagtgcagcatgtcgccgcacgccggccggccgcggcggcgggaggacgacgaccggcacgggagggggaggaggatgacgcggaacaggtcgatggtggacatgcggagccagctgctgcaccggacgctggtggaggagctcaaccgccgcctcttcttcaacaccgtcggcgccgtcgagaacatcggcttccgggcgcccaccaccacctcctcctcttcctcgtcgacgcgtggcaggatccggagcaaagacgacaagcgtcaccagcacgtcatgttttaatttgagcaatctgtttttctttttctttttttggtacttagtgtgtgtggatgccaaaaagatagtcaagcccagtggcggaaccaggattgagttgaaccccgggccgagttttaaatatagttgtgac

SEQ ID NO: 29718 - protein, 658 aa, Panicum virgatum
  misc_feature: Ceres CLONE 1893037
  misc_feature (32)..(291): Pfam Name: Pkinase Pfam Description: Protein kinase domain
  misc_feature: SWISSPROT Homolog: EC 2.7.11.1 Non-specific serine/threonine protein kinase
MSGPRRCGSRRPAVVGDNTNGYVETDPTGRYGRFDELLGKGAMKSVYRGFDEELGVEVAWNQASLSDVLRTPDAVQRMYSEVQLLSRLRHDAIIGFHASWVDLPRRTFNFITELFSSGTLRSYRRRYPRVSLRAVRSWARQILRGLAYLHGLDPPVIHRDLKCDNIFINGHEGRVKIGDLGLAAVLREAGGAAHSVIGTPEFMAPEMYDEEYDELVDVYSFGMCVLEMLTLEYPYSECSNPAQIYKKVTAGKLPDALYRVQDAEARQFIGRCLVAASKRPSAAELLLDPFLQLDDHYQHHATVVMPQPTISLPPAAAPCSTRSISSSDDVSSIMGDDHVGGEDAADPPVASRTSDMTITGKLNAEEDTIFLKVQIADETGNDVRNIYFPFDMVSDTATEVAEEMVKELEIRDRDPSEIAAMIDQEIERLLPGRKQQHEYTVYAAQDDDDENVKRPPPFYYLSSSPTSSQGSVCGAGPGGFSGPQGSAWSKDYGYLASLSDDDDDMSSMHSGKYSALHYASGNEEEAQSPHQVIGDTASKAQPKNTRFGPGESSSSLLTRQQQRQCSMSPHAGRPRRREDDDRHGRGRRMTRNRSMVDMRSQLLHRTLVEELNRRLFFNTVGAVENIGFRAPTTTSSSSSSTRGRIRSKDDKRHQHVMF

SEQ ID NO: 29719 - DNA, 613 bp, Panicum virgatum
  misc_feature: Ceres CLONE 1893039
  misc_feature: Encodes the peptide sequence at SEQ ID NO. 29720
gttcaactccagcaaacaacatcatttcctcctcttcgatctctccattcgcccacaactgattaattagcatcaacctcgctcctccgaatccgatcacctacaagaagcaacaagcagcagcagctcagagatcacaacaggcagcatatctatggaggtctcgtcgtcttcggcggaggtgccccactatttcctctgcccgatctccctggaggtgatgcgcgacccggtgacgctcgccaccggcatcacctacgaccgcgccagcatcgagcggtggctcttctccgacggccacgccacctgccccgtcacgcgccgcgcgctcgcgcccgaggagatggacgccacgcccaaccacacgctccgccgcctcatccaggcctggtgcgccgcgcaccaggtcgagcgcttccccacgccgcgcccgccgctcgactcctgccgcgtcgccgcgctcctcgacgagggccgccacggcagggaggccgccgcgctcagggagatccgggccgtcgccgccgagagcgaccgcaacaggcgctgcgtcgaggccacgcccggcgccctcgacttcctcgtatccgtcgtcaccaagcactccacgtct

SEQ ID NO: 29720 - protein, 152 aa, Panicum virgatum
  misc_feature: Ceres CLONE 1893039
  misc_feature (9)..(86): Pfam Name: U-box Pfam Description: U-box domain
MEVSSSSAEVPHYFLCPISLEVMRDPVTLATGITYDRASIERWLFSDGHATCPVTRRALAPEEMDATPNHTLRRLIQAWCAAHQVERFPTPRPPLDSCRVAALLDEGRHGREAAALREIRAVAAESDRNRRCVEATPGALDFLVSVVTKHST

SEQ ID NO: 29721 - DNA, 2757 bp, Panicum virgatum
  misc_feature: Ceres CLONE 1893045
  misc_feature: Encodes the peptide sequence at SEQ ID NO. 29722
gcgtcccgcaccgtgtgccccccattcgcctccctccgcttccgcccttccgccaccaccacccgacctggcccccagcggcggtcggcaaaccctagaacctcgtacacccatcttgcgttccccgggagtgggatagggtccggcctccgtgtgcccagcccgcggcgatgccgctgttcatctccgacgaggagctccggctcctcggcggcgacacggccgccgtcgccgagcgggccgacgccgccatccgcgagctccggcgccaggtggacaccgtccgcgccgaggcggacgcggccgcgatcgccgccgagcagacctgcgccctcctcgagcaacgctacacctccctctccgcggagttcgatcggtcccaggccgaggccgccgagctcaccgccgccgcggagcgccgtgccgccgagcttgcctcctcccaggcggagatacatcagcttcgcatccaggcgattgctaaggatggcgaggtggagaggttgaaagttgaaatctcggagctgcacaagtcgaagtgtcagtcgttggagttgattgagcagagagatgctgaaataaaagagaaggatggcatcatccagagctattatgacaaaattgtcaatctggcagatagttctgctagtaaagaggctaggatacaagaggttgaagccaagtttacccattgtcaggcaatgtgcaaccgcattacccaggagaaggagctgcttgaaaagcataatctatggcttgatgaagaactgaaagtaaaagtgaagaacttagctgaactaaggaaaacaaatatggacgaggaggctaggatgtcagctaggattgcagagcttgaaagagagatttctgaaacttctagctccttgaggcgaggcaaagaacgtatctctgaactggagcaaagggtatcttacatggaaaaggaattgtgctcaacaaaggatgccgcagctgctaatgaacaacgtctgggtgctgaactttcaactgtcatgaaacttgctgaacttcacaaagaaagttctgaggaatggtcgaagaaggctggggagcttgaaggtgttattaaagcattagagacgcatctgacccaagttgaagatgagtacaaggaaaagcttgagaaggagatcttatccaggagagaccttgaaaaggaagctgccgacttgaagcagaagcttgaaaaatgtgagtttgatttggagaatacaaggaagtccagggaattgagcctcgttccactgaccagtgttacagcagactcctctgatttagtagactcaagacaaggactgccaatgtctgatgatttaaatcagaatgacctaatggttattccaaaggtacctagtggtgtttctggaactgcattagctgcttctcttcttcgtgacggttggagtcttgctaagatctatgagaaataccaagaagctactgatgctttacttcatgagaggcgggggaggagacacgcagaagcagttcttgaaagggtcttgcatgaaatagaagagaaggctgaacttatcctagatgaacgagctgagcatgagagaatggttgaagcttatgctcttatggaccagaaattgcagcaagcattgctggagcatgataattttgaaaatactattaggaatctaaagtctgagttgaaaaggcgggaacgtgatcatagtgtggcacagaaggaaatagatgatctgcagaaacaagtggctgttctgctaaaagaatgtcaagacatacagcttcgctgtggttctagccttcctaatgtaggtaatggtgccttttctgcaagcttaggcagtgttctttccaacgtagagcacaatatcaaggacaatatgtcttttaaagatatcaatggattagttcagcagaatgttcaacttcgaaatcaagttcacatgctctcagctgatcttgacaaaaaggacatggaactacgggagagcttccaaattgagttgaagaaaattactgatgatgctgcattcagggttgaaaaagtgatgaagaaatctgaagaacaagcaataatgattgaatctcttcatcgatccgtagcgatgtatcgtaagctttgtgaggagcagcagaagactcgttcgaatgttgaatcagtacccaataatttgcaagatagtggcagaacggacctgatggttctgtttgaaggatcacaggaagtctcgaagaaagcttatgagcaagtctctgagcgagccaggagcctcaatgaagagctgacaaagttgagggctgagcttgtgtctctgcggtctgaacgtgataaggcagtgcttgaagctgattttgctcgggaccggcttaatgggtttacagcagagcttgagcaccagaggaaggagactaattccatttcactgagaaatgcggagttgatgcatctgatagttgattacgaacgtagacttcgtgaagattcggattctaagcaagccttagaggagaattcaaggaatctattgatggaggtgtccgttctgaagggtcaaaaagagattctagtaaagtcagagaatagagctttggatgaagtccgtgatttaacagagcgagtgcatcgtctgcaggctacgattgacaccatacataccactgaggaggttcgagagaatgcaaggtctatggaaaggagaaatcatgaggagcacattaagcgactagaaagggattgggctgagcttaagaaggagcttc

SEQ ID NO: 29722 - protein, 862 aa, Panicum virgatum
  misc_feature: Ceres CLONE 1893045
  misc_feature: SWISSPROT Homolog: EC 2.7.11.1 Non-specific serine/threonine protein kinase
MPLFISDEELRLLGGDTAAVAERADAAIRELRRQVDTVRAEADAAAIAAEQTCALLEQRYTSLSAEFDRSQAEAAELTAAAERRAAELASSQAEIHQLRIQAIAKDGEVERLKVEISELHKSKCQSLELIEQRDAEIKEKDGIIQSYYDKIVNLADSSASKEARIQEVEAKFTHCQAMCNRITQEKELLEKHNLWLDEELKVKVKNLAELRKTNMDEEARMSARIAELEREISETSSSLRRGKERISELEQRVSYMEKELCSTKDAAAANEQRLGAELSTVMKLAELHKESSEEWSKKAGELEGVIKALETHLTQVEDEYKEKLEKEILSRRDLEKEAADLKQKLEKCEFDLENTRKSRELSLVPLTSVTADSSDLVDSRQGLPMSDDLNQNDLMVIPKVPSGVSGTALAASLLRDGWSLAKIYEKYQEATDALLHERRGRRHAEAVLERVLHEIEEKAELILDERAEHERMVEAYALMDQKLQQALLEHDNFENTIRNLKSELKRRERDHSVAQKEIDDLQKQVAVLLKECQDIQLRCGSSLPNVGNGAFSASLGSVLSNVEHNIKDNMSFKDINGLVQQNVQLRNQVHMLSADLDKKDMELRESFQIELKKITDDAAFRVEKVMKKSEEQAIMIESLHRSVAMYRKLCEEQQKTRSNVESVPNNLQDSGRTDLMVLFEGSQEVSKKAYEQVSERARSLNEELTKLRAELVSLRSERDKAVLEADFARDRLNGFTAELEHQRKETNSISLRNAELMHLIVDYERRLREDSDSKQALEENSRNLLMEVSVLKGQKEILVKSENRALDEVRDLTERVHRLQATIDTIHTTEEVRENARSMERRNHEEHIKRLERDWAELKKEL

SEQ ID NO: 29723 - DNA, 642 bp, Panicum virgatum
  misc_feature: Ceres CLONE 1893045-R
gagattgatcaccagaggcaggagggtacttccatttctgagcgaaacgcggagacgacacatgtaagagttgatgacgagcgtaaacttagtgaagagtgggattctaaccaaccctgggaggagagctcaaggaataaattgacggaggagtcagtattttaagggtcaaaaaaagcttttaggatattcagagcaaagagcattggatggagtaaatgcattaacccagtgagcggatcgtagtcggggaacgagggacacctttcatcactctgaggagaatggagagaaagtaaggtaaaaggaaaggagaaatcatgaggagcgacattcagtgattcgaaaagaggatatgggttgagcaacagaaggagattcaggagcatatgagcccattttggaattatgccccttgataagaaaatttcacaaggcatcgcaatgaagcaagtggtggatatgagaaaggagtagcagagctagagcaaccccgcttcaggtgctggaacaagggcacccatttcggagtccaagtgttcgtgatttagaggcaaagctgaaatcaaggagcgtcatttttagggccgctggccatgaaatgtcagccacctaggaggataagtatgccctatagcaggt

SEQ ID NO: 29724 - DNA, 356 bp, Panicum virgatum
  misc_feature: Ceres CLONE 1893071
  misc_feature: Encodes the peptide sequence at SEQ ID NO. 29725
ctcgcttctttgcatcagccgtcttcgtccgatggcctcccccatcgggtccgcgtcgcgggggcagctcctgcagaggggcggggcgggggcgggcccgtgctgccgcgcgcggggcaccaccgcacctccgcggactgcgtcgtcatggagcgggggttggtgactacgcacaacgccgagaccgccgactacttccgcgggacccaggtgcgctgagtcctctgcccccacaagccccacgccggcaaccgcgccgtcctgaccgcccatatctcctacatgatcacccaccaccataagatcgtggtcgtcgaccacgaaatgcccgcaaagcacagcgaccgccgccgcat

SEQ ID NO: 29725 - protein, 72 aa, Panicum virgatum
  misc_feature: Ceres CLONE 1893071
  misc_feature: SWISSPROT Homolog: EC 3.1.4.4 Phospholipase D
LASLHQPSSSDGLPHRVRVAGAAPAEGRGGGGPVLPRAGHHRTSADCVVMERGLVTTHNAETADYFRGTQVR

SEQ ID NO: 29726 - DNA, 1812 bp, Panicum virgatum
  misc_feature: Ceres CLONE 1893076
  misc_feature: Encodes the peptide sequence at SEQ ID NO. 29727
attttttattactcccctttcccggtcttgcgagcgagccccgccatggatatctgcaccggttgttttcgagccagatattagtagttgcgtgcttgcgtttgcgttggggaggggttggaccccgtctattccggaacaggggacgctgcccttttccacgcgccactctgctccgaacccatcctgctccgaccagccctctccctgctccgccgcgccgaggagaaagcaacagaggaaagagagaggatttccacccggtcgtcccctcgatccgttctccgctgcagttccttgaagcaaggtgctggggatcgactccgtctccgtcgaccggaattccacggcgtcgagggccgcttcaaccgttttggcgcgtcgtgccagcgagatgcttcggtgaaagaccacttcttgacgcgttctgctggtgccgctgctccccatggcaggagcaggaggaggctaggacagcccggcaccgagaggcgcgcggtccgtgctccccagcgtggcctcgcgcggcatgctcgttgcctcgccgggggagggatggtcgatcgaacgagggccgcgctcatcggggtcaccgccggcgtcgcggctgcggtgcttgcggcggcgtgcgtgctcctcgccatctggctgcaccgccggcgggccagcgtcgccgcccggacgcggtccgtggagtcgccctcagcgacgctgcgggccgacggcgaccgctgcgccagcctcgactccagcgcctccgtctcggtggtctccgagagcgtcgccgactggggccacccgccgccggcaaagcgcgccgcgttctgggcctggagaggcggcgccggccataatggcagggagccgccgccgctgaccgtttccgggatcccaaaataccactacaaggatctgcagaaggctaccagcaactttaccacaattctggggcaaggatcgttcggtcctgtgtacaaggctgtaatggccactggtgaagtggtagctgtaaaagtgctcgcgagtgattcaaggcaaggggaaagagagttccagactgaggtagctttgcttagcaggctgcatcatagaaaccttgttaatttggttgggtattgcgtggaaaaaggtcagcgcattctgatttacgagtacatgagcaatgggagtttggcaagacttttgtacggcgacaataaacggagtttgagctggcaagaaaggctgcaaattgcccatgatatctctcatgggatcgagtatctgcatgaaggggctgttccacctgttattcacagagatctaaagtctgataatatacttttggaccattcaatgagggccaaggttgcagactttggtttatcaaaggaggaagtatatgatggaagaaagtcgggcctcaagggcacctatggatatatggatcctgactacatgtccacaaataagttaacaaagaagagcgacgtgtatagttttggtattatactttttgaactgataactgccataaatccacagcaaggtctaatggactacattaatctggtaagtcattttaacgttactgaaagtccataaatcttgtagtttgtcgtctagaagagtcctctctagttaggcattcccgcgcgttcatcggttgtatccttgtgccgtatagtcctctagagaaaactcaaggtgtgcgtgcgcccttacctcaaaaaaaaaaaaaggtgtgcgtgcgcccctcatggcccgcattgtaaaggaaaccactctttttccttcttaatgcaatgataagcagctctcctgcgtattatc

SEQ ID NO: 29727 - protein, 342 aa, Panicum virgatum
  misc_feature: Ceres CLONE 1893076
  misc_feature (125)..(336): Pfam Name: Pkinase Pfam Description: Protein kinase domain
  misc_feature: SWISSPROT Homolog: EC 2.7.11.1 Non-specific serine/threonine protein kinase
MVDRTRAALIGVTAGVAAAVLAAACVLLAIWLHRRRASVAARTRSVESPSATLRADGDRCASLDSSASVSVVSESVADWGHPPPAKRAAFWAWRGGAGHNGREPPPLTVSGIPKYHYKDLQKATSNFTTILGQGSFGPVYKAVMATGEVVAVKVLASDSRQGEREFQTEVALLSRLHHRNLVNLVGYCVEKGQRILIYEYMSNGSLARLLYGDNKRSLSWQERLQIAHDISHGIEYLHEGAVPPVIHRDLKSDNILLDHSMRAKVADFGLSKEEVYDGRKSGLKGTYGYMDPDYMSTNKLTKKSDVYSFGIILFELITAINPQQGLMDYINLVSHFNVTESP

SEQ ID NO: 29728 - DNA, 1391 bp, Panicum virgatum
  misc_feature: Ceres CLONE 1893078
  misc_feature: Encodes the peptide sequence at SEQ ID NO. 29729
tttttattcagttcttctaattcatgttttgtatgctgctgatacagagtagcatcatatagtcttttttttaggggggggggagtagcatcatatagtctggacaatttaattgttccgctaatgcttagttatgaaattacacttgctttggtttggcagtcgaaactctcagtatcagggaaggatttttggttgacacttatagccaggcgctcgcgccattttgctggaacaagattcttgaaacgaggtgttaatgaaaagggcagggtcgccaatgatgttgagactgaacagattgtttttgaagacacatctgatggaatcccaagtcagatggcttctgttgtacaacatagaggatcaatacctcttgtctggtttcaggaaacttcaagacttaatattagaccagatatcatattaaaacccgatgtggactacaaggcaacccgccttcattttgagaaccttgcacttagatatgggaatccgataatcatcttgaacttaataaagacccgtgagaagaagcctcgtgaatctttgctccgtgcagaatttgcaaaggctatccattacattaataaggggctaacagaggacaaacgtctaaaatttttacacatggatctgagtaagctttctcgaaggaaaggcaccaatgtgcttgcactgttgaacaaggtggcatccgatgtgttggatctaactgaattcctccactgcgaaataagtacatcagcaaaatctgaggatgccccaagtggcgaaagaaccgttgccaaaccaagtgatgacaaatgtagcagtgatcaaagcgaatgcatagctaagttggtacctcttttgttacagaagggtgtcctcaggacaaattgcatagactgcttggaccgcacaaatgttgcacaatttgcatacggtttagctgctttagggcgtcaacttcatgctctggggcttattgaatcacctaaaattgaattgcatgctcctctggctgatgatctgatggatttctatgaacggatgggtgatacattagctattcaatatggtggttctgccgctcacaacaagatcttctgtgagcaaagaggccagtggaaggcagcaacccaatctcaggagttccttcgaaccctgcaacgctactacaataacgcctacactgataacgacaagcaggatgctataaacgtgtaagcttctcaatatattgcaaaataatataccggtaggaatgacagaaccagtgggaagcatcgacatttatgtgttatatttgtgcttaccataaaatggtttgcctgtcgtaaaaaatgcagattcttagggcattttcaacctcaacaagggaaacctgcattgtggaagctggactc

SEQ ID NO: 29729 - protein, 362 aa, Panicum virgatum
  misc_feature: Ceres CLONE 1893078
  misc_feature (1)..(184): Pfam Name: Syja_N Pfam Description: SacI homology domain
  misc_feature: SWISSPROT Homolog: EC 3.1.3.36 Phosphoinositide 5-phosphatase
MLSYEITLALVWQSKLSVSGKDFWLTLIARRSRHFAGTRFLKRGVNEKGRVANDVETEQIVFEDTSDGIPSQMASVVQHRGSIPLVWFQETSRLNIRPDIILKPDVDYKATRLHFENLALRYGNPIIILNLIKTREKKPRESLLRAEFAKAIHYINKGLTEDKRLKFLHMDLSKLSRRKGTNVLALLNKVASDVLDLTEFLHCEISTSAKSEDAPSGERTVAKPSDDKCSSDQSECIAKLVPLLLQKGVLRTNCIDCLDRTNVAQFAYGLAALGRQLHALGLIESPKIELHAPLADDLMDFYERMGDTLAIQYGGSAAHNKIFCEQRGQWKAATQSQEFLRTLQRYYNNAYTDNDKQDAINV

SEQ ID NO: 29730 - DNA, 721 bp, Panicum virgatum
  misc_feature: Ceres CLONE 1893078-R
tggcactgtgcctggaggaaggcacttcatgtcagaagagcggcagaattatttgaaaagattaggttaccctgagttacattcttcgaatttccttgatcttgatttgctgtcatcttcggggaattcctgcgatgaggaggttttcgagaggtcatcactgatcaattcgcctatggatgagatcagtgttgaatcatctacatcatacagcgaacaaggacatgtcgatgagggaagggatgacacggatctgtctcgctcaagcagccagctctcagacactagggactattctgaccgctttgcgcactgggtcgctaatggaggcatgctttgctactaggtggttatctttttgtcttggtgactgtagaaattttgatgcagcaggaaatggctgacaactagatcagatcaaacggctgactgctaggcgcatctgcctgcgcaagaagcgagactgaagagatggcggtgatgggagaagcttcgcaccatcgtggttgtgatcacttgaaggcttgatgacgtcgataatcagacgagcagatgttggtggctggggtgggtacagaattcaatttgctatggtgaagaatttgaccatagtttagacaataaataggccaaaggatatctgattcttttagcttagcttacctttttcccccctttctccatagaaattatcaaaagaaaaaaggaaaaaaatcatact

SEQ ID NO: 29731 - DNA, 616 bp, Panicum virgatum
  misc_feature: Ceres CLONE 1893084
  misc_feature: Encodes the peptide sequence at SEQ ID NO. 29732
ccccttcttccgaaacacactcgcgccgtcacgcttcaccctagtccctcccaaatggcggcggccaccaccacccacctcgccgtcgcccgcaaaaccctaaaccacgccccctccggagccccaggcgccgcggccggctccgtctccttccccgccgcgcaggccccatgccgcctcgccgcctccgcgggctgccgccgcaccgtggccgcgaaggtcgcgtcgccgtcggtcgtcggcaccgccatgccgtcgctcgacttcgagacctccgtcttcaagaaggagaaggtgtccctggcgggccatgaggagtatattgtcaggggtgggagggatctgttcccgctgctgccggaggcgttcaaggggatcaaacagattggcgtcattggctggggctcgcagggtcctgcacaagctcagaacttgagggactcacttgttgaggcaaagtcagacattgttgttaagattggtctccggaaaggttctaaatctttcgaagaagcccgtgcagctggatacactgaagagagtgggactctgggtgatatatgggagactatatcaggcagtgatcttgtattgcttctgatatccgattctgctc

SEQ ID NO: 29732 - protein, 187 aa, Panicum virgatum
  misc_feature: Ceres CLONE 1893084
  misc_feature: SWISSPROT Homolog: EC 1.1.1.86 Ketol-acid reductoisomerase
MAAATTTHLAVARKTLNHAPSGAPGAAAGSVSFPAAQAPCRLAASAGCRRTVAAKVASPSVVGTAMPSLDFETSVFKKEKVSLAGHEEYIVRGGRDLFPLLPEAFKGIKQIGVIGWGSQGPAQAQNLRDSLVEAKSDIVVKIGLRKGSKSFEEARAAGYTEESGTLGDIWETISGSDLVLLLISDSA

SEQ ID NO: 29733 - DNA, 2349 bp, Panicum virgatum
  misc_feature: Ceres CLONE 1893131
  misc_feature: Encodes the peptide sequence at SEQ ID NO. 29734
attttcccccggccgccgtcttgggcatatatcccggcctctcggcggcgtgccgccagcaaccccagaagtaggaggcagccccctcgatttaagcccaattcgtgggggggacgaggggggcatcggggcgttccgattgccacgccgcccaaatctgcctgcatcctcgccggcgcacacagcttcgtgcgatcgcctcgtgatctcttctaggatgggggaaggggcgaaggcgctgctggccaagccgatccagctcgcggaccaggtggcgcagcaggcggggtaccagtgcctccggacggactgcacggagctgcgggcccgcgccaaggacctcgccgacctgctgcggcaggcggcgcgggccgacctgtacgagcgccccgccgcgcgcgtcatggccgacaccgagcgggcgctcgccaaggccgcgggcatggccgcccgctgcttccagagccactcccgcatccgccgcttcttcacgctcaacccggtgtcgggcctcccgcgcaccatcgccttgctcgacaccgcgctcgaggacatcgactggctcatccgcatctcgtccccgcaggccgacgacgacggcgacctccggggcctcccgaacatcgcgcagaacgagcccgtgctcgccctgatctgggacaacatcgcgcggctccaaaccggcgggctcgccgcgcgggccgacgccgccgccacgctcgcctccctcgcccgcgacaactcccactacgccaagtacatcatcgaggaggacggcgtcccgcccctcgtcaagctgctcaaggatggcaccgacgacggccaggaggccgccgccacggcgctcggcctcctctgccgcgacgaggagagcgtcgagaagcttctccacaccggggtctgctccgtcttcgccgccgcgctcaaggagccaccgatgcgcgtgcaggctgcggtcgcggacgccatcgcgtcgctcgcgcagcacagccacaaatgccaggagctcttcgcgcagaactacgccgttcggcacctcgtcagccacctcgccgccggaaccatccaggagcacagcaagtactctgtcggagggtacggctcaaggagcgcccctaccgcggcggcgcccatgacgtcgctcgacaagctccactccgttgtgctcgccaaatcgcgcagcgtgcgacaaggagggcctgcaggttcctccacaaatgagccgccgaacccatcggaagcttcgaatggccagcagcagcagcgaggaagatcgaaccagatgcaatcggtggtgaaatccgcgatagctgccaagacgacgccaaacgtagtcgcgcctccacctggtaggcctcagctcaactccaacggttcgagcggccgcggatcacgcgaggccgaggacccggccaccaaggcgcacatgaaggccacggcggcgaaggctctgtggatgctcgcgcgcggccatgtgggagtctgcaccagcattacggactcgcgcgcgctcctctgcttcgccaggatcctcgagaacggcgacggcggcgcgggcacgcacctgcagttctactcggccatggcgatcatggagatcacccgcgtcgccgagcacaacctcgctctgcggcagtccgcgttcaagcccagctccccggctgccaaggccgtcgtcgagcagctcctccgcatcgtgcgcaagggagacgacaacgacctgctgcggccgtgcatcactgccctgggctgcctgtcccgcacgttcaccgcgagcgagacccgcgtgatcggcccgctggtggagctgctcgacgaccgcgagattccggtaacgaaggaggccgtggtcgcgctcaccaagttcgcctgcaccgagaaccacctccacgtgaaccattgcaaggccatcgtggaagccggcggggcgcggcacctcgtccagctcgtctacctcggagaccacctgcaggtcgaggcgctcatactgctctgctacattgcgctgcacgtcccggagagcgaagagctcgcgcaggccggggttctcgccgtgctcctgtgggcgtcgaagcaggcacacatggcgcaggacctgcgtgttgaggcactgctgccgaacgccaaggctcggttggatctcttccagtccagggcatccagatgatggttgccgcaatcaccggtggagatgaactagttcatcttgcatttacagaaacaaattagatttgtgtctactttcaagttcctattattagagtgtacatatcgcggttcttctttgtctcaagaaaatgttgatgtaatcaattaatggatcatctcccaaggaattcatgttgctcg

SEQ ID NO: 29734 - protein, 649 aa, Panicum virgatum
  misc_feature: Ceres CLONE 1893131
  misc_feature (175)..(215): Pfam Name: Arm Pfam Description: Armadillo/beta-catenin-like repeat
MGEGAKALLAKPIQLADQVAQQAGYQCLRTDCTELRARAKDLADLLRQAARADLYERPAARVMADTERALAKAAGMAARCFQSHSRIRRFFTLNPVSGLPRTIALLDTALEDIDWLIRISSPQADDDGDLRGLPNIAQNEPVLALIWDNIARLQTGGLAARADAAATLASLARDNSHYAKYIIEEDGVPPLVKLLKDGTDDGQEAAATALGLLCRDEESVEKLLHTGVCSVFAAALKEPPMRVQAAVADAIASLAQHSHKCQELFAQNYAVRHLVSHLAAGTIQEHSKYSVGGYGSRSAPTAAAPMTSLDKLHSVVLAKSRSVRQGGPAGSSTNEPPNPSEASNGQQQQRGRSNQMQSVVKSAIAAKTTPNVVAPPPGRPQLNSNGSSGRGSREAEDPATKAHMKATAAKALWMLARGHVGVCTSITDSRALLCFARILENGDGGAGTHLQFYSAMAIMEITRVAEHNLALRQSAFKPSSPAAKAVVEQLLRIVRKGDDNDLLRPCITALGCLSRTFTASETRVIGPLVELLDDREIPVTKEAVVALTKFACTENHLHVNHCKAIVEAGGARHLVQLVYLGDHLQVEALILLCYIALHVPESEELAQAGVLAVLLWASKQAHMAQDLRVEALLPNAKARLDLFQSRASR

SEQ ID NO: 29735 - DNA, 608 bp, Panicum virgatum
  misc_feature: Ceres CLONE 1893149
  misc_feature: Encodes the peptide sequence at SEQ ID NO. 29736
gaaccgcatcgctcgccgcgccgccgccgctcctaaaccccagacgcaaaccccgctcatctccctcgcgccagcaacacctcctcccgcgccgccacgaggggcagcagcagcgcgcacgcgtgcgagagggagctgggatgggaggcgggcggaagcgcgggcgcacgcagcgccgccactttaagcagggccgcgagaacgtctggaagcacaacccccagcgccctcccgccggcgaaggaggcgaggggaatccctcgtggcagcccttcaccaccgagaacccggccttcgaggagtactacaaggagcagcaaattattcctgaggaagagtgggatgatttcatgagtatgctccgaaagccattaccttccacctttaggattaatgcgagctgtcagttttttcaagatatctgctcacaattggaaaacgacttcagaaaatcattagagactgaggtaagtgatgagcatgaagaagatgctattcggcctttgccttggtaccctggtaatcttgcatggcatttgaacttttcccgaatgcagctgaggagaaaccaggcacttgagagttttcatgaattcttgaagcgagag

SEQ ID NO: 29736 - protein, 155 aa, Panicum virgatum
  misc_feature: Ceres CLONE 1893149
  misc_feature: SWISSPROT Homolog: EC 2.1.1.29 tRNA (cytosine-5-)-methyltransferase
MGGGRKRGRTQRRHFKQGRENVWKHNPQRPPAGEGGEGNPSWQPFTTENPAFEEYYKEQQIIPEEEWDDFMSMLRKPLPSTFRINASCQFFQDICSQLENDFRKSLETEVSDEHEEDAIRPLPWYPGNLAWHLNFSRMQLRRNQALESFHEFLKR

SEQ ID NO: 29737 - DNA, 664 bp, Panicum virgatum
  misc_feature: Ceres CLONE 1893162
  misc_feature: Encodes the peptide sequence at SEQ ID NO. 29738
gcccagcgctgcgtcattcacttcaccaatggcctccgccggcggcgccgcgctcgccgccctcgcgctcctcgtcctcctcccagtcgccgcggcctccgactccgaccacaagtaccaagcagatgagcccgtgacgctctgggtgaacaaggttggcccgtacaacaacccgcaggagacgtacaactactacagcctcccgttctgccatgcaacagaaaaccatgtgcacaagtggggagggcttggcgaggtcctcggtgggaatgaactcatcgacagccagattgacataaagttcaggaagaatgttgacaagggcaccatttgttctcttgatcttgatcctgacaaggccaagcaattatcagatgcgattgaaaactcatattggttcgaattcttcatcgatgatttgcctctgtggggttttgttggagaggcagacagaaacaatgataacaaatatttccttttcacccacaagaatattgtcatcagatacaatggcaatcagattatccatgttaatcttacccaagaaagtccaaagcttattgatgcgaataaggcaatggacatgacatattctgtcaagtgggaaccaacgaacataacatttgctcatcgctttgatgtgtacctggactatcctttcttt

SEQ ID NO: 29738 - protein, 211 aa, Panicum virgatum
  misc_feature: Ceres CLONE 1893162
  misc_feature (51)..(211): Pfam Name: EMP70 Pfam Description: Endomembrane protein 70
MASAGGAALAALALLVLLPVAAASDSDHKYQADEPVTLWVNKVGPYNNPQETYNYYSLPFCHATENHVHKWGGLGEVLGGNELIDSQIDIKFRKNVDKGTICSLDLDPDKAKQLSDAIENSYWFEFFIDDLPLWGFVGEADRNNDNKYFLFTHKNIVIRYNGNQIIHVNLTQESPKLIDANKAMDMTYSVKWEPTNITFAHRFDVYLDYPF

SEQ ID NO: 29739 - DNA, 755 bp, Panicum virgatum
  misc_feature: Ceres CLONE 1893176-R
  misc_feature: Encodes the peptide sequence at SEQ ID NO. 29740
cgccgtggaatgggccggccccggcggcaagcagccgctgacatggcacaaggccttgttcaacgcgccggcagggagcgcgccggtggcgctggacatggggagcatgggcaagggccaggtgtgggtgaacgggcgccacgccgggcggtactggtcgtaccgcgccggcggcggctgcgggcggtgcgggtacgccgggacgtaccgcgagggccggtgcctgtccggctgcggcgagccctcccagcggtggtaccacgtgccgcggtcgtggctgaagccgagcgggaacctgctggtggtgctggaggagtacggcggcgacctcgccggcgtcgccctcgccacgcggaccgcatgagcgttccaccatcgtgtatctgatcgactcgtacataccatgacgaggagcaagccaaccacgcggtatttgtggacggtatttatacacaccacaccgtacactgaaaaactacagcaacggtatacagcaaggtagaggatggcatttatgtgcggagaggcttggtggtcgctggccggccatcagtgcggcggcaggaatggccgctgcaccggcacacacttcgagctccctcccaattcaattggattttttttcgattttatttctttctgtgtttagatccgtaaaatgttggtaaaaagagttacatcggacactgtagtacactgtaacatttttcatttgtttgtgataattgttgtcctaccatgacctaactaggctc

SEQ ID NO: 29740 - protein, 120 aa, Panicum virgatum
  misc_feature: Ceres CLONE 1893176-R
  misc_feature: SWISSPROT Homolog: EC 3.2.1.23 Beta-galactosidase
  misc_feature: The sequence is a functional homolog of SEQ ID NO 2 in US patent 7084321
  misc_feature: Functional homolog of the protein sequence given in SEQ ID NO 51151
  misc_feature: Useful for making plants with altered cell wall content and/or composition
  misc_feature: Functional homolog of the protein sequence given in SEQ ID NO 51319
  misc_feature: Useful for making plants with altered carbohydrate content
AVEWAGPGGKQPLTWHKALFNAPAGSAPVALDMGSMGKGQVWVNGRHAGRYWSYRAGGGCGRCGYAGTYREGRCLSGCGEPSQRWYHVPRSWLKPSGNLLVVLEEYGGDLAGVALATRTA

SEQ ID NO: 29741 - DNA, 2203 bp, Panicum virgatum
  misc_feature: Ceres CLONE 1893176
tgcttctcttgttgactatttcccttcattccctcactagttaccctccaaacatttagaccctttgcttagaggtgggcttccattaaaatcttctaacgttggaagtccgtgccatcgaaacgtagaggtcctaaagaatccatcccttccccaatgagctaactcactaggcggtgaagcctaaccgatcaaatgaaccggtaaacacaaattgccaatgaaataggctttctttgtgagagaagtgagtcccggctctgataccaattgtaagaccgaatcgggtgctctagcctaagagggaaagagggtgaattaggcaatttaaaatttagacctatagcaccaattaaataacacaatattaaaataaaacatactatctatatgtgcaactaaggttgttctagtgtgaaacccctatctcaaaaagagtttagcaatctatagtctttcctatcaagatactactctatgaaaataaaggcaaacaagaattgctagtagaaatgtggaagcttaaagagcgggatagaaagaagcaaactcttgacgcgggtgtttattctgtggttcggttagccacaaaggcacacctatatctacgttgttgaagcactcactaagagtatcgcttctcggaaatcaagtctcttccgcggactcaaccacggttaccttgatcccgggttccactaaggagcttctccacaaaggatgtgggtctccacgtcccccgcacaaggatgtcgtcgccgctccagaccaagtcggagggtcgatgacgtgccggcgagctaccaagctccaaggggtcggcacaccaagatattttcttggttcaacaaagaaccacagcacaaagactcaaggcattgctttctcactcactaagagctaacctagcactaacactctaaaaaatgtgctaaggactaaaaatataatcactaagttcttggatggcttggagatattcttaggtgtggctgtgatgtttttgaactccaacaatcttcaaatggccggggaaacccatattagccaccaagtcgaactagccgttcagagccgttacccaactttctgcgtagcgtcggatagaccgacggtgggtcaccagatcatccggtcacactgagccacagggtagtcgttggggtctctgacagctaacgcaggagacaccggataaaccgatgggtaggcgtcggttcatccggtgagcgtcggatcatccggtgctgaaggaatctttctttgagttctttcttcgtgttttgctttgcttggcttttttacttcatccctagaatataataatgtttacttgacaaactcattagtcccattgattgtgttgttactcaatcaccaaaatcacaaaactatggcctaatgaggccattttccaaacagctggtcacaccagtactgccgttgcagtgaatgtagttctagctttggtgagtggtgaccacatttgcatgttctgaatctgatgcagtaccatggaggaacaaattttgggcgcacagctggtggcccctttatcgcaaccagctatgactatgacgccccgatcgacgaattcggtatgcttaggcaaccgaaatggggtcatctgagggacctgcatagggccatcaagcaggccgaacctgcattggtttctggtgatccgactatccaatcacttggaaactatgagaaggcatatgtcttcaagtcaaagaatggagcctgtgccgcattcctttcaaattaccacacaaattctgctgtgaaagtcaggttcagtgggcgtcactatgacctccctgcttggtccatcagcattctgcctgactgcagaactgcgatcttcaacactgcaacagtgaaggaaccaactctgctgccaaagatgaatcctgtgttacggttcgcatggcagtcctacagcgaggacacaaactcgctggacgacagcgctttcacaaaggatggcttagttgagcagctcagcttgacatgggacaagtcggactatctgtggtacaccacccaggtcaacattggtgcgaacgaacaattcctaaaatctggccagtggcctcagctcactgtctactccgctggacactcgatgcaagtgtttgtcaatgggagatcatacgaatctgtttacggcggctacgagaacccgaaactgacattc

SEQ ID NO: 29742 - DNA, 1840 bp, Panicum virgatum
  misc_feature: Ceres CLONE 1893184
  misc_feature: Encodes the peptide sequence at SEQ ID NO. 29743
aaagtaatctttcaaaaagaaaaagaaaaaagtgatattacttggagcggtgaaggttggccatgagcataaatcatgagagagcagtgtgataaatcagatgaggtgtcctctgctttccttttccttgagcatgaatcatccatccatcaggtgaccactaggttgaggaactggacagggaatcgaaaaggcatggctgggagtatagtaaaagtttccaaggtgtgcctgaagcataattaacaataatggaggccacatgccttcaatgctattcaaggataatttagccacccagatgattcgatgttgattttccattggcagacacttaagattgtgctatcctgttcgtggttatttagctccatttatcactggcatacaatatacatacggctttgaacccacaggagctgtcaaatccagaggtcgcactccagcgaacgtaagatcctagaagcaatttttgcacaaaagaaataaaaaaataaaaagaacaaagtaacataaacactgatttaattcatcttccctatgatactttgggagagcatgagcacagccggcttcggcgcggacgatgttcaagacttgaagcaacacttttttcgcacaaatctatgacgcgtattgacatccaagaattcgatcttgttgccacggcaaaacagttggagacatgtctggagaagtcgtcgagctgggcagcggtgtgaccaacctcaaaccaggcgacaaggtcatctccatcagcttcccggtaacattctcaattcaaatttccaattactactgccttgcagagttctgttcccctcgagcagtgatgaacttgtgcatctcttctgacagtaagaaacaacgattttaatttgttaggctaattgtatatagtaagtgcattgcctgactaattaacacgttcatgaatcatttcccatgcatcccaccttggaagaatggcggcgggctcgcggagtacgcggtggcgccggcgtcgcttacggtggcacggccgccggaggtgtccgcggccgaaggcgcctctctgccgacggctgcgtccaccgcgctccagcagctgaaggccgcgggcgtcagcagcttcgacgggtccggcggcggcagcaacggcccccggaacgtgctggtcaccgcggcctccggcggcgtcggccactacgccgtgcagctggccaagctggcggggctccacgtgacggccacctgcggcgcgcgcaacctgggcctcgtccggggcctgggcgctgacgaggcgctggactacaagacccccgagggcgccaggctgcggagcccctccggccggaagtacgacgcggtgatgcactgcgcgacgggcaccccgtggtcggtgttcgcgccggtgctggccggcgaggccacggtcgtcgacgtgacgcccgggatcgccgccgccgccaggtcgttcctgcagaaggtgacgctggccaagcagaggctggtgccgctgctcctggtgcccaggaaggaggagatggagtggctggcggacatgacgcggcaggggaagctcaggacggtggtcgattccaggtacccgttgagccgggcgcaggaggcgtgggccaagagcatcggagggcacgccaccggcaagatcgtcgtggaaatgggaggcgaggagtgagccggccgggcggcgtgcgtgcgtgcacggcgatctgtgtgacagcattgtgtcgtcgtggtgttgtatgcggtctgtctgattggatttctagtgtgggaataattaagaaacaacaagttgtgctgggcactctgaaatcagattcaggatcaggtgatt

SEQ ID NO: 29743 - protein, 248 aa, Panicum virgatum
  misc_feature: Ceres CLONE 1893184
  misc_feature (70)..(207): Pfam Name: ADH_zinc_N Pfam Description: Zinc-binding dehydrogenase
  misc_feature: SWISSPROT Homolog: EC 1.1.1.1 Alcohol dehydrogenase
MNHFPCIPPWKNGGGLAEYAVAPASLTVARPPEVSAAEGASLPTAASTALQQLKAAGVSSFDGSGGGSNGPRNVLVTAASGGVGHYAVQLAKLAGLHVTATCGARNLGLVRGLGADEALDYKTPEGARLRSPSGRKYDAVMHCATGTPWSVFAPVLAGEATVVDVTPGIAAAARSFLQKVTLAKQRLVPLLLVPRKEEMEWLADMTRQGKLRTVVDSRYPLSRAQEAWAKSIGGHATGKIVVEMGGEE

SEQ ID NO: 29744 - DNA, 1337 bp, Panicum virgatum
  misc_feature: Ceres CLONE 1893190
  misc_feature: Encodes the peptide sequence at SEQ ID NO. 29745
gacttgaacagagccaacgtctcgtatataggccgagagaggagaggtctaccacgcgcgcgggcactaccgcgcaaaggggatcgagggggaggttatctatagagagtgagaggtgatggcctcggaggcggcggccaatgggagcctggccaacgagaaggcgccggagacggtgggcgtcggccggtacgtggagatggagcaggacggcgactccagcaccgtcaagtcgcgcctctccggcctgctctggcacggcggctcggcctacgacgcctggttcagctgcgcatccaaccaggtggctcaggtgctcctgaccctgccctactccttctcgcaactggggatggtgagcggcattctgttccagctcttctacggcctgatgggcagctggacggcgtatctcatcagcatcatgtacgtggagtaccggacccggaaggagagggagaaggccgacttcaggaaccatgtcatccagtggttcgaggtgctggacgggctgctcgggaagcactggcggaacgtcggcctggtcttcaactgcacgttcctgctcttcggctctgtcatccagctcatcgcctgcgcgagcaacatctactacatcaacgacaagctggacaagcggacgtggacctacatcttcggcgcctgctgcgccaccaccgtgttcatcccctccttccacaactaccggatctggtccttcctcggcctcgtcatgaccacctacaccgcctggtacctcgccatcgcctccctcatccacggccaggttgatggcgtgaagcattccgggccgaccaagatggtgctctacttcaccggtgccacgaacatcctctacaccttcggcgggcacgctgttaccgtggagatcatgcacgcgatgtggcgtccccagaagttcaaggcgatctacctgctggcgacgctgtacgtgctgacgctgacgctgccgtcggcggcgagcgtgtactgggcgttcggcgacgagctgctgacccactccaacgcgctggcgctgctcccgcgcacggcgttccgcgacgccgccgtcgtgcttatgctcgtccaccagttcatcaccttcggcttcgcctgcacgccgctctacttcgtgtgggagaagctcgtcggcctccacgactgccgcagcctctgcaagcgcgccgccgcgcgcctccccgtcgtcgtgcccatctggttcctcgccatcatcttccccttcttcgggcccatcaactccgccgtcggatccctcctcgtcagcttcaccgtctacatcatcccggcgctcgcgcacatgatcaccttccgctccg

SEQ ID NO: 29745 - protein, 406 aa, Panicum virgatum
  misc_feature: Ceres CLONE 1893190
  misc_feature (47)..(406): Pfam Name: Aa_trans Pfam Description: Transmembrane amino acid transporter protein
MASEAAANGSLANEKAPETVGVGRYVEMEQDGDSSTVKSRLSGLLWHGGSAYDAWFSCASNQVAQVLLTLPYSFSQLGMVSGILFQLFYGLMGSWTAYLISIMYVEYRTRKEREKADFRNHVIQWFEVLDGLLGKHWRNVGLVFNCTFLLFGSVIQLIACASNIYYINDKLDKRTWTYIFGACCATTVFIPSFHNYRIWSFLGLVMTTYTAWYLAIASLIHGQVDGVKHSGPTKMVLYFTGATNILYTFGGHAVTVEIMHAMWRPQKFKAIYLLATLYVLTLTLPSAASVYWAFGDELLTHSNALALLPRTAFRDAAVVLMLVHQFITFGFACTPLYFVWEKLVGLHDCRSLCKRAAARLPVVVPIWFLAIIFPFFGPINSAVGSLLVSFTVYIIPALAHMITFRS

SEQ ID NO: 29746 - DNA, 644 bp, Panicum virgatum
  misc_feature: Ceres CLONE 1893190-R
ctccgcaaccgcccgtgagaacgcggtggagcctccgccgcggctggtggggcggtggacggggacgtacatcatcaacgcgttcgtggtggcgtgggtgctggtggtcggcttcggcttcggcggctgggccagcatgaccaacttcgtgcgccagatcgacaccttcggcctcttcaccaagtgctaccagtgcccgccgccgccgcccctcgcgttccccggcggcctcagcaacatcaccatgccgttcgccggcgggcacccgccggccgcggcccctgcgccggcgcattccctccaccaccaccaccggcatcacagccacgggctctgaactctgaaaagagacgatcagccaggctgctacctgggcatgaccctgcttcagttccagctaatccagtacttagcctagcttaattagcagcaccagcactttcgtggtcgcagacttgtctagctttgtcgctcgctttcccgggttcagtgactacaggaaggctgacgagggtgtatcactgtaccagtagcatggagtctcttgtgttccgagctgtgtcctggcgtggagctcaaaaaagaggaatatttctacggccgcagatgccaatgcaagtctggctgcctgctgctttctctcg

SEQ ID NO: 29747 - DNA, 1834 bp, Panicum virgatum
  misc_feature: Ceres CLONE 1893195
  misc_feature: Encodes the peptide sequence at SEQ ID NO. 29748
attcccgatccccgccctgcgccgcgcctcttcctcgcgctccggtcgcggcctctacctcccttggcacccgccgcctgccatcctctccccgagaaggatctgcaccgcctccaccgattcccgtgctgtgcgccgcccgccctgaatcgcgtcgccccgtgccgccgctccccctcatccgcgccgccgccgcccctgccctctcccgccccgctgcagcccgttccctctccctgcacccctcccatccctgtcccgcggcccctgctgcccgttccctcaccctgcgcctcccctggccactccctgcgccgcccctgccgtctgccgccgccgtgacccccctgccctgtcccgccgcccctgcagcccgttgcctctccctgctgcaggccctgccctctccgcccctgctgcctctgcattgctgtgcgccgctgcctccccttttgtcattcaggagctaaaagtgaggtccagataagcgggaacaaacaaacagggccctcgtcatccctcgaagaagaggaacacgtcacggcaagtgtctacccctccggcggagatccatcccagcggccacccgcttggttgaggcccctcctgaggcttcccctcccggtgtgcagcgaagccctgcgaggaccccttctcgcgtgtgtccacgatcggcgttcctcccacagatccttctatttggcgaaataagtttatgttgatttgtgaatacgatttgtgatacctagagttgtgcagttattttgtttcagtttctgttcacagcgtcagatcagtttaatttttttcctgaaaagcagatcaatttaattgggtagcgcagaaaatttgggctttggcagaacaggataatttgaagttcgttctgtctctggtgtctggtggtactgtttcatttgttagtacgcctaatttttgtgatggaaagtgtacctaatgcttgtgattggaatattggaggcaagtggagtgatcaaagttggttttcccgtatggcatgttcccctcatgttttcctatggtgaaatattgctgacatcaacatgttatggtgctatcaatgttgccttgaacttatccagaaattatgttttctgacctgtttgagtggaaaacattattatatatgtgattccgttaggaccttgcttttgctgcttgttcttggaggagggtttgccgaggaagccgcagctagttagccatgtcgtcctctgtgctgagggctgtggccgacagggccatccggaggcaggccctcacgctgacggatgccgcagcgtccaggatccggcagctcctcagcctcaggcagcggccgtacctgcggctcggcgtcaaagcccgaggctgcaacggcctctcatacacgctcaactacgccgatgagaaggggaagtttgatgagcttgtcgaggagaaaggggttaaagtgcttatcgaccccaaggcattaatgcatgttattggcaccaagatggactatgttgatgatccactgaagtccgagtttgtgttcataaacccaaattccaaaggggagtgcggctgcggtgaatcctttatgactactagcagcaaagggtccacatcatgatgtgttttgcgttgtaaatgcataaaggcctcggctactgattttgttgggtctgttgtgttgcaaccttgttgggtctgcagctatttgtttctgttttgtctcctacttcccccattttttcatagatctgctagaacagatgaagattgtggggtttgcaccttgtactcctttgatagcttgaatctccattttgagcgatttttgtgccgg

SEQ ID NO: 29748 - protein, 130 aa, Panicum virgatum
  misc_feature: Ceres CLONE 1893195
  misc_feature (19)..(108): Pfam Name: Fe-S_biosyn Pfam Description: Iron-sulphur cluster biosynthesis
MSSSVLRAVADRAIRRQALTLTDAAASRIRQLLSLRQRPYLRLGVKARGCNGLSYTLNYADEKGKFDELVEEKGVKVLIDPKALMHVIGTKMDYVDDPLKSEFVFINPNSKGECGCGESFMTTSSKGSTS

SEQ ID NO: 29749 - DNA, 1076 bp, Panicum virgatum
  misc_feature: Ceres CLONE 1893219
  misc_feature: Encodes the peptide sequence at SEQ ID NO. 29750
tcgcctcgcctcacttgcttcttccactctttccaccaccacccatccctctctctctctctctctctcctcccggcccggcccttctctctctttctctctatacgcggatcaccggacggaggcaagctagctaccacctcgaccgaccggcggccgatctgtgctgtgaacaagtcaggaagctagctcgcggagatacatggctggcgcggggggtgcgacggcggtgcagcagccggcggcgggggctccgccggctggggcgaggagtggtgccggcgccggcgccggcgcggcgggggccccggtcgccgacccgcgcgccgaggcgctgcggtgcccgcgctgcgactcggccaacaccaagttctgctactacaacaactactcgctgtcgcagccgcggcacttctgcaaggcgtgcaagcgctactggacgcgcgggggcacgctccgcaacgtccccgtcggcgggggctgccgcaagaacaagcgctccaggagcagcagcgcggcgggcgccgccgggaggagcggatcctcctccgccgcggccgccgtcacgtcctcctcggcggcgtccacgctgcccctgccgccgccggcggggtccctgccgtcgctcacgtccgcgctcggcctgcccgggggcacctcgctggcgtcgctgctactcggcagcggcaccgacggcgaccacctcggcctcttccaggcggccatgcagtcggttgtctcctcggaggcaaccgcctacgagatgcagcagcagcagacacaggtggaccacctgctgggcctcggctacgggggcgccggcgccggcgcgcagatccagcagctcaagccgtggatgcacgaggccggggcgggcgcgggtgggatcatggacagcttctacgcgccgctgctctccagctccctcgtgccggggctggaggagctgcacgtcaaggcggaggccgccggcgccggggaccaccagcagaaggcggcgcccggggaccagcagaacggcagctgggagctgccgacgccgtcgccgtccaacgtcgacgcaagcatcatcgcgt

SEQ ID NO: 29750 - protein, 291 aa, Panicum virgatum
  misc_feature: Ceres CLONE 1893219
  misc_feature (40)..(102): Pfam Name: zf-Dof Pfam Description: Dof domain, zinc finger
MAGAGGATAVQQPAAGAPPAGARSGAGAGAGAAGAPVADPRAEALRCPRCDSANTKFCYYNNYSLSQPRHFCKACKRYWTRGGTLRNVPVGGGCRKNKRSRSSSAAGAAGRSGSSSAAAAVTSSSAASTLPLPPPAGSLPSLTSALGLPGGTSLASLLLGSGTDGDHLGLFQAAMQSVVSSEATAYEMQQQQTQVDHLLGLGYGGAGAGAQIQQLKPWMHEAGAGAGGIMDSFYAPLLSSSLVPGLEELHVKAEAAGAGDHQQKAAPGDQQNGSWELPTPSPSNVDASIIA

SEQ ID NO: 29751 - DNA, 730 bp, Panicum virgatum
  misc_feature: Ceres CLONE 1893219-R
tgtgggggaaagctgagatgagagagagagcgctgtggaagaagagagatcatcatcatctcacctcatagggcagaaaattagacaaatcaaacaatgatccaatttttcaagaggatttcttcgccgagtcgaacgctgaatccatgatctttgccgtcgatggatgatcaaggtggtcggcaactagcatccatggatttaggaggaggaggagaccatgagaccatgggagagcaaagaagccaagaagtgtaagtgcagtgctgccacatgacactacttgatatttacgtcttcttggctagcttctccttgggtgttttgtacataggcggcatatggtgggggatacaatagctaaggtagcccgtgagagatacatcatggtgcaagtcatgagcctctctctctcatctcgacattttaaatcagtgtgttttaattggttactctcgctctctctttctctctaccatggattagggaagagctctctagatgtacaagttaatactagtacttttctacccttttgcagctgaattagagaactgtttttgagttctcatgcattagagagttgttaagggtacggtccatgcatcagcttcgttctctctttcttcctttctcttctagactggaattaatttctctttcttttggggagttttgttcaaacatggcttgtacgaattatgatgactttgtgagttatgagaaattt

SEQ ID NO: 29752 - DNA, 3238 bp, Panicum virgatum
  misc_feature: Ceres CLONE 1893220
  misc_feature: Encodes the peptide sequence at SEQ ID NO. 29753
aaatatacaaaatcccggctcaaactttttacacgcggacccccggcttcgccagaaatcgcctcggagcgggagatctcgcgggagggaccatccccggcggcgaggatgtccgccgcgaggcgcgcccacccgccgctgcagaacggcgcggggggagacgacggggacgacgagcgggacgaggaggaggaggacggcgacgaggaattggaggatgaggcggaggaggaggagccgcggctcaagtaccagcggctgggcgggagcgtgccggcgatcctctccaccgacgccgccgcgtccatcgccgtcgccgaccgcatggtcgcgctcggcacccacaacggcaccctccacatcctcgacttccagggcaatcaggtgaaggaaattgctgcccacacggcaactatcaatgacatcagttttgatgcagacggtgaatatataggcagttgctcagatgatggcacagtagcaataagcagcctcttcactgatgaaaaactgaagtttgagtaccatcgcccgatgaaagcaattgctctagaccctaattattcccggaactataggagatttgctactggtggattagcaggtcaagtacttgtgctgacaaagaaaacttggggtggttaccataagaaggttctgcgtgatggcgaagggccaatccattctatgaagtggagagcagacctgcttgcttgggctaataatgcaggggtgaaagtgcatgacatgaaaacagacaaaggaattgcattcatagagcgaccgaaaggcattcctcggccagaattcttacttccccacctagtatggcaggatgatacagttttagttattggatggggaacaagtgtcaagatcgcagcaattcgaacagatttatctcagggactcaatggcatacaaaggaccatcgccgcagtaggttctgagaagtatgtagatattgtgggttcattccaaacaggctaccacatatctgggattgctccttttggtgaccttttagttgtgcttgcctatattcccgacgaggatgaaaacgagaaaaaaattagtacttctgttactccacgacagggaactgcacagtgtccagaaattcatcttgtatcatggaagaatgatgaagttactacagatgctctgcctattcatggttatgaacattacaaggcaaaggattatgctcttgcgcatgcacctttctcaggaagtagcaatgccggagggcaatgggctgctggcgatgaacctctgtattacatcgtgtctcctaaggatattgtggtcacaaaaccaagagatgctgaagatcatattgcttggcttcttcaacatgattgtcatgaaaaagcattggctgctgttgaggcagggcaagggcggactgagcttcttgatgaggtgggttcaagatacctagaccacttgataattgaaagaaaatatgctgaagctgctcaacgctgtccaaagttgctgcgaggatctccttcagcatgggagagatgggtctttcactttgctcatctccggcaacttcctgttttggtcccttacatacctacagaaaatcctcagctgagtgatactgcatatgaggttacccttgttgctctaactaccaatccttctttccatgaacttctgctaaccactgtaaaaaattggccaccaacgttatactcagcttcacctgtcatatctgccattgagccacagctgaactcatcgttgatgactgatacattgaaagaggctttagctgaattgtatgtaatcaatagtcaacatgaaaaggcgctctccctgtatgctgaactcctgaagccagaagtatttgagtttattgagaagtacaacttgcatgatgccattcatgataaggtcgtcaatcttatgttactggatagtaaaagaactgttcacctactgatccaacatcgtgatatcattcccccatatgaagttgtggagcagttgctgcatagcaataaaactggtgacaagagatattttttgcacctatatttgcatgctctatttgagatagatatacatgctggaaaagattttcatgacatgcaggtggagctttatgcagactacgagccaaggatgctactacccttcctccgtactagtcagcattacaggcttgacaaggcatatgaaatctttgcacaaagggaacttgtaagggagcaggtttttgtccttggtcgaatgggcaatgctaaggaagctctttcaacaattataaacaaactggaagacattgaggaggctgttgaatttgttacggaccaacatgatgatgaactatgggaggaactgatcagacaatgcctccagaagcctgaaatggttgggatgctattggagcataccgttggcaatcttgatcctctgtacatagtcagtttggttcctgatgggttagaaatacctcggttgcgggatcggcttgtgaaaattgtaacggactaccggacagaaacttcgttgcgaaatggatgcaatgatatacttaaggctgactgtgtgaaccttttggttaaatactaccacgaggctcgacgtggagtttacatggcaagcatggacgaggaggtacatggaaacagagttgatgatggatcatcccgagcaagtgagaggtcatccagtgtccgggctctagatattaagtccagaacgagatgtggtgcccggtgttgcttatgcttcgatcctttgcccattcaggacatatccgtcattgtgttctactgctgccatgcatatcatctgtcttgcctggaaggtgggttagacttaatgagatcaaacagtaatcaagatagcgacaatgaatcagatgatgaggatggttccccatctggcgggtctcggatgcgctgtgtattgtgcactactgctgctgcataatttatacctcgttgggtagtccatactaccttgtgtgtgtgtgttgtaagtttttagccttgtaattattgtgttcttctggtgtgttttacaatgtacaatagcatgattctttgagggaagccatgtcctcggccagaggatttttgtgtaaatttgatgaaccaccatgagcaaagttgtgcggcattttcattttttgtaatgccacgtttgccagataatgaaaagtttattacaggatgcagaattgctcttcccgaaacttaaatagaagctatttcag

SEQ ID NO: 29753 - protein, 947 aa, Panicum virgatum
  misc_feature: Ceres CLONE 1893220
  misc_feature (90)..(128): Pfam Name: WD40 Pfam Description: WD domain, G-beta repeat
MSAARRAHPPLQNGAGGDDGDDERDEEEEDGDEELEDEAEEEEPRLKYQRLGGSVPAILSTDAAASIAVADRMVALGTHNGTLHILDFQGNQVKEIAAHTATINDISFDADGEYIGSCSDDGTVAISSLFTDEKLKFEYHRPMKAIALDPNYSRNYRRFATGGLAGQVLVLTKKTWGGYHKKVLRDGEGPIHSMKWRADLLAWANNAGVKVHDMKTDKGIAFIERPKGIPRPEFLLPHLVWQDDTVLVIGWGTSVKIAAIRTDLSQGLNGIQRTIAAVGSEKYVDIVGSFQTGYHISGIAPFGDLLVVLAYIPDEDENEKKISTSVTPRQGTAQCPEIHLVSWKNDEVTTDALPIHGYEHYKAKDYALAHAPFSGSSNAGGQWAAGDEPLYYIVSPKDIVVTKPRDAEDHIAWLLQHDCHEKALAAVEAGQGRTELLDEVGSRYLDHLIIERKYAEAAQRCPKLLRGSPSAWERWVFHFAHLRQLPVLVPYIPTENPQLSDTAYEVTLVALTTNPSFHELLLTTVKNWPPTLYSASPVISAIEPQLNSSLMTDTLKEALAELYVINSQHEKALSLYAELLKPEVFEFIEKYNLHDAIHDKVVNLMLLDSKRTVHLLIQHRDIIPPYEVVEQLLHSNKTGDKRYFLHLYLHALFEIDIHAGKDFHDMQVELYADYEPRMLLPFLRTSQHYRLDKAYEIFAQRELVREQVFVLGRMGNAKEALSTIINKLEDIEEAVEFVTDQHDDELWEELIRQCLQKPEMVGMLLEHTVGNLDPLYIVSLVPDGLEIPRLRDRLVKIVTDYRTETSLRNGCNDILKADCVNLLVKYYHEARRGVYMASMDEEVHGNRVDDGSSRASERSSSVRALDIKSRTRCGARCCLCFDPLPIQDISVIVFYCCHAYHLSCLEGGLDLMRSNSNQDSDNESDDEDGSPSGGSRMRCVLCTTAAA

SEQ ID NO: 29754 - DNA, 677 bp, Panicum virgatum
  misc_feature: Ceres CLONE 1893221
  misc_feature: Encodes the peptide sequence at SEQ ID NO. 29755
  misc_feature (556)..(556): n is a, c, t, g, unknown, or other
atggccctcatgctccgcccttgggcctttcttctcttccttgcactgctctcctacgatgaatctggtcttcagagcacgaggaatggagttgcacaggccacgcagagggtcttcctgtatccgcagtctcccaaggtctcctctattgtgagcaccaagtacaggactgcctaccacttccagcctcccaagaactggatcaacgatccaaatgggccaatgtactacaatggtatctatcaccaattctaccagtacaatccaaacggttcactctggggtaacatagtttggggccactcggtctcaacagatctcatcaactggatccggcttgagccagcaatagaacgaacaactccgagcgacataaacggttgttggactggttcagccacaatcctcaagggcggtcggcctgttatcatatacactggtgctgacacagagaagcgtcaagtccaaaacattgtgtttccaaagaacgtgtctgatccatacctgaaggaatggatcaaaccagacaacaaccccttgatccaaccagttggtncaggattgaactcagaccaatttagagatccgacaaccagttggattggaccagatgggctgtggagaatagcaattggggctgagctgaacggctacagtgcatcacttttgtacaagag

SEQ ID NO: 29755 - protein, 222 aa, Panicum virgatum
  misc_feature: Ceres CLONE 1893221
  misc_feature (57)..(222): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: Functional homolog of the protein sequence given in SEQ ID NO 51320
  misc_feature: Useful for making plants with altered carbohydrate content
  misc_feature: Functional homolog of the protein sequence given in SEQ ID NO 51321
  misc_feature: Useful for making plants with modulated biomass
  misc_feature (183)..(183): Xaa is any aa, unknown, or other
MLRPWAFLLFLALLSYDESGLQSTRNGVAQATQRVFLYPQSPKVSSIVSTKYRTAYHFQPPKNWINDPNGPMYYNGIYHQFYQYNPNGSLWGNIVWGHSVSTDLINWIRLEPAIERTTPSDINGCWTGSATILKGGRPVIIYTGADTEKRQVQNIVFPKNVSDPYLKEWIKPDNNPLIQPVGXGLNSDQFRDPTTSWIGPDGLWRIAIGAELNGYSASLLYK

SEQ ID NO: 29756 - DNA, 1929 bp, Panicum virgatum
  misc_feature: Ceres CLONE 1893261
  misc_feature: Encodes the peptide sequence at SEQ ID NO. 29757
cgcttcagtgagccagccagccagccagtaggcggagtgggcggcggcggcgagcggcgaggcggcgccggcccacattgtccggtgcgcgaagagctccggcggcggtggtggccatggctcgcctccgctgcctgttcgtgctcgcgctcctcctcgggcagctgcccggcgacgccgtcgccgggcgcgggcaccacggccccgccgcgcacgactaccgggacgcgctggccaagtccatcctcttcttcgagggccagcggtcgggccggctgccgccgtcgcagcgcatgtcctggcgccgggactccgggctgagcgacggcgccgcggccaaggtggacctcgtcggcgggtaccacgacgccggcgacaacgtcaagttcgggttcccgatggcgttcagcatgacgatgctggcgtggagcgtggtggagttcggcggcctcatgaaggccgagctgcagcacgccagggaggccgtccgctggggcgccgactacctgctcaaggccacggcgcacccggacaccatctacgtccaggttggcgacgccaccaaggaccacgcgtgctgggagcgcccggaggacatggacaccccccgcaccgtgtacaaggtggacgccggcacccccggctccgacgtggccgccgagacggccgccgcgctcgccgccgcctccctcgtcttccgcaaggccgacccggcctacgccggccgcctcctcgcccgcgccaagcgggtgttcgcgttcgccgacaggcaccggggctcctacagcacgggcctggcggcggacgtgtgcccctactactgctcctactccgggtaccaggacgagctcctgtggggcgcggcgtggctgcaccgcgccacccggagccccgcgtacctgggctacatccaggccaacggccaggtgctcggcgccggcgagggggacaacaccttcgggtgggacaacaagcacgccggcgcccgggtcctgatcgccaggtcgctcctggtgcagcgccagggcgccctgcgcgagtacagggcccacgccgacgccttcatctgctccatggtgcccggcacgccggcggaccagacgcagtacacccgcggcggcctgctgttcaagctcagcgacagcaacatgcagtacgtgacctccagcgccttcctcctgctcacctacgccaagtacctggccttcgcgaggcagacggtgagctgcggcggcggcggcggcgcggtggtgacgccgcagcggctgcgcgccatcgcgcggcggcaggtggactacctgctggggagcaacccggcggggatgtcgtacatggtcgggtacggggcgcggtacccgcggcgcgtgcaccaccgcgcgtcgtcgctgccgtcggtggtggcgcacccggggcggatcgggtgctcgcaggggttcgccgcgctctacgccggcggggccaacccgaacgtgctcgtcggcgccgtcgtggggggccccgacctgcaggacaggttccccgaccagcgcagcgaccacgagcactcggagccggccacctacatcaacgcgccgctcgtcggcgccctcgcctacctcgcgcactcctacggccagctctagctgcctgcctgccgatcaggctgtcgctcgatcgtcggagtattagtattgttctcgtcttgattgattgattagagtcggagttgatcgtggttggaggaggaccccagtgcaagcaaaaaacgaagggcgcttcgcttgtgggtcttgattggttgtgactacttaggtgttaagcacgccgtagtgtgattggtttaggtacgtgacgccgatggcgcacggatgtgatgtatgaatgtatcggggtgacaccaaaaatgtgtgctccaccccaagtgagtactactgctactgcaatggttgc

SEQ ID NO: 29757 - protein, 501 aa, Panicum virgatum
  misc_feature: Ceres CLONE 1893261
  misc_feature (34)..(492): Pfam Name: Glyco_hydro_9 Pfam Description: Glycosyl hydrolase family 9
  misc_feature: SWISSPROT Homolog: EC 3.2.1.4 Cellulase
  misc_feature: Functional homolog of the protein sequence given in SEQ ID NO 51322
  misc_feature: Useful for making plants with altered carbohydrate content
  misc_feature: Functional homolog of the protein sequence given in SEQ ID NO 51323
  misc_feature: Useful for biocontainment applications
  misc_feature: Useful for making plants with altered cell wall content and/or composition
  misc_feature: Useful for making plants with modulated nitrogen use efficiency
MARLRCLFVLALLLGQLPGDAVAGRGHHGPAAHDYRDALAKSILFFEGQRSGRLPPSQRMSWRRDSGLSDGAAAKVDLVGGYHDAGDNVKFGFPMAFSMTMLAWSVVEFGGLMKAELQHAREAVRWGADYLLKATAHPDTIYVQVGDATKDHACWERPEDMDTPRTVYKVDAGTPGSDVAAETAAALAAASLVFRKADPAYAGRLLARAKRVFAFADRHRGSYSTGLAADVCPYYCSYSGYQDELLWGAAWLHRATRSPAYLGYIQANGQVLGAGEGDNTFGWDNKHAGARVLIARSLLVQRQGALREYRAHADAFICSMVPGTPADQTQYTRGGLLFKLSDSNMQYVTSSAFLLLTYAKYLAFARQTVSCGGGGGAVVTPQRLRAIARRQVDYLLGSNPAGMSYMVGYGARYPRRVHHRASSLPSVVAHPGRIGCSQGFAALYAGGANPNVLVGAVVGGPDLQDRFPDQRSDHEHSEPATYINAPLVGALAYLAHSYGQL

SEQ ID NO: 29758 - DNA, 1289 bp, Panicum virgatum
  misc_feature: Ceres CLONE 1893279
  misc_feature: Encodes the peptide sequence at SEQ ID NO. 29759
atcatcgtcctcctgcatcaggaggtcctatagttaaaattacgtgttttaccactaacctaattaccctcctcacgcggaagcaaacactctgcttcaccatcttcgttgctttttttcttcatctcaaacttcatcaagcaagatgacggtgactccggtcatcacggtgagcgacgggaggctggcggtgtgcggccgcacggtgctcaccggcgtgccggacaacgtgtcggcggcgcacgcggccggggccgggctcgtcgagggggccttcgtcggcgcccacgccggcgaggccaagagccaccacgtcttcaccttcggcacgctgcgggactgccggttcctgtgcctgttccggttcaagctgtggtggatgacgcagcggatgggtgtctccggccgcgacgtcccgctcgagacccagttcatgctcgtcgaggtgccggcctccgccgacgacgacgccgccggcgctggcccggtgtacctggtgatgctgccgctgctggaggggcagttccgggcggcgctgcaggggaacgaccgcgacgagctgcagatctgcgtcgagagcggcgacaaggcggtgcagaccgaccagggcgcgcacatggtgtacctccacgccggcgacaaccccttcgacgccatcgccgccgccgtcagggcggtggagaagcacctgcagacgttccaccaccgggagaggaagaagctgccgtcgttcctcgactggttcggctggtgcacctgggacgccttctacaccgacgtcaccgccgacggcgtcaagcacggcctccagagcctggccaagggcggcgcgccgccgcggttcctcatcatcgacgacggctggcagcatatcgccgccgaggacaagcccgaccccagcgtcgccgtccaggagggagcgcagttcgcgagcaggctgacggggatcaaggagaacaccaagttccaggccaagcccaccgacggcgacggcgagccggcggcgggcgggctgaagcagctggtccgggagaccaaggacgcccacggcgtgaagcaggtgtacgtgtggcacgccatggcggggtactggggcggcgtggcgccgtcgccgggcacggggatggagcgctacgagccgtcgctggcgtacccggtgcagtcgccgggggtcaccggcaaccagccggacatcgtgatggactcgctgtcggtgctcgggctcgggctcgtgcccccgcgccgcgcccgggacttctacggcgagctccacgcgtacctggcctcct

SEQ ID NO: 29759 - protein, 381 aa, Panicum virgatum
  misc_feature: Ceres CLONE 1893279
  misc_feature (7)..(381): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
  misc_feature: Functional homolog of the protein sequence given in SEQ ID NO 50752
  misc_feature: Useful for making plants with altered carbohydrate content
MTVTPVITVSDGRLAVCGRTVLTGVPDNVSAAHAAGAGLVEGAFVGAHAGEAKSHHVFTFGTLRDCRFLCLFRFKLWWMTQRMGVSGRDVPLETQFMLVEVPASADDDAAGAGPVYLVMLPLLEGQFRAALQGNDRDELQICVESGDKAVQTDQGAHMVYLHAGDNPFDAIAAAVRAVEKHLQTFHHRERKKLPSFLDWFGWCTWDAFYTDVTADGVKHGLQSLAKGGAPPRFLIIDDGWQHIAAEDKPDPSVAVQEGAQFASRLTGIKENTKFQAKPTDGDGEPAAGGLKQLVRETKDAHGVKQVYVWHAMAGYWGGVAPSPGTGMERYEPSLAYPVQSPGVTGNQPDIVMDSLSVLGLGLVPPRRARDFYGELHAYLAS

SEQ ID NO: 29760 - DNA, 598 bp, Panicum virgatum
  misc_feature: Ceres CLONE 1893279-R
  misc_feature: Encodes the peptide sequence at SEQ ID NO. 29761
cgggcgggggaacttgttcggctgccccgcggcgccccgctgcccgtgaaactcggcccgcttgaattcgaagtgtttcaagtttgcccggttcgccgggccgccggcgttgggtttgcgcccgttggaattcttgacaagtttaaagccgggggggccgttgaggaattcgaagtgaaaaccggcgccccggtgaccgtggcggcgatgaaggtgggcgggtgcggccggtttggcgcctaatgcttggggcggccggggaagtgcgcgctggaattgggggaggtggagtttgggtaagaaggggacaaggggcttgttaccgttgacctgcccgttccggaacaggaactgtaccggtggacgctggaaatcacggtgtaggccgaaacggtgaacccggaagcttgttggatttttggggctttgccattggtgaagttcccgggaaattgggggaaaaaagagggtgattgtgaagtgccttgttgtatgattatcaatgtggggaatggggaaaagggaaaattgtatgctttgctaagccaatatgttatgttgtacggtgtaccctgtgaaatggaagttgtattgtacc

SEQ ID NO: 29761 - protein, 80 aa, Panicum virgatum
  misc_feature: Ceres CLONE 1893279-R
  misc_feature: SWISSPROT Homolog: EC 2.4.1.67 Galactinol--raffinose galactosyltransferase
RAGELVRLPRGAPLPVKLGPLEFEVFQVCPVRRAAGVGFAPVGILDKFKAGGAVEEFEVKTGAPVTVAAMKVGGCGRFGA

SEQ ID NO: 29762 - DNA, 1304 bp, Panicum virgatum
  misc_feature: Ceres CLONE 1893282
  misc_feature: Encodes the peptide sequence at SEQ ID NO. 29763
acacaagccacaaggggcactgggtgtgcagcgacgacctgtacgaggagtcgactggcggtggaggcggagttccaagaacccacgcgcgagaagtactcccaggtcgtcttctccctcgatcccatctcgtcaccccccccttctccgatccgatcggtcgcggagcgctgcgtttcccggctgcacaggtttcttgggggctttctttagaagcgattcgtttcccgggtctgccctcggattgatcaagaaatggaaaagcaaaccctgtttcccctgttcttcaggtcgtagttggcatctgtttctcggaacgtgcgatttctaccactccaaattgcagactccagatggcatttgggaactgtgcgagtgattgggtttaactacgaatctaggggacaccgtcatggcatacttcccagaggaagtggtggagcagatccttggctatgtaacctcgcacagggatcgcaacgccacgtcgctagtgtcccgggcatggtaccacattgagcgccgtagccgtcgctcggtgcttgtaagcaactgctatgcagtgcgcccagagcgtgtgcttgtgcggttccccagcatgcgctcgctgagcgtgaagggcaaaccacactttgctgacttcgaccttgtcccggcggggtggggcgccacggctgatgcatgggtggattcgtgtgcccgtgcgtgccctggccttgaggagctccggctgaagcggatggttgtgactgatgagtgcctcaagctgattgctggctcttttaccaactttaaatcacttgtccttgtcagctgcgaggggttcagcactgctggccttgctactatcgccaccaattgcaggtttcttaaggaactggacttacaagagagtgttgtgaaacctcgaggccatcattggcttaattgttttccaaagccttctacagaactagaatccttgaactttgcttgtttgtctggggaggtgaatgcttctgcattggagaggcttgttgcaaggagtccgaatcttaaaaggctaaggttgaatcgtgctgttccatttgatgttttgtacagaatacttggtcgcacacctaagctggaggatttaggcactggatcttttgtaagaggcaataaccctgccgcatatgtcagtttgttctctgctctcggaaagtgcagttcactaaagagtttatcaggtttttgggatgctacgggcttttttcttcgaggaattttttcagtctgcaagaaccttacatgcttgaacctcagctatgctccattgattc

SEQ ID NO: 29763 - protein, 297 aa, Panicum virgatum
  misc_feature: Ceres CLONE 1893282
  misc_feature: Functional homolog of the protein sequence given in SEQ ID NO 50502
  misc_feature: Useful for making plants with altered carbohydrate content
MAYFPEEVVEQILGYVTSHRDRNATSLVSRAWYHIERRSRRSVLVSNCYAVRPERVLVRFPSMRSLSVKGKPHFADFDLVPAGWGATADAWVDSCARACPGLEELRLKRMVVTDECLKLIAGSFTNFKSLVLVSCEGFSTAGLATIATNCRFLKELDLQESVVKPRGHHWLNCFPKPSTELESLNFACLSGEVNASALERLVARSPNLKRLRLNRAVPFDVLYRILGRTPKLEDLGTGSFVRGNNPAAYVSLFSALGKCSSLKSLSGFWDATGFFLRGIFSVCKNLTCLNLSYAPLI

SEQ ID NO: 29764 - DNA, 736 bp, Panicum virgatum
  misc_feature: Ceres CLONE 1893282-R
  misc_feature: Encodes the peptide sequence at SEQ ID NO. 29765
acagccactggatgaaggcttggttgcaatcgtccagtcatgcaaaggcccttaggcgtctctccatgtctggcctcctcacggactgcgtgttcctgtacatcggcatgtatgccgagaagctggagatgctctcagtggcatttgtggggggtagtgacgatggtatggtctacgtgcttaatggctgcaagaacctcaagaagctggagatcagggacagccccttcggcgacaccgccctccttgcaggagtggacaagtacgaggcgatgcgctcgctctggatgtcctcctgcaacatcaccctagggggctgcaagaccctagcggcgagcatgcctggtgtcaacgtggaggtcattaacgatgcgggagccagtatcgatgaagcggatgaggaatccagcaacgcgaagaaggtggagaagctgtatctctaccggacgatagctggaccccgtggtgatgcccctggattcgtctcaatattgtaagtgctgatgcccctggattcgtctcaatattgtaagtgctagtaccgtagcggctaaagatggttcttccctgaaccttgggttccggatgaactctgttctgaaccgtgtctaccgtagttttgctaccctgttttgctaccttgtagcgttaacttaaaccttggtgctttgtggacctttgcgcaggacatgtatgaccgtaactaatgtttatgtttatatgctggttggcactc

SEQ ID NO: 29765 - protein, 164 aa, Panicum virgatum
  misc_feature: Ceres CLONE 1893282-R
  misc_feature: Functional homolog of the protein sequence given in SEQ ID NO 50502
  misc_feature: Useful for making plants with altered carbohydrate content
SHWMKAWLQSSSHAKALRRLSMSGLLTDCVFLYIGMYAEKLEMLSVAFVGGSDDGMVYVLNGCKNLKKLEIRDSPFGDTALLAGVDKYEAMRSLWMSSCNITLGGCKTLAASMPGVNVEVINDAGASIDEADEESSNAKKVEKLYLYRTIAGPRGDAPGFVSIL

SEQ ID NO: 29766 - DNA, 626 bp, Panicum virgatum
  misc_feature: Ceres CLONE 1893288
  misc_feature: Encodes the peptide sequence at SEQ ID NO. 29767
aagtaacaccattgacccagaccagggccggcgctccaccatctcggctcctcttttattcgcagccatgtcgggcagcgcaaatggtgcctccgccggcgctgctcacgtcgtgatgctcccgtggctcgccttcgggcacatcaccccgttcgcgcagctggcacgcaaactggtctccgccgacggcggtggcgtccgcgtgacgttcctgacggccgccgggaacgtgccgcgcgtcgaggccatgctggcgccgtcggccgcgggcgcggtggtggttgtgccgctccacctgccccacgtcccggggctggacgcgggggcctccagcacggcggagctctccgccgacggcgccgagcttctcaaggtcgccctggacggcacccggccgcaggtcgcggcgctgctcgccgagctccgcccggtcgccgtgatcatggacttcgccacgccgtgggtctacgacatcgccgcgccgctcggcctcaaggcgctccacctcagcgtcttctccgccactgcgggcgcttttaactgcgtccccgcgcgccgcctccacggggcgcacccgtccgcgcaaggtgagctcgaggatcagtgggagaactggctctccgcgt

SEQ ID NO: 29767 - protein, 186 aa, Panicum virgatum
  misc_feature: Ceres CLONE 1893288
  misc_feature: SWISSPROT Homolog: EC 2.4.1.115 Anthocyanidin 3-O-glucosyltransferase
MSGSANGASAGAAHVVMLPWLAFGHITPFAQLARKLVSADGGGVRVTFLTAAGNVPRVEAMLAPSAAGAVVVVPLHLPHVPGLDAGASSTAELSADGAELLKVALDGTRPQVAALLAELRPVAVIMDFATPWVYDIAAPLGLKALHLSVFSATAGAFNCVPARRLHGAHPSAQGELEDQWENWLSA

SEQ ID NO: 29768 - DNA, 1825 bp, Panicum virgatum
  misc_feature: Ceres CLONE 1893293
  misc_feature: Encodes the peptide sequence at SEQ ID NO. 29769
aaaccccacccttctcttatccccgtcacctatccgccggcgcgccgcccgccggccacctccacctcgccggcgagatgctgacctgcggccgcttcctctcctcctccgcggccacaaccaccgcctccttctccccgctccggaccctcacccgctccctcctccgccggccccacccccgcctcctctcctccgcctccgccgccgccacgaccgccgttgagcccgacaccaaaggcggcggcggcggcgcgggtggaggaggtggtggcgcggtgaggccgcagtggaaggcggcgattgacttcaagtggatccgggacaaccgggacgccgtcgctgacaatatccggagcaggaactctgccgccaacctcgacctcgtcctcgagctgtacgaccagtacctcgcgctgcagaaggaggttgaacggctccgagctgaaagaaatgcagttgctaacaagatgaaagggaaactagatccatcagtgcgccaagcccttgttgaagaaggcaagaacctgaaaaagacgcttattggacttgaagaggatcttgttgagctgactgataagcttcaacttgaagcacaaagtattcctaacgctacacatccagatgttcctgtaggcagtgaagaaagctctgttgtccggaaggaggtaggaagtcagaggagcttcaatttcacaatcaaagatcaccttcagcttggaaaggaacttgatttatttgattttgatgcagcagccgaggtcagtggttcaaagttctactacttaaagaatgaagctgttttgttggagatggcccttataaattgggctatttcagaggtctcgaaaaagggtttcacaccactcataactccagagattgtgcggtcatctgttgttgagaaatgcggcttccagccaagggcccaaaacactcaggtctactcaatagagaacagcgatcagtgtctcataggaactgctgaaattcctgttggaggcatccacatggattcaatacttctcgattctgctttgcctttaaaatatgtagcctattcacactgttttcgcacggaagctggtgcagcaggtgctgccactaggggcctctatcgagtacatcaatttagcaaagttgagatgttcatattctgtcggccagaggaaagtgacaaatggcatgaagaacttattacgattgaagaggatctttatgcttcacttggacttcatttcaaaactttggacatggcaactggagatttgggtgcaccagcttaccggaaatttgacattgaggcatggatgccaggcctcgagcgatatggtgagatctccagtgcatctaactgcacagactatcaaagtaggcgacttggcatccgttaccgtccaacaccctcagagcctccaccagcgaatgccaagaaagggaaggcagctggcgggcctactcaatttgtccatacactaaacgcaacggctgttgcagtgcctcgtctgatagtatgcattcttgagaattttcaacaggacgatgggtcgattgtgattcctgagcctctaagacccttcatgggtggactcgaggtgctctccccaaaatccaagtgaccgtaaagtcacccacagtagttaagcttacggtatcagtgaaaaattgagctgtatgtgtcacgtacaagtgacacgagggtcattacaatattgagtttcgtgatttgggctcgtgtttcataacgcctcttaaaaataatcttttttttaattatgtaatgtagcacacactgtatcgatcaggtactctgcatagcattact

SEQ ID NO: 29769 - protein, 513 aa, Panicum virgatum
  misc_feature: Ceres CLONE 1893293
  misc_feature (244)..(415): Pfam Name: tRNA-synt_2b Pfam Description: tRNA synthetase class II core domain (G, H, P, S and T)
  misc_feature (75)..(180): Pfam Name: Seryl_tRNA_N Pfam Description: Seryl-tRNA synthetase N-terminal domain
  misc_feature: SWISSPROT Homolog: EC 6.1.1.11 Serine--tRNA ligase
MLTCGRFLSSSAATTTASFSPLRTLTRSLLRRPHPRLLSSASAAATTAVEPDTKGGGGGAGGGGGGAVRPQWKAAIDFKWIRDNRDAVADNIRSRNSAANLDLVLELYDQYLALQKEVERLRAERNAVANKMKGKLDPSVRQALVEEGKNLKKTLIGLEEDLVELTDKLQLEAQSIPNATHPDVPVGSEESSVVRKEVGSQRSFNFTIKDHLQLGKELDLFDFDAAAEVSGSKFYYLKNEAVLLEMALINWAISEVSKKGFTPLITPEIVRSSVVEKCGFQPRAQNTQVYSIENSDQCLIGTAEIPVGGIHMDSILLDSALPLKYVAYSHCFRTEAGAAGAATRGLYRVHQFSKVEMFIFCRPEESDKWHEELITIEEDLYASLGLHFKTLDMATGDLGAPAYRKFDIEAWMPGLERYGEISSASNCTDYQSRRLGIRYRPTPSEPPPANAKKGKAAGGPTQFVHTLNATAVAVPRLIVCILENFQQDDGSIVIPEPLRPFMGGLEVLSPKSK

SEQ ID NO: 29770 - DNA, 579 bp, Panicum virgatum
  misc_feature: Ceres CLONE 1893315
  misc_feature: Encodes the peptide sequence at SEQ ID NO. 29771
atccaaaccggcaaacccaacacagcaagctggtcagacaagaaacctgggctacttcccctgctccccgttccttgcgatcctatccgccccacgcgtcgttcaccgccaccgcgccgcgtgccatggcgaccggcgacgaccagcgctgcccggcggcgttcgctgggaacgccgccggcgacgcggagagcgcgacggccatcgaggacctgcccgtggacgtcctggccctcgtgctccgccgcctcgacggcgcgtctctggccgcgttcggctgcgcgtgcgccgccttccgcggcctcgccgccgacccggacgcctggcgcgcgctctgcctcgcgcgctggccctcgctccgcgacgtgccctccgctcaccacaagggccaccggcggctcttcgccgacgcgttcccgttcccggccgcgcctgcgccgtcgtccgccgtcccggcgcgcctcgtctcggccttcgacctccatcacgggggcgcctgcatcctgtcgcgcgtcgtggacaccgacgccgcgtcggagtggttcctgggcgcgccgttctgcgtcgacgcgctcgtgc

SEQ ID NO: 29771 - protein, 151 aa, Panicum virgatum
  misc_feature: Ceres CLONE 1893315
  misc_feature (25)..(72): Pfam Name: F-box Pfam Description: F-box domain
MATGDDQRCPAAFAGNAAGDAESATAIEDLPVDVLALVLRRLDGASLAAFGCACAAFRGLAADPDAWRALCLARWPSLRDVPSAHHKGHRRLFADAFPFPAAPAPSSAVPARLVSAFDLHHGGACILSRVVDTDAASEWFLGAPFCVDALV

SEQ ID NO: 29772 - DNA, 810 bp, Panicum virgatum
  misc_feature: Ceres CLONE 1893315-R
ctaggtggacggtcgatgaccccttggtgcatcccgtgatggctagtcaggtctagctaaggtgggtaatggatttgctgggatctgcaccgacactaaggtgatcgtgttgtggtaccccacttgtgggtaaagttgcacacctctgcagagttaaaaacctattcgaatagtccgtgcccacggtactgggcgagttacggtgtggtctcacaactagtgtttactatgggatgggttggcgtgagttattttgggaaatgtgttctggcagttgtgccgtgtgctacggcggatgaggagtccagtagcagcttaaaacttggatcctttatggatcaacccctcgtgttactcggtacaagaaaactggtattgaaaatgctttctttcaaatgaacccctgcataaaatattgctttccgcaaaaccctagcattatccttgaattaccctgtgcattatattctgttataccccctccgtgggtgtggttggacttgctgagtacgtttgtactcaccccattctttatttttacagaagaagatccagacttcgtacccgacgatgttgagtaggggtaccgtcctgcacccagccttgcctgtggattagggtcacccgcaagagatatcgcatgacgcaagactctgatgactttctttttgtatttaatatcattgcgtgtgtatggattgtaatccttgcgatagtggcgcttctctgctcactactgcgtagagttgtacggtaatgaaccatctgatgtaataaatgtgtcatcagcctcttgggactgatgtttgt

SEQ ID NO: 29773 - DNA, 1932 bp, Panicum virgatum
  misc_feature: Ceres CLONE 1893319
  misc_feature: Encodes the peptide sequence at SEQ ID NO. 29774
attagaccaccacccgttggctcggcttggctttctcccctccgccccggggaacgcggccgccgatccgctcccgatccccctcccgtccccctccgccgcccgatcccaccaaatccgcgcccgcgcttctccaattcgattccctagctcgattggcaccacccgatcagccgcggggcaggccgtatctggtttgattcgattggattgggtccccgtgcggagctgtggatccctaattgagttgccgctagggtttcggcgggcgcggtcgccgtgtgggcgggcggaagggttttaccatggcggagaagagctgcctcaagcggctccagaaggagtaccacgcgctgtgcaaggagccgccgccgcagatcgtggctcgcccgctgcccaacgacatattggagtggcgtaagtagcctcccccgaccctaccagtagattggtcgcctttttcggtcgttgatgtctacggtgaactgtctgtaatttatttttgtcggaagcgatggtgtatgtgaaacgcatgcctcatccggttcatgttgcggtagcaatcactttttgagcttggtttggttggaagcgacggcggtgtagttgtaacgcatgtcgcatacggttcacgatgtggtggcaatcactttttgagttcttttatgtttctatatgcatttgattgctttcagttgctctgcacattgcatgatatgctcatagcaatttatggtttaaagtttgaattgtgggatgtccgaggttctggttagtgagttaaattgattatgagtatttggcaatcaatagttcttgtccaaactgaattattttgcgggttccctgaaaaccagtgtataagctcagcctttctttttagctcatagtaggaatggcaggctaagatctttccccatagggtggtaagctactatttggcatctggtagggtggtaagctccagaatttttaactttggctcctgctaactgttcacttatatggactggctctggatagtacattagcaagattcaaatgttcctggggttgtgaggattgatcattacgtgtatacaaagttcagtgacttaatagatcttcaaatagggaacaattgtgcgagatcattacttgttttggtcaagggcatgtgcatagagttggtcacctggcatgcttgatgtccaatacatatttgatgcattttctagatatttgatcaacaatcattggattatcctatttagctgcacaattgtctagtttcgtcatgtgaaatattgcttgtcctacttatggtataagggctctggaaccccaaatgtttgtttatatttatatattttggtgagcatcgggatttgctttggcataactgcaattataaagtgcgacagtaacatgtgacagatggcttgtgctaattatgtgcatatagtaatagatgattagatattgtagattcttggtcaaaattattaaatgactaattgagcaccattgacaactcatagcctacatcttgcctcttggatagctgatgctgaagactgtctttatttgtcattttaccttatatgcattaaggaaaagagtaatattgaactatgtgttagctatagaacacatggaaacgtttaagtttatacttatgacttattatgacttgtctaaaatattttgttattttaattagtagtaacagaatatccaaaggagcattcactcatttgtaactttgttgaatagaccaaaaccatttggtgcctcagattgtatctcctatatattattgtcatgcttattcttagtgtaatgccaatctttttgcttactttcaatgctatatttggtaccaacttttgtgcttttttttactttgtatgccagactatgttcttgaaggaagtaaaggcacaccctttg

SEQ ID NO: 29774 - protein, 39 aa, Panicum virgatum
  misc_feature: Ceres CLONE 1893319
  misc_feature: SWISSPROT Homolog: EC 6.3.2.19 Ubiquitin--protein ligase
MAEKSCLKRLQKEYHALCKEPPPQIVARPLPNDILEWRK

SEQ ID NO: 29775 - DNA, 751 bp, Panicum virgatum
  misc_feature: Ceres CLONE 1893319-R
  misc_feature: Encodes the peptide sequence at SEQ ID NO. 29776
taatggcatggtgcttctcattagggtgtgagggaaaactgtagctacaaaatttgtattataattaacaaaaacattatttcttttgtttctgtttctaacttgtttcattgttcagcatgacaactccaagcggcaggtttgctccacacaaaagaatatgcctgtcaatgagtgactttcatcctgaatcttggaatcctatgtggtctgtagcaagcattcttactgggctcttgtcattcatgatggatgatgctctgacaacaggaagcatcaagacttcagatgcagagaagagacgcttagccaaagcttcccttgcatacaattgtgagagcaaaaactgcccacacttcaggaaactgttcccagagtatgttgagaagtacaaccaacagcaacaattggagaacaccgctgcagaaccagagccccgtgagaatcctgctgcccctgctccatctcctgcagtccagcaagctccagttgtggccaatagagcgcagccagtagcagaggcacgtcgtgagaagaaccagaagaaagtggtgcccttctggatggttctggtcatgttttcagtttttggtgccgtgatggccttgcccctaatgcaactttgagaataataaatgacagaaagtgtgatactggggcgtaattttgtatagtttctattggtttgtgactcaattgtcctcttgggagtcatgttggtaaacatgtgatggtaaatcttttgaaccgt

SEQ ID NO: 29776 - protein, 168 aa, Panicum virgatum
  misc_feature: Ceres CLONE 1893319-R
  misc_feature: SWISSPROT Homolog: EC 6.3.2.19 Ubiquitin--protein ligase
MTTPSGRFAPHKRICLSMSDFHPESWNPMWSVASILTGLLSFMMDDALTTGSIKTSDAEKRRLAKASLAYNCESKNCPHFRKLFPEYVEKYNQQQQLENTAAEPEPRENPAAPAPSPAVQQAPVVANRAQPVAEARREKNQKKVVPFWMVLVMFSVFGAVMALPLMQL

SEQ ID NO: 29777 - DNA, 407 bp, Panicum virgatum
  misc_feature: Ceres CLONE 1893323
  misc_feature: Encodes the peptide sequence at SEQ ID NO. 29778
gctcggcgccgccgcttcctttcgttgatggatcgccccacccggttcctccctcttcatccctctctcgttgccccctcccacttcgccggcgagaggaggcgcccgggccggcacgcacccttccgtctcgtgtcctcggtggctccggaggaggacccggcggcatcggaggcgaggcgatgcgcgtccggtgactccttcatccggcgccatctctggaccttcgcgcctcatccgcccatcttgcccttcgaggtgctatctgttcgccttgggcgtaccccagaggacctaatcaagctcgatgccaatgacaatctctatggtccacccccagaggtggctaccgcattatgtaatctacagctcccctatgtgtaccctgatcctgaaagccgccactt

SEQ ID NO: 29778 - protein, 126 aa, Panicum virgatum
  misc_feature: Ceres CLONE 1893323
  misc_feature: SWISSPROT Homolog: EC 2.6.1.9 Histidinol-phosphate transaminase
MDRPTRFLPLHPSLVAPSHFAGERRRPGRHAPFRLVSSVAPEEDPAASEARRCASGDSFIRRHLWTFAPHPPILPFEVLSVRLGRTPEDLIKLDANDNLYGPPPEVATALCNLQLPYVYPDPESRH

SEQ ID NO: 29779 - DNA, 1746 bp, Panicum virgatum
  misc_feature: Ceres CLONE 1893334
  misc_feature: Encodes the peptide sequence at SEQ ID NO. 29780
ctcctcccccttggaggattccgagcacatcagctgtgtgtcttggtgtcctccaaacacaagcacccgctctgttgcccttcacctctccttcctctccccctggccagggagagaggaagacagaggcacgaagtggcacagagtagacgcttgtgaaccattcgacctgttgctgctgctgctgctgtcgtcacccccgacgagtcgagaaggatggagaagaagcccaccatcctcatgaaccggtatgagctcggccgcatgctcgggcagggtacctttgccaaggtgtaccatgcccggaaccttgcttccaaccagagcgtggccattaaggtcattgacaaggagaaggtgctgcgtgttggcatgatcgaccagatcaagcgggagatctccgtcatgcgccttgttcgccaccccaacatcgtccagctgcacgaggtcatggccagcaagagcaagatatatttcgcaatggagtatgtccgtggcggcgagctcttcgccagggttgccaggggccggctgaaggaggatgctgcgaggaagtactttcatcagttgattggggctgtggatttctgccacagccgaggcgtcttccaccgggacctgaagccggagaacctcctcgtggacgagaacggtaacctcaaggtgtcagactttggcctgagtgccctcaaggagtgcgagaagcaggacgggttgttgcacacgacatgcggcacacctgcatatgttgcacctgagataatcaacaagaagggctacgatggagcaaaggcggacatatggtcttgcggtgtcatactgtttgttcttcttgccggctatctcccattccaggacacaaatctaatggagatgtaccgcaagattagcagagctgatgtcaagtaccctcagtggttctctcctgatatccggaagttcatgtccaggctccttgatccaaatccaaacaccaggatcaccatcgagaagctggttgagcacccgtggttcaagaaggggtacaaaccagcagtgatgctggcacagtcacacggttcaaacagcctcaaggatgttcaagttgctttcagcaccgaccacaaggacaacgaggccaacaaggtggaacaaccaaacagccctttgaagccaacaagtttgaatgcatttgacatcatctcgcactccaaaggatttgatctgtcaggcctgttcgggaacaatcaagagcagaaggcgaattcacggttcatgacccaaaagccagcatcagcaatagtgtcaaaactagagcagattgctgaaacagagcgcttcatggtgaagaaacaggatggactggtgaagctgcaggggtccaaagaagggaggaaagggcagctcgcaatcgacgcggagatcttcgaagtgacaccagccttttatgtcgtcgaggtgaagaagtcagcaggggacacactggagtacgaaaagttctgcaacaaggacctaagaccttcactcagagacatctgctggagcagtcaatcagaggaaaagctcccttcactggctgagtcgtcacattaaagccatcctcttagtcggtcgtgagatatttccttagcgcaatctcttcagagatgcaactacaatcagccttcctttctcttttttcccctttctcaaagggctgagatcttgctcccttgagcatcaggctgtacggctctttgtgatcctttttgccagttttcttcttgc

SEQ ID NO: 29780 - protein, 451 aa, Panicum virgatum
  misc_feature: Ceres CLONE 1893334
  misc_feature (12)..(266): Pfam Name: Pkinase Pfam Description: Protein kinase domain
  misc_feature (312)..(372): Pfam Name: NAF Pfam Description: NAF domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
MEKKPTILMNRYELGRMLGQGTFAKVYHARNLASNQSVAIKVIDKEKVLRVGMIDQIKREISVMRLVRHPNIVQLHEVMASKSKIYFAMEYVRGGELFARVARGRLKEDAARKYFHQLIGAVDFCHSRGVFHRDLKPENLLVDENGNLKVSDFGLSALKECEKQDGLLHTTCGTPAYVAPEIINKKGYDGAKADIWSCGVILFVLLAGYLPFQDTNLMEMYRKISRADVKYPQWFSPDIRKFMSRLLDPNPNTRITIEKLVEHPWFKKGYKPAVMLAQSHGSNSLKDVQVAFSTDHKDNEANKVEQPNSPLKPTSLNAFDIISHSKGFDLSGLFGNNQEQKANSRFMTQKPASAIVSKLEQIAETERFMVKKQDGLVKLQGSKEGRKGQLAIDAEIFEVTPAFYVVEVKKSAGDTLEYEKFCNKDLRPSLRDICWSSQSEEKLPSLAESSH

SEQ ID NO: 29781 - DNA, 1294 bp, Panicum virgatum
  misc_feature: Ceres CLONE 1893336
  misc_feature: Encodes the peptide sequence at SEQ ID NO. 29782
acacacatccgcatcagcttctttctctccctcggcggctgcccgtctccccgtcctcctccgcttcgccggcgcccgcgcccgcgccgtccggccatgggggtgctcacggcggcggagctcaacttcctcgtcttccgctacctccaggagtccggtttcattcatgcagcattcactctagggtatgaagcagggatccataagggtggcattgatggaaatgcagtcccacctggtgctctcatcactattgtgcagaaaggcctccagtacatagaactggaagcaaataccgaagagaatgatgaagaaattgagaaggattttgcccttctggaaccaattgaaatcatcacaaaggatgttgaagagttgcaacagcttgtaaagaagagaaaaagggagagatctcaaactgaccgcgagaaggataggggaaaagagaaagaacgtaatgaggagcatgaacggcgtcctggaggcgaacgtgagagggatcgccatgacaaagaaaaagaacaggtgagggagaaggataaatctgaaaaagacagggagcatgagaaagaaaaggagaaagaaaagcagcatacagagcgtatcgataagattaagcacgatgaagattctcttgctggcggaggtcccactccaatggatgtaagtgtaactgctcaggagatttctagtaccgatgtgactgtattggaagggcacagttctgaggtttttgcttgtgcatggagtccaactggttctcttctagcttcagggtcaggagactcaacggctagaatctggacaattccagatggtccatgtggttccaacatgcaatcatctcctccgggtgttcatgttttgaaacattttaaaggtcggaccaatgagaagagcaaggatgtcaccacccttgactggaatggtgaaggtacactactggctacaggctcctatgatgggcaggcaagaatatggagtagagatggagagctgaagcagacacttttcaaacacaagggtcccatattttcgttgaaatggaataagaaaggagattatctcctaagtggaagtgttgataaaactgctattgtttgggatacaaagacatgggagtgcaagcagcagtttgaatttcattcagctccaacactagatgttgattggagaaataataactcttttgcaacatgctcaaccgacagcatgatctatgtttgcaagattggggaacagcgtccagttaaatcatttattggtcatcagagtgaagttaatgctatcaagt

SEQ ID NO: 29782 - protein, 399 aa, Panicum virgatum
  misc_feature: Ceres CLONE 1893336
  misc_feature (199)..(237): Pfam Name: WD40 Pfam Description: WD domain, G-beta repeat
  misc_feature (299)..(337): Pfam Name: WD40 Pfam Description: WD domain, G-beta repeat
  misc_feature (258)..(296): Pfam Name: WD40 Pfam Description: WD domain, G-beta repeat
  misc_feature (7)..(33): Pfam Name: LisH Pfam Description: LisH
  misc_feature: SWISSPROT Homolog: EC 2.3.1.48 Histone acetyltransferase
MGVLTAAELNFLVFRYLQESGFIHAAFTLGYEAGIHKGGIDGNAVPPGALITIVQKGLQYIELEANTEENDEEIEKDFALLEPIEIITKDVEELQQLVKKRKRERSQTDREKDRGKEKERNEEHERRPGGERERDRHDKEKEQVREKDKSEKDREHEKEKEKEKQHTERIDKIKHDEDSLAGGGPTPMDVSVTAQEISSTDVTVLEGHSSEVFACAWSPTGSLLASGSGDSTARIWTIPDGPCGSNMQSSPPGVHVLKHFKGRTNEKSKDVTTLDWNGEGTLLATGSYDGQARIWSRDGELKQTLFKHKGPIFSLKWNKKGDYLLSGSVDKTAIVWDTKTWECKQQFEFHSAPTLDVDWRNNNSFATCSTDSMIYVCKIGEQRPVKSFIGHQSEVNAIK

SEQ ID NO: 29783 - DNA, 770 bp, Panicum virgatum
  misc_feature: Ceres CLONE 1893336-R
  misc_feature: Encodes the peptide sequence at SEQ ID NO. 29784
tttgggcttcatgttctgatgatgtgacaactaagatatggagtatgaagcaagataaatgtgtatttgattttaaggagcataccaaggaaatatataccattcggtggagcccaacaggcccaggaacaaacaatcctaatcagcagttgcttttggctagcgcatcttttgattctactatcaagctttgggaagttgagcaaggacgccttctgtacagcttgtctggccataggcagcccgtgtattctgttgcatttagccctgatggtgaatacttagctagtgggtccctggatcagtgcctacacatctggtctgtgaaagaaggcaggatcctcaagacctacagagggactggtggcatctttgaagtttgctggaataaggaaggcagcaagattgcagcctgtttctcgaacaacacagtctgcgtgatggatttcaggatgtagtccaaccagtatgttagtgcataacaggcctaaaaacagggctatatctgggaggagcggcattgttagcttaatgtacatcttaggtggctttaatttctccatccatgtacaggtttcttctcggttatattgaccatagagtagctatgttgtaatgcaggtcttaaaaaggtttagtcttatggaaatgttttggtggcaaaaatgctcgtcatccttctgaccgcacttgattaactggcctaatctcactgacggagtcagttttgcccgccatagtggcaaataacatgagatagattttgcacg

SEQ ID NO: 29784 - protein, 151 aa, Panicum virgatum
  misc_feature: Ceres CLONE 1893336-R
  misc_feature (69)..(107): Pfam Name: WD40 Pfam Description: WD domain, G-beta repeat
  misc_feature (18)..(65): Pfam Name: WD40 Pfam Description: WD domain, G-beta repeat
  misc_feature: SWISSPROT Homolog: EC 2.7.11.7 [Myosin heavy-chain] kinase
WASCSDDVTTKIWSMKQDKCVFDFKEHTKEIYTIRWSPTGPGTNNPNQQLLLASASFDSTIKLWEVEQGRLLYSLSGHRQPVYSVAFSPDGEYLASGSLDQCLHIWSVKEGRILKTYRGTGGIFEVCWNKEGSKIAACFSNNTVCVMDFRM

SEQ ID NO: 29785 - DNA, 2423 bp, Panicum virgatum
  misc_feature: Ceres CLONE 1893339
  misc_feature: Encodes the peptide sequence at SEQ ID NO. 29786
acctgccaacacccaacacccagcggccacagcatccgtgctcccgcaacctcccggcctccgcctccgcttcccccaggcagccccacggccgtcgccttcccctccgggccgaaaccaccccgcgtcctcttcctcgaaccaggcaatatccaccgaatattcagctcggctgatccgctataaaaaccaggcccaaaccaacccgcccgcccgcccgcccgctcaacgtgtttatccgtttcgggttggacccatgagatatttcgctgggatcccggcggcgcacgggacgaattcctcctccgtgcgctggtggtaaccgatgctacaaactcccaagtcaaaattcagcccataaaaattttatgggcggatcatccgtcgccgcccaggaagcgagcgacgacgccgccgccgcccgagtcgtgggatcccacgtcgactccgcctccaatcccctccctccgccgggctcggcgacttctgcagcggagggcgagcaggagcacgccaagccggaggccccagctgaggcagcggcggcggcggctccggtagaggctaagcaggaggcggcagcagcagcagcagcagcagcagcagctgcagcagcaggcgtgcaggccatggcggtcaccgtggtgcgggacgtggaggcgggcccggacgcgagcaccagcggccagggcggggacaagccttcctggttcacgcctaagagattacttgtcatgttctgcattatcaacatgctaaactatgttgatcgaggagcaatagcaagtaatggtgtcaatggtagccgcacaaaatgttctggtggaacatgctccccaggctcaggaattcagggagactttgatcttaataatgctgaagatggtgtgttgtcctcagcatttatggttggactgttggtggcttcgctgatatttgcatcccttgcaaaaagatataatcctttcagacttattggtgttggcttgttagtgtggacaatagcaacagctggttgtggggcctcgtttgatttctggtcaattactatttgccgcatgttagttggtgtcggcgaagcttcgtttataagtctcgcagctccattcatagatgacaatgcacctgtagctcagaaaacagcatggcttgctatgttctacatgtgtataccaaccgggatagcactaggctatgtgtatggaggactgatcggaaaaacactgggctggcgtgctgctttctggggagaatcaattttgatggttccttttgtgattctaggatttgtgataaagccactagaaatgaaaggactttctcacagcggaataaaagaatatggccagatgcttaatcccgaggttcaagaccagataaataataatgggccaaagcatgttatgcctggtggaatcaatgatcttgcaggaaaggtcccacaaaagttttccttctccagatttggccgaaggctcatgactgaaattggtcttttcagcaaagatatgaaagaactactacaagagaaggtttttgtcaccgtggtcttaggttatatctcctacaactttgtcattggtgcttattcctactggggccccaaggcaggccaacagatctacaatatgacaagtgcggatcttatgtttggtggaataactatagtgtgtggaatcgttggaactctagccggaggtttcacccttgacaagatagggtctaccatacctaatgctttcaagcttctttccgccgcaacatttctaggggcaatattctgttttggtgccttttgtttcaagagcctttatggattcataccctgtttttcagtaggggagattttggtttttgcaactcaggcaccagtaaattttgtgtgccttcattctgtgatgccacatttgcggccactggcaatggccgtatccactgtttcgatccatatatttggtgatgtgccttcttcacctcttgttgggcttcttcaggacaaaatcaataactggaggtccacagctcttatattgacatccatccttttcattgcagctgtgttttggtttattggcatatttgtccccagcgtggatcgtttcaatgaagagagcgagcatggtgttcctgccgccgagagatcaaacctcaggccactgctcgatgacaacgaggaggcacgggcatctgactaaaatccgtgcaagttagatcacgtcatggcccttttcttttcttttttttcttcttttttgagggtaatcttagccggattatttcccttgtgctagcaacatgtgaaatgtaaatttgcatgtcagctggctgtactatgtatatataataggtgcgtttggtttccgttcttttctactatagtgtacagactacagaaacaggcaatgtcaggattgtttttttac

SEQ ID NO: 29786 - protein, 521 aa, Panicum virgatum
  misc_feature: Ceres CLONE 1893339
  misc_feature (37)..(447): Pfam Name: MFS_1 Pfam Description: Major Facilitator Superfamily
MAVTVVRDVEAGPDASTSGQGGDKPSWFTPKRLLVMFCIINMLNYVDRGAIASNGVNGSRTKCSGGTCSPGSGIQGDFDLNNAEDGVLSSAFMVGLLVASLIFASLAKRYNPFRLIGVGLLVWTIATAGCGASFDFWSITICRMLVGVGEASFISLAAPFIDDNAPVAQKTAWLAMFYMCIPTGIALGYVYGGLIGKTLGWRAAFWGESILMVPFVILGFVIKPLEMKGLSHSGIKEYGQMLNPEVQDQINNNGPKHVMPGGINDLAGKVPQKFSFSRFGRRLMTEIGLFSKDMKELLQEKVFVTVVLGYISYNFVIGAYSYWGPKAGQQIYNMTSADLMFGGITIVCGIVGTLAGGFTLDKIGSTIPNAFKLLSAATFLGAIFCFGAFCFKSLYGFIPCFSVGEILVFATQAPVNFVCLHSVMPHLRPLAMAVSTVSIHIFGDVPSSPLVGLLQDKINNWRSTALILTSILFIAAVFWFIGIFVPSVDRFNEESEHGVPAAERSNLRPLLDDNEEARASD

SEQ ID NO: 29787 - DNA, 1845 bp, Panicum virgatum
  misc_feature: Ceres CLONE 1893344
  misc_feature: Encodes the peptide sequence at SEQ ID NO. 29788
atccctgcatctgcaagtgctgtgaaactacaagagtccgaggttatagtaataggtaaccacccaagtgtcaagctctgtcatatagacgcctagttgttcatcgctgatcattgtcatggcggcaaacctagcacagctgttgatgcgcgagctgatggctcctcgagcatggtttctgcttctcctccctctctccctattgctcgtaggctacccattattcagcgcaaagagggcgaggaagaggcagcaggagacagacggaaatcacctaccgccttcgcctccggcgctgcccgtcctcggccacctccacctcgtcggcttccgcttcccgcacgtcactctccgcagcatcgccgagaagcacggcggggacctcatgttgctgcgcctaggcgccatgccggcgctcatcgtgtcgtcgccccgcgccgccgaggcggtgctacgtacgcatgaccgcgtgttcgcgtcgcggccgccctctctggtcgccgatgtcctcatgcacggccggaacgacattggcttcgcgccgtatggggagcactggcggcaggcgaggaagctcgtcaccacacaccttctcaccgtcaaaaaggtgcaatcgttccgtcacgcccgtcaagaagaggtgagcgcggtggtcgcttgtatcggtgaggcggccgccgccggcgcgccagtcgacgtccacgagcttgtcggctcgttcacaaatgacctcgcgtgtcgcgctgtcataggcaagtcgttccggagcgaggaccagaacaggctgttccagggggtggtcgccgacgcatcagccctcctaggagggttcactgtcgacgagttcttcccgttcctcacatgcttcggcatcctcagcaaggtggtccgcgccaagtccgacagattgaggaagaggtgggatgagctgctggacaggctgatcgatgaccttgagagcaaatacaagcccatggcggtggcggcggtagcagaggcggcgagccatgtgaagaaggacgaggatgacaacttcataaataccttgctctctgttcgacaggagtacggctacaccagagggcagatgaaagctatcctgcttgacgtgtttttcgggatgggcacagcagcttcggtcctcgactacaccgtgatccagctccttcagaatccacgcgtgatgaccaagctacaagccgaggtgaggagctgcgtgctgcagcaggggcagggagaagaaaccgtcagcgaggacgacctgaaccgcatgccctacctgagagccgtcatcaacgagtcgctccggctacaccccgcgacaccgctcctcacgccgcacttctccatggccacctgcgtcatcgacgggctcgtcgtccccgcggaggtgcgcgtcctcgtcaacctctgggccatcggcagggacgcgcgcttctggggcgaggacgcggaggagttcgtcccggagaggtttctcgacggcggcggcgcggcgcatgtgagctactggggcaacgacttccagttcctgccgttcggcgccgggcgccggcagtgccccgggatcaacttcggcatggcccaggtcgaggtgatgctggccaacctcgtgcaccgcttcgactgggagctgccgccggggaaggtggcccgagacatcgacatgtccgaggacttgggcctcgtggtgaagcgcaaacacaagctcctcttgcttcccaaattgtgcgtgtagctccgatatgatatatcatctccgttttcgaatatttatttatcgtctgctattttatttttgaattaaaatacgacaaataaaaaagaacggaggagtgttagtgt

SEQ ID NO: 29788 - protein, 539 aa, Panicum virgatum
  misc_feature: Ceres CLONE 1893344
  misc_feature (54)..(533): Pfam Name: p450 Pfam Description: Cytochrome P450
  misc_feature: SWISSPROT Homolog: EC 1.14.13.68 4-hydroxyphenylacetaldehyde oxime monooxygenase
MAANLAQLLMRELMAPRAWFLLLLPLSLLLVGYPLFSAKRARKRQQETDGNHLPPSPPALPVLGHLHLVGFRFPHVTLRSIAEKHGGDLMLLRLGAMPALIVSSPRAAEAVLRTHDRVFASRPPSLVADVLMHGRNDIGFAPYGEHWRQARKLVTTHLLTVKKVQSFRHARQEEVSAVVACIGEAAAAGAPVDVHELVGSFTNDLACRAVIGKSFRSEDQNRLFQGVVADASALLGGFTVDEFFPFLTCFGILSKVVRAKSDRLRKRWDELLDRLIDDLESKYKPMAVAAVAEAASHVKKDEDDNFINTLLSVRQEYGYTRGQMKAILLDVFFGMGTAASVLDYTVIQLLQNPRVMTKLQAEVRSCVLQQGQGEETVSEDDLNRMPYLRAVINESLRLHPATPLLTPHFSMATCVIDGLVVPAEVRVLVNLWAIGRDARFWGEDAEEFVPERFLDGGGAAHVSYWGNDFQFLPFGAGRRQCPGINFGMAQVEVMLANLVHRFDWELPPGKVARDIDMSEDLGLVVKRKHKLLLLPKLCV

SEQ ID NO: 29789 - DNA, 580 bp, Panicum virgatum
  misc_feature: Ceres CLONE 1893377
  misc_feature: Encodes the peptide sequence at SEQ ID NO. 29790
acaaagcaccaagctttagcacgcacaagggcctaacacaatcctctaacacacacgcctctcgaaagctccagcagcggcgcaagcccagccagccagcctcgtcgccatggctcccaacctcagcaaggccaagccggacctgctcggcgacgcggccgcccccgtcgagggcctcaaggcgccgtcgcgcttcacgctcaagggcaaggacctcgccgcgttccggagctccctgtacctgcacgccggcgacgacccgttcgagctcgtgcgggaggccgtgcgggtggtccgcgcccacctcggcacgttccggaccatggacgagaagaccccgccgccgatcgtggacaagttcgggtggtgcacgtgggacgccttctacctcaaggtccacccggagggcgtgtgggagggcgtccgccgcctcgccgagggcgggtgcccccccgggctggtgctcatcgacgacggctggcagtccatctgccacgacgacgacgacccggcgtccggcgccgagggcatgaaccgcacctccgccggcgagcagatgccctgccggctcatcaagttc

SEQ ID NO: 29790 - protein, 156 aa, Panicum virgatum
  misc_feature: Ceres CLONE 1893377
  misc_feature: SWISSPROT Homolog: EC 2.4.1.67 Galactinol--raffinose galactosyltransferase
MAPNLSKAKPDLLGDAAAPVEGLKAPSRFTLKGKDLAAFRSSLYLHAGDDPFELVREAVRVVRAHLGTFRTMDEKTPPPIVDKFGWCTWDAFYLKVHPEGVWEGVRRLAEGGCPPGLVLIDDGWQSICHDDDDPASGAEGMNRTSAGEQMPCRLIK

SEQ ID NO: 29791 - DNA, 1687 bp, Panicum virgatum
  misc_feature: Ceres CLONE 1893379
  misc_feature: Encodes the peptide sequence at SEQ ID NO. 29792
atttcccacgaccacaccacacaaccaagcgagcaaaccctccgccggagtgctcagtcgcgactcacgccgccgccgccgcctctatcgccggccgcgcttcaagggatccagaggcaaggctaatcgctccccattcaccaatttctggaacaaaaaaactgtcttattctcctcacaagtcatcgtattactagtacaaagctgtgatcgaactgcagggcttggcggcgcggggatctgcctccagccctccacaagatggaggaggcccctgctacgaggaatccagcggccattcttacagacgacctccttatcgagatcctccgccgcctgcccatccgctccgtatgccgcttcaagtgcgtctcgcggtcctggcgcaagctcatctccgaccccgcccaccgcaagaagctaccccagaccctcaccggcttctactacgctagcgtcagcggtgagcgcttcccaaagtgggcgtaccacttcaccgatgttaccgggaaagacgtaccattcatcttgcccttccccagtgccgatgtacgcctcttggattcctgccatggcctcctccttttccgttgctttcagcctggtcctcgtattgtcgatgcaccgtttcattatgttgtgtgcaatcccgcgaccccgaagtgggtgatgttgccgggtcgcactttggctagtggcgacgctaaaacagcccgcttggggtttgatccggcagtctcctcgcacttccatgtggttgagtatgtgctggacgagggtgactccgtcacaggggtgcagatctattcatccaaaactgcatcatggaacttcaaggaaagtgaatgggacgacgacgtctgtctacatattttctctcatagtgtgagaagtgtgtttcttaatggctgtatgcatatgatgacgctctgtcacgggatagtggtggtggacatggagggaacagcatggaggacaattcctgtgccatctgttggtccgtttggctgcatcgatcaagcccagggtcgcctgtgttttcttaatgttcatgatgctgatgccttcaaactgtcaatctggatccttgaagaccatggtactaatgaatggacactgaagcattccgtcaggactccactgctgtttccgcagaaaaatcctcgatttgtgttgggttacaaagtgattacagttcaccccgaatgcaacaatttgatctactttgtttatgggagggacgacacactaatggcatatgaaatggaccgcaaggaaattcatgttatccggaatctcggacatgattactgggagccctgtcttccttatgttcccttgttctcggaggcattagcagatgagccgtgaaactgttagatttactgcagctatgtgtttattactgcaatgatgaattcatattggtgcagtaaggagtatgtggcattccttctagctgctaattgttctagcaatctgtatgttgagtagactgtcagaaaagtcaagttctgttttcctttgttttactcatatgagtatgtctctcttgtgctatttttgatttggaccaatgttgtttaattgttgagatctcatgaactgcctttaggaagggtaactgtgtattctttcagttaaacagctatgttattaaggataactggaattgccaccaatgttc

SEQ ID NO: 29792 - protein, 369 aa, Panicum virgatum
  misc_feature: Ceres CLONE 1893379
  misc_feature (9)..(56): Pfam Name: F-box Pfam Description: F-box domain
MEEAPATRNPAAILTDDLLIEILRRLPIRSVCRFKCVSRSWRKLISDPAHRKKLPQTLTGFYYASVSGERFPKWAYHFTDVTGKDVPFILPFPSADVRLLDSCHGLLLFRCFQPGPRIVDAPFHYVVCNPATPKWVMLPGRTLASGDAKTARLGFDPAVSSHFHVVEYVLDEGDSVTGVQIYSSKTASWNFKESEWDDDVCLHIFSHSVRSVFLNGCMHMMTLCHGIVVVDMEGTAWRTIPVPSVGPFGCIDQAQGRLCFLNVHDADAFKLSIWILEDHGTNEWTLKHSVRTPLLFPQKNPRFVLGYKVITVHPECNNLIYFVYGRDDTLMAYEMDRKEIHVIRNLGHDYWEPCLPYVPLFSEALADEP

SEQ ID NO: 29793 - DNA, 391 bp, Panicum virgatum
  misc_feature: Ceres CLONE 1893387
  misc_feature: Encodes the peptide sequence at SEQ ID NO. 29794
tccagaacccaaatccagcaagcaactcgctctgcttctcctctcgtgccctgtttttcccattccctccctgattctgatcgacatggtccaccaccatcgggcgagcctgctggtgcccccgcagcgcaaggccgaggcggcggcagaggacccggagggcggcggcggccggatgaaggagctccggggccgcctggccgactacgcctgccaccaccaccggaagcacggccacgacgcgctgctccgcatgctcgcgggcttcgcgctcgtctcctgcctcctgctactgctcccgggcagccccgtctccggcgccatggacgagctgctgcagctcgggacgaccacgcggcccgaccaggagcagggggcgggagacgagcgc

SEQ ID NO: 29794 - protein, 101 aa, Panicum virgatum
  misc_feature: Ceres CLONE 1893387
  misc_feature: Functional homolog of the protein sequence given in SEQ ID NO 50484
  misc_feature: Useful for making plants with altered carbohydrate content
MVHHHRASLLVPPQRKAEAAAEDPEGGGGRMKELRGRLADYACHHHRKHGHDALLRMLAGFALVSCLLLLLPGSPVSGAMDELLQLGTTTRPDQEQGAGDE

SEQ ID NO: 29795 - DNA, 616 bp, Panicum virgatum
  misc_feature: Ceres CLONE 1893387-R
  misc_feature: Encodes the peptide sequence at SEQ ID NO. 29796
ccggaacgggtcgcgcgcgatcgagaacgaggccgagctggcgcgcgccgcggcgggcgccgggttccgcgtcgccgtgctccggccgcgccgggacacggagctcgccaggctgtaccgcgccctgaacgcgtcggacgtcatggtgggcgtgcacggcgcggccatgacgcacctcctgttcatgcgccccggatccgtgttcatccaggtggtgccgctcggcacggactgggccgccgaggcgtactacggcgagccggcgcggcggctggggctgcgctacatgccctacaggatcctgccgtccgagagctcgctctccgggcggtacgccgagggcgaccccgtgctggccgacccggacgccgtgaacgccaaggggtggcaggtcaccaagcgggtctacctggacggccagaacgtgcggctggacatggcgcggttccgccgccacctgcgccgggcgcgtgaccactgggcgcgaggcagggccgccgccgcgcggatcggaacaggggcggaacagcggtagcgtttgcggaggatcttggtttcatttttgacatgggtgaatgttgtactgtaaaatatggcatgtagagacatcaggtgt

SEQ ID NO: 29796 - protein, 177 aa, Panicum virgatum
  misc_feature: Ceres CLONE 1893387-R
  misc_feature: Functional homolog of the protein sequence given in SEQ ID NO 50484
  misc_feature: Useful for making plants with altered carbohydrate content
RNGSRAIENEAELARAAAGAGFRVAVLRPRRDTELARLYRALNASDVMVGVHGAAMTHLLFMRPGSVFIQVVPLGTDWAAEAYYGEPARRLGLRYMPYRILPSESSLSGRYAEGDPVLADPDAVNAKGWQVTKRVYLDGQNVRLDMARFRRHLRRARDHWARGRAAAARIGTGAEQR

SEQ ID NO: 29797 - DNA, 690 bp, Panicum virgatum
  misc_feature: Ceres CLONE 1893395
  misc_feature: Encodes the peptide sequence at SEQ ID NO. 29798
  misc_feature (527)..(527): n is a, c, t, g, unknown, or other
atggataagtagactcgctagctgttccaagtctcaagccaatctatcacctgctacatctctgccgctgctggccagctgcgatggccggctgcttcttggcgacgacgatcacgccgacgatcagtcgcgctgtcgtcggcctcgtcatcatctccttctccgtcgtcgtttgctgcctccccgtcgtcgccgccttgtccttcaactactccgccttctccccaaaaatgcaaaacagcatcatcagatgcgaaggcgacgcctacatcaacaacggcgacgggtggatcgaggtgaccgccaacaggatgagcggcatcggcggcagccgcggccgcgcgtcgtacggcgccgagccggtgcgcctctgggacggggacaccggcgaggtggccagcttcaccacgcgcttctccttcgtcatcaacccgccgccgccgctgggaatcaacaacaagggcaccggcatggccttcttcctcgccgcctacccgtccagcctcccggcggtgtccgcggcctancacatgggcctcaccaaccaggcccccgacgccgtggccgccggcgatgcccgggtcgtggcggtggagttcgacaccttcaacgacaccgccgcgctggaccccgacaagaactacgacgacgtcgggatcgacgtcaactccttcaggtcggtgggcacgc

SEQ ID NO: 29798 - protein, 202 aa, Panicum virgatum
  misc_feature: Ceres CLONE 1893395
  misc_feature (37)..(202): Pfam Name: Lectin_legB Pfam Description: Legume lectin domain
  misc_feature (148)..(148): Xaa is any aa, unknown, or other
MAGCFLATTITPTISRAVVGLVIISFSVVVCCLPVVAALSFNYSAFSPKMQNSIIRCEGDAYINNGDGWIEVTANRMSGIGGSRGRASYGAEPVRLWDGDTGEVASFTTRFSFVINPPPPLGINNKGTGMAFFLAAYPSSLPAVSAAXHMGLTNQAPDAVAAGDARVVAVEFDTFNDTAALDPDKNYDDVGIDVNSFRSVGT

SEQ ID NO: 29799 - DNA, 1201 bp, Panicum virgatum
  misc_feature: Ceres CLONE 1893404
  misc_feature: Encodes the peptide sequence at SEQ ID NO. 29800
atccgctggtgcaccgttggcgttggtggtctgttccgttaacccaccaccaccagccaccaccccgctcgccatccaccaaacgcaaatccacaccgcaccaaccgaatcgggggagtaaacaaagaggcggcaggatggtgatcggacatgccgccggcatgtgtgcgtgggcaaaggcagcagacgcgctggagctgctccctccagtccggtggctgtgagcactgagcagtgacgcacgcgcgtcccggcgtccaggtccggaggatcacaggagcagccgagcaggacgagccgaggtgccagcccgtagtgctgccccgccctctgtgcgcgccttttgggtggggctcctcaaaagcagaggggggagcaaggtcgcggcagcatctagcagcgcggcacggcgagtagcgcggagcggggaggcagggcaggaatcattccgctcgcgagtctgccgcccgcgccgctgcccccgctttccggagccgggcggccccgcgccgcgcgcgcctatcctctccggccggcatcgtcctcccacgctgcccgcgtccgcgtcgtgcgcattggggcatttcttcgtttgggtggcgctgtcgtcgcaccaccaccaccgccgccagccagccagccgcctttgctgattggtacgggcgggcggggcgctagccattttttttaattcctgagatgcttccgctgctgcttatatccacgctcccggccttcacgctgctcctcgtcgcgcccgccaccaagcccggctgcaagctcgcgcgggagctcggcctcctcgcgctgctgctcgccacggagctgctgcgccacgccaccgccgcggggaggaggctgcggggccgggggcgggagccggagcgcggcgcgagggcgatgcccgctccgcccaggccgaggccggccgcattggcggcgccgggcgaggaggcaacgcccgccgcggcggggctcccgctgctcgacctcgcggagctcgcgctagaccgcgtgctggaggagctctcgccggcctcgctcgccgcgatggcgtgcgtgtgcgccgcgctccgggaccggtgctccgccgacgcgctgtgggagcgccaactccgcgccaagtgggggcgcgtgctgggcgccaccgcgcggaaggagtgggaggcggagctcggcgccagggtcgcccgcgcaagcg

SEQ ID NO: 29800 - protein, 167 aa, Panicum virgatum
  misc_feature: Ceres CLONE 1893404
  misc_feature (93)..(140): Pfam Name: F-box Pfam Description: F-box domain
MLPLLLISTLPAFTLLLVAPATKPGCKLARELGLLALLLATELLRHATAAGRRLRGRGREPERGARAMPAPPRPRPAALAAPGEEATPAAAGLPLLDLAELALDRVLEELSPASLAAMACVCAALRDRCSADALWERQLRAKWGRVLGATARKEWEAELGARVARAS

SEQ ID NO: 29801 - DNA, 635 bp, Panicum virgatum
  misc_feature: Ceres CLONE 1893404-R
ggcgcaagaacaaggacttcccatacggtacgacggtgcctgtgcccggagtcccggaccgcctgcatactcggccggcgacggcgagagatgcccacggacggcaccacggttctactcgctctactggttcaagtacttccaatggctgatctgatccgatgccttttgcgatgcgttgctacaggctggtggtatggcgtcgtgggtcaccaggcaccgtgcaacccgaacgagcatctgtgtcgctgccacgaggacgatacgatcgtcctggagttccagcactacgcccccgggtcgcggtggaggcagaccaccgtgagcaggaaggatcacagggagacgggggacgagaccggcggcttctacgggggcatcaggaagctgcagaccaaggacgagatctcgacgtggcgccgattctggcccgtggacgtcctcaactgatggagatcgcatttgcaacgggcctgcgcgcccgcgtcccaaaattcccccatgtacagttatggagagctttcagcattcgtctgaaataactctgaagtctgaacctttttctcgggtctgaaggatctctttttccctagagatttatggcgcagggcattcaatccgatcaagattgtcag

SEQ ID NO: 29802 - DNA, 698 bp, Panicum virgatum
  misc_feature: Ceres CLONE 1893410-R
  misc_feature: Encodes the peptide sequence at SEQ ID NO. 29803
atgagtacctggaccgttttatccggcggagatttcagcctaatacattcaaatttgttgcctcaaaggttgctgcagatggtttcctctttggaccattagatcttctcttgttcttctcatatgtgggtctcggccaaggaaggagtgtagagcaagtgaaggaagacgtgaaaagagatttcattcccgctctggtactaggtgggatgatctggccagccgtgcagatcgcgaacttccgcttcattcccgtgcggtaccagctcctgtatgtcaacttgttctgcctcttggacagttgtttcctatcatggattgagcagcagggagacgcttcatggaagcagtggttcacatcgttccataaaatcgaagaccataagagtaaggtttgattttactagttataatccatggtgttcatgcggatcaacatttaaaactctactggctgaagcactattaacttgctgtaagataaaagggggccaaagttgtccgggagagggttacaggggagcatgtgtttcccagacagggatacggatgttgataagctgaagatgcgtgcttgactgcttgtggctagtggctgaggcattgttaacttgctgtaaccggatctgagctttatgtctctgtggttgtctgaaaattcagtccaatacggtgtcccacttatgctgcggccgtgg

SEQ ID NO: 29803 - protein, 131 aa, Panicum virgatum
  misc_feature: Ceres CLONE 1893410-R
  misc_feature (42)..(112): Pfam Name: Mpv17_PMP22 Pfam Description: Mpv17 / PMP22 family
EYLDRFIRRRFQPNTFKFVASKVAADGFLFGPLDLLLFFSYVGLGQGRSVEQVKEDVKRDFIPALVLGGMIWPAVQIANFRFIPVRYQLLYVNLFCLLDSCFLSWIEQQGDASWKQWFTSFHKIEDHKSKV

SEQ ID NO: 29804 - DNA, 1308 bp, Panicum virgatum
  misc_feature: Ceres CLONE 1893410
cctctcctctcctcttcttgcccgtggaattgttctctcctcgcttgcccggcggcgcggtgaggatgcggcggctctggcgatggtaccagcagtgcctggcctcgcacccggtgcgcacgcaggtcgtcagctccggcatcctctgggcctccggtgacatcggcgcccaggccgtcacccactactccgcacgccgtcgcgccaacaacaaacccgtggtagcagccccaatcgaatccatcccctaccgctttcttcgtccatggtcgccatatgtagattcccccggctagttctcggacggggtcgctccattttttttaagctatctcttcctattcttggcctggacttgggcgggttccttgcgagctgtaacttctgtctggtgtgatccaatggcatatagctcgctgctaatgcgtaggcaatctttgtcggttcggacgagctgtggatttgatcggtaacctgaaacggcaccacaaatgggtcaacttgtcagctcctgaatgcggatgatggctggatttgtgctctgtccctttggcctgtgtgaggtttactgcaaagaaactagagtatttggtgggaaaccccttaatatcttaagattctttatttctaatgctagggccttgtcaaatctattattgcgaatgcctctatggacttctgtggtagtgagaattgatactcccattctggcaaaaattttggaaataggaggtttgttgctaaaaaggacctaggatgccctttttggtcactgatgtctgatattacattaggtctgattgtcgttcactccatttggggtgttcatggattgttgggtagtaatggagcttttattttgttcccagaagtatgacttagaggagtaaatttgtaatggaatgagaagttgaacgagttttttttttaatagatggaagtttcttggtaaatagcttaacctgcaaatcagattaattttctggccatgtgatctactcttttgcttgctgtgacctcacagggcttgttgtttactgtgcagttttatggttatggttgggatggggctcatagtatcccattagtacatacttacagttctcatttcttgctttgatggcaaaggttagccatttctctgatttttaagcttcagataatcagatgtgcttgtttgttcttttaattccgagtacaacgagaatcgggagcttgatttgattgttgttaatatgtactttactcaacagagttgccttctctttaatcagcaaatcaacctttgaatttcttgtatccagagtt

SEQ ID NO: 29805 - DNA, 2268 bp, Panicum virgatum
  misc_feature: Ceres CLONE 1893414
  misc_feature: Encodes the peptide sequence at SEQ ID NO. 29806
agccgccacgcccccttcctcactcgccgccgcctctgcacaaggaagggaagaagaagaggggagagagaagaggtgctgtaggaggaggacgcccagctgccggaccgccggtggagcactacgacggccgcgaagtccgaggaggaggagacgccgctgccgccggagctgccgcacgccgccgcaccgtacatcgacatcgacgatcccggccgcgctgcacagcacggccccggaccgccaccgcccaccgcgacgcctcgccgctgcaccgccacccgtcttcttcgacccgtctgattgtgaggagcaagcggagacagcagccatgagtacggacaacttcacgcccgaaacgaagcagttgctggatgcggcgcacaggaaggcatggaaggcccgccacaaggaggtcctgccgctgcaccttgcggcggtgctggcggcggacaaggagggcatcatcctgcagcaggccatcacgcaggcgtcagacggcgacgtgtccaagttgggctcattcaagagcgtgctgggcagaatgctcaagaagcagccgtccatgaagcagccgctgcagccggactcgataccgagatccgcgtcgctgaacaaagtcatcgacaaggcgcggtccgcgcaggactccgactcccccctcgaatttaggcagctggtgctcggccttctctccagcatcaagatctccgactgcctcaaggacaatggcgttgacttgaccgcggagcgggtgcgccaggagctcttgaagttccccggcggtgagggcagcggccgcgtggcggactccgacttccaggcgctcatgatgtatggccgcgacctcgtggaggaggccatgaagctggacccggtcattggccgcgacgacgagatcctcagcgtggtgagcatcctctcctgccgcaaaaagaacaaccccgtcctcgtcggcgagcccggcgtggggaagacggccatcgttgagggcctcgcgcagcgcatcgcgcggggcgacttgccccgcagcctccagggagtccgccttatcgcgcttgacatgggcgcgctcgtcgccggcaccggtaatagaggcgatttcgaggagcggctcaaggccgtgctcacggaggtagaggaggccgacgggaatgtcatcctcttcatcgacgaggtacacctcgtcaccggtgcgggcaaggcgcaggggtccatggacgctgccaacctgatgaagccgatgctggcgaggggccagctccggtgcatcggcgccaccacgctggaggagtaccgcaagtacatcgagaaggacgccgcgttcgagcggcggttccagcaggtgttcgtcgctgagcccagcatcgacgacaccatccacattctgagaggactcagggcgacgtacgagagccaccatggtgtgaggatcttggaccaagccctcgtggccgccgcggagctctccgccagatacatcacggatcgacacctgcctgacaaagccatcgacatggtagattgggcctgcgcccttttcattctagagctggaaagccccccgaaggagatggaaaacctcgagaacaagaagattcagctgaaagttgagctccagtctctcaagatggacatgaacgatgacggccggcaggttaagcagctcaaagaagaactgcgccagttgaggaggcagttggggaccctggaaacggagtacgccaagcagaaggagagggtccaacagtacagggggcttcgcgagaaggagctgtcaacgctgcagaagaagctgttaatgctggaggccccagcaggtgctagtaaccagcggatactcccgccaagctggcccaagcacggcagctttgagatcatcaaggttcttcttgagcacgatttagggaggatcaaatggaaggagtggcgtctgcacaaggaactcaagaatgaggagggcgaggccagcaacagggcccagttgctcgaggacaaggaaaagctgctggctcgtggcaagcaggagctcatggagctcgtgaagtatacccgcgaatgcatgaagcgctgcgaggaactgatgcccattggagccgtcggccctgaacagatcgctaaggtggtgagccggtggaccggcattccgtgtttgaatccgaatccgatccgtttacatgtggataaagtacgctaaggatcgaccgcgacttaaacctcacggacaaagatacaaaggttaggcgatcaagcactttgtttatctgc

SEQ ID NO: 29806 - protein, 621 aa, Panicum virgatum
  misc_feature: Ceres CLONE 1893414
  misc_feature (204)..(398): Pfam Name: AAA Pfam Description: ATPase family associated with various cellular activities (AAA)
  misc_feature: Functional homolog of the protein sequence given in SEQ ID NO 50876
  misc_feature: Useful for making plants with modulated heat sensitivity
MSTDNFTPETKQLLDAAHRKAWKARHKEVLPLHLAAVLAADKEGIILQQAITQASDGDVSKLGSFKSVLGRMLKKQPSMKQPLQPDSIPRSASLNKVIDKARSAQDSDSPLEFRQLVLGLLSSIKISDCLKDNGVDLTAERVRQELLKFPGGEGSGRVADSDFQALMMYGRDLVEEAMKLDPVIGRDDEILSVVSILSCRKKNNPVLVGEPGVGKTAIVEGLAQRIARGDLPRSLQGVRLIALDMGALVAGTGNRGDFEERLKAVLTEVEEADGNVILFIDEVHLVTGAGKAQGSMDAANLMKPMLARGQLRCIGATTLEEYRKYIEKDAAFERRFQQVFVAEPSIDDTIHILRGLRATYESHHGVRILDQALVAAAELSARYITDRHLPDKAIDMVDWACALFILELESPPKEMENLENKKIQLKVELQSLKMDMNDDGRQVKQLKEELRQLRRQLGTLETEYAKQKERVQQYRGLREKELSTLQKKLLMLEAPAGASNQRILPPSWPKHGSFEIIKVLLEHDLGRIKWKEWRLHKELKNEEGEASNRAQLLEDKEKLLARGKQELMELVKYTRECMKRCEELMPIGAVGPEQIAKVVSRWTGIPCLNPNPIRLHVDKVR

SEQ ID NO: 29807 - DNA, 4179 bp, Panicum virgatum
  misc_feature: Ceres CLONE 1893433
  misc_feature: Encodes the peptide sequence at SEQ ID NO. 29808
atcgcgaaaaaatctttttctcgcctctcctcgctcctcgccgtttctctctcctcccctccgcctcacccgccgctcgccgcgaaatccacccgcggacgccgcccgctcgccgtggagagcctcggattagagtgcgccccgtcgagagatttcgaagcaactatgtttgggattggttgatatgatacttgttcacgttgggggatgcagacccccccctctgtgggggttgattgaagaagttaacagtactcttagacgaacttgtgtcctactgatactgaaagtttcttggtttcgaggcaagtagcattactaagagtaggaccttggtggcatagatggatgaactgactgaaaacttcaacgcggtgttgattacaggctcttgagctaccaaagtaccaagtatgtcagcttcaaatgagaagtggatcgatgggctccagttcacatcactgttctggcctccaccccaggatgtgcaacagaagcaggcacaaattttggcctatgttgagtactttggccagtttacagctgacagcgagcaattccctgaagatgtagcacagctcattcaaagttgctacccatggaaagaaaaacgcttggtagatgaagtgttggcaacttttgttcttcatcatcccgagcatggtcatgcagttgtacatccagttctttcacgtatcatagatgggacactgtgctatgatagacatggtcccccattcagctccttcatctctttgtttagccatacttctgagaaagagtactcagagcagtgggccttggcatgtggcgaaattcttagagtcttgactcattacaataggccaatattcaaagttgagcgccaacgttgtgaagctgaatgtagcagcacatccgatcaggcaacgtccagtgattccacggataagaaatctgatgattccctaggaaatgaacctgatcggaagccattgaggccactaactccatggatcactgacatattgctcgctgcacccttgggaattagaagcgactactttagatggtgtggtggtgtaatgggaaaatatgctgctggtggagaattgaagcctccaacaactgcttgcagccgaggatctgggaagcacccgcaacttatgccatccacccccagatgggctgttgcaaatggagctggtgttatattaagtgtctgtgatgaggaggtagctcgttatgagacagcaaatttaaccgcagcagctgttcctgcacttctgctgcctccaccgacaacaccattggatgagcatttggtggctggcctgccccctctcgaaccctatgctcgtttgttccatagatactatgcaattgctactccaagtgctacacagaggctgctttttggtcttctcgaagcacctccgtcatgggctccagatgcactggatgcagcggtgcaactagttgaactacttagagcagcagaagattatgctactggcatgcggcttccaaagaattggatgcatctgcatttcttgcgagcgattggaactgcaatgtcaatgagagctggtattgctgccgatactgctgctgctttgcttttccgcatactttcccaaccaacactactttttccaccactgagacatgccgaaggagttgaagtacatcatgaaccactgggcggctatgtatcatcttataagaggcagttggaggttcctgcttctgaagccactatcgatgccactgcacaaggcattgcatccttgttgtgtgctcatggccctgatgtcgagtggagaatatgtaccatctgggaagctgcctatggattgctgcctctaagttcatcagcagttgatttacctgaaattgtcgtagctgccccgcttcaaccacctacactgtcatggagcctgtacttgccattattaaaagtatttgagtacttacctcgtggaagtccatctgaagcatgcttgatgaggatatttgtggcaacagttgaagctatactcaggagaacttttccttccgaaacctcagaacaatccagaaaaccaagaagtcaatctaagaaccttgctgtcgctgaactccgcacaatgatacattcacttttcgttgaatcctgtgcctcaatggatcttgcctcccggttactatttgtggtgttaactgtgtgtgtcagtcatcaagctttaccagggggcagcaaaagaccaactggtagtgataaccattcttctgaggaagtcactgagaattcaagattaacaaatggaagaaacagatgtaagaagagacagggacctgttgctacatttgattcatatgttttagctgcagtttgtgccttgtcttgtgagcttcagctgttccctttcatttctaagaacggttcaaattcaaatataaaggattccatgaagattatcgtacctggaaaaaccaatgggatcaataccgagctacaaaatagcatcaactcagcaattcttcatactcgcagaatacttggcatcttggaagctcttttctccctgaagccatcatcagttggcacctcgtggagctatagctcaaatgaaatagttgcagcagctatggttgctgctcatgtttctgagttatttcgtagatccaggccttgcctaaatgcactctctgcactgatgcgatgcaagtgggatactgagatttctaccagggcatcgtccctttaccatttgattgatttgcatggtaaaacagtgtcctccattgtgaacaaagctgagcctcttgaagctcacctgacccttacaccagttaagaggggtaatcaacagcactctgaggaaaacaatatcagctcctcggatagtggcaagatggagaacaagaatggtttaacctcacataagaaaagtggtttctcaagaccactcttgaaatgtgcagaggaggttctactaaatggagatgttgcaagtacatctgggaaagccattgcaagcttacaagtggaagcatctgatttggcaaacttccttaccatggatcggaatgggggttacggaggttctcaaactctcctaagatctgtattgtcagagaaacaagaactgtgcttctctgttgtctcactgctctggcagaagctcatagcttctcctgaaatgcagatgtctgcagaaagtacgtcagctcaccaaggatggagaaaggttgtagatgcgctttgtgatgtcgtttcagcctcaccaaccaaggcatcaactgctattgttctccaggccgagaaggactttcagccttggattgctagagatgacgagcaaggtcagaagatgtggagagtcaaccagcgaatagtgaagcttatagctgagcttatgaggaaccatgacagcccagaagcattggtgattcttgctagtgcttcagaccttctacttcgtgctactgatggaatgcttgttgacggtgaagcttgtactttgccacaacttgagcttctggaagtaaccgctcgagcagtccatctcatcattgaatggggagattcaggtttatcagttgctgatggcctctctaatctactgaagtgccgtctatcacccacaatccgctgcctttctcacccaagtgcacatgtgcgagcactcagcatgtctgtcctccgcgacatcttgaacaacggatccattacccccagcaagatcatccaaggggaacaacaacggaatggtatccagagctcgtcctaccggtgcctggcagcatccatcaactggcaggcggacgtgcagaggtgcatagagtgggaagctcacagccgccgcgccactgggctgacgcttgccttcctcagtgcagcggctaaggagctcagctgccccctcccttgctgacaagacaaggccattccctgggactgacgtcggcagccagtgcaggcagtcgctgcagggtcagcgagtaggatgctaatctctccatcagggatgacttgctggcttgttcatgatgcgatttatactgatactaggtgttgtttccaaagcatatacggggctttgctcccaaggtgccatttgctttcaatctgatgttagatgttcaagcatatgcaactgcttgtgttgtacgtaacttgtactatgcatgtaatgtaagcctgtaacgtcgttc

SEQ ID NO: 29808 - protein, 1161 aa, Panicum virgatum
  misc_feature: Ceres CLONE 1893433
  misc_feature: Functional homolog of the protein sequence given in SEQ ID NO 50888
  misc_feature: Useful for making plants with modulated flowering time
  misc_feature: Functional homolog of the protein sequence given in SEQ ID NO 50889
  misc_feature: Useful for making plants with modulated biomass
MSASNEKWIDGLQFTSLFWPPPQDVQQKQAQILAYVEYFGQFTADSEQFPEDVAQLIQSCYPWKEKRLVDEVLATFVLHHPEHGHAVVHPVLSRIIDGTLCYDRHGPPFSSFISLFSHTSEKEYSEQWALACGEILRVLTHYNRPIFKVERQRCEAECSSTSDQATSSDSTDKKSDDSLGNEPDRKPLRPLTPWITDILLAAPLGIRSDYFRWCGGVMGKYAAGGELKPPTTACSRGSGKHPQLMPSTPRWAVANGAGVILSVCDEEVARYETANLTAAAVPALLLPPPTTPLDEHLVAGLPPLEPYARLFHRYYAIATPSATQRLLFGLLEAPPSWAPDALDAAVQLVELLRAAEDYATGMRLPKNWMHLHFLRAIGTAMSMRAGIAADTAAALLFRILSQPTLLFPPLRHAEGVEVHHEPLGGYVSSYKRQLEVPASEATIDATAQGIASLLCAHGPDVEWRICTIWEAAYGLLPLSSSAVDLPEIVVAAPLQPPTLSWSLYLPLLKVFEYLPRGSPSEACLMRIFVATVEAILRRTFPSETSEQSRKPRSQSKNLAVAELRTMIHSLFVESCASMDLASRLLFVVLTVCVSHQALPGGSKRPTGSDNHSSEEVTENSRLTNGRNRCKKRQGPVATFDSYVLAAVCALSCELQLFPFISKNGSNSNIKDSMKIIVPGKTNGINTELQNSINSAILHTRRILGILEALFSLKPSSVGTSWSYSSNEIVAAAMVAAHVSELFRRSRPCLNALSALMRCKWDTEISTRASSLYHLIDLHGKTVSSIVNKAEPLEAHLTLTPVKRGNQQHSEENNISSSDSGKMENKNGLTSHKKSGFSRPLLKCAEEVLLNGDVASTSGKAIASLQVEASDLANFLTMDRNGGYGGSQTLLRSVLSEKQELCFSVVSLLWQKLIASPEMQMSAESTSAHQGWRKVVDALCDVVSASPTKASTAIVLQAEKDFQPWIARDDEQGQKMWRVNQRIVKLIAELMRNHDSPEALVILASASDLLLRATDGMLVDGEACTLPQLELLEVTARAVHLIIEWGDSGLSVADGLSNLLKCRLSPTIRCLSHPSAHVRALSMSVLRDILNNGSITPSKIIQGEQQRNGIQSSSYRCLAASINWQADVQRCIEWEAHSRRATGLTLAFLSAAAKELSCPLPC

SEQ ID NO: 29809 - DNA, 646 bp, Panicum virgatum
  misc_feature: Ceres CLONE 1893443
  misc_feature: Encodes the peptide sequence at SEQ ID NO. 29810
gagggcccgccgccatcgccctcctcctcgtgcctcaaactaacctctctctttctggtcgccagccagcgttgtccatactagcaaggcaaagcgctaggcagagcaatttcctagctagctagctagcgccgtaccggggagagagagagagagagagagagagagagagagatggcaggcggcggggtatggcggccgttgctcgccggcgcctggctgctgtggcttctcccgtgggcttcggccgtccgccggagcgacttcccggcgtccttcctcttcggcaccgccacttcctcgtaccagatcgaaggtgcttacctcgagggcaacaaaagtttaagcaattgggatgtgctcactcatctaccagggagaatcaaagatggaagcaccggggacatcgcggatgatcattaccatcgtttcgaggacgacgtcgagctgatgtactctctcggcacaaacgcttacaggttctctatatcatgggccagaatccttccaagagggagattcggcgaagtgaacccagaaggcatcaagttctacaacgaactcatcgactcactcctgctcaaaggaatagagccgttcgtcacgctgagccactacgacatgccgcaggagctggaggacaggt

SEQ ID NO: 29810 - protein, 157 aa, Panicum virgatum
  misc_feature: Ceres CLONE 1893443
  misc_feature (27)..(157): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50474
  misc_feature: Useful for making plants with altered carbohydrate content
  misc_feature: Functional homolog of the protein sequence given in SEQ ID NO 50475
  misc_feature: Useful for making plants with altered cell wall content and/or composition
  misc_feature: Functional homolog of the protein sequence given in SEQ ID NO 50615
  misc_feature: Useful for making plants with modulated biomass
MAGGGVWRPLLAGAWLLWLLPWASAVRRSDFPASFLFGTATSSYQIEGAYLEGNKSLSNWDVLTHLPGRIKDGSTGDIADDHYHRFEDDVELMYSLGTNAYRFSISWARILPRGRFGEVNPEGIKFYNELIDSLLLKGIEPFVTLSHYDMPQELEDR

SEQ ID NO: 29811 - DNA, 1599 bp, Panicum virgatum
  misc_feature: Ceres CLONE 1893451
  misc_feature: Encodes the peptide sequence at SEQ ID NO. 29812
ggccactcccccaccatctcatcccgttcctctcacaagaatcactcctgctccctcctcagatctctctcgcgagcaaaacaggcaaaactttgatcttaccccaggtaaggttacggcgggcagccatgaggcggcggccacctttccattcccgtgccgccgccgccgctgccgtgctcctgctgctgctgctgtcccccgccccgagctcccagctcggcctcggctccgccattgccgcctggatcaacggcgcgccgccgccgtctcccagccctcccgctggtgccggtgccgcctcctcatcctcggccgcgccgagccagcaggagtacacggcgctgcaggcgctgaaggcggccgtcaccgaggacccccgcggcgcgctgtcgtcgtggcggggcgccaatgtctgcgcctaccgcggcgtctactgctccgcgccgcccgacggcgcggcggccgcgggcgcgccgacggtggtggcggggatcgatctcaaccgcgccggcctccggggcacgctccccgaggcggtctccctcctggcgcacctcacgttcctccacctcaacagcaaccgcctgggcggcgccgtcccggactctctccgggacctgcagtacctgacggagctggacctcagcaacaacctcttctccggcccgttccctgcgtccacgctgctcatcccgtcgctggtgtacctggacctccgcttcaacgccttctccggcgagctcccgcccgacgtcttcgccaaggacctcgacgccgtgttcctcaacgacaaccagttcgagggccagatcccggagacgctgtggtcgtcgccggccacggtcatcacgctggccaacaaccgcttcacgggccccgtcccggccgcctacggcgggtacggcggccgggtgcgcgaggtgctgttcctgaacaacaacctgaccgggtgcgtgcccgaggcgctggggttcctgcccagcatccaggtgctggacctgagctacaacgcgctgtcggggcacctccccggcacgctgtcgtgcctgtccgggatcgaggtgctcaacgtggcgcacaaccagctgacgggggagctgccggacctgctgtgcgacctgcggcggatcacgaacctgtccgtgtccttcaacttcttctccgggatcagccagcggtgcgaccggcagctggggagccgcggcgtgttcgacttcgtgggcaactgcgtgcccgggcgggacatgcagcggccgcagcccgagtgcgaggggttcccgggggagggcgggctcagctgcctccgcatcccgggggcgcgccccgccgggtgcggcggcgacgccgccgtgtccgtgggcgtcggcgtcggagtcggaatcgggggcctgccgttcgggctgccaggcgcggccgccggggccgggggcgcggtcaccgtcaccgtgccctgatcggtcatcggtgccgctggtgcaggccgctggcattgcatcttggaatcatttcattttttttttggaggcaattagcctcgatcggcttggcgtatcgcatgtgatcgttaattacatttacatggcggcggtaacggct

SEQ ID NO: 29812 - protein, 442 aa, Panicum virgatum
  misc_feature: Ceres CLONE 1893451
  misc_feature (66)..(105): Pfam Name: LRRNT_2 Pfam Description: Leucine rich repeat N-terminal domain
  misc_feature: SWISSPROT Homolog: EC 2.7.11.1 Non-specific serine/threonine protein kinase
MRRRPPFHSRAAAAAAVLLLLLLSPAPSSQLGLGSAIAAWINGAPPPSPSPPAGAGAASSSSAAPSQQEYTALQALKAAVTEDPRGALSSWRGANVCAYRGVYCSAPPDGAAAAGAPTVVAGIDLNRAGLRGTLPEAVSLLAHLTFLHLNSNRLGGAVPDSLRDLQYLTELDLSNNLFSGPFPASTLLIPSLVYLDLRFNAFSGELPPDVFAKDLDAVFLNDNQFEGQIPETLWSSPATVITLANNRFTGPVPAAYGGYGGRVREVLFLNNNLTGCVPEALGFLPSIQVLDLSYNALSGHLPGTLSCLSGIEVLNVAHNQLTGELPDLLCDLRRITNLSVSFNFFSGISQRCDRQLGSRGVFDFVGNCVPGRDMQRPQPECEGFPGEGGLSCLRIPGARPAGCGGDAAVSVGVGVGVGIGGLPFGLPGAAAGAGGAVTVTVP

SEQ ID NO: 29813 - DNA, 654 bp, Panicum virgatum
  misc_feature: Ceres CLONE 1893466-R
  misc_feature: Encodes the peptide sequence at SEQ ID NO. 29814
tttggaccaatcaagccatttcgtcctgcggcggtcttatccatacttctccttgcaacatatcccttcatgactaacctacatgggccggagctcaagatacttgtcaacatagcatcgcttttgaagaacatgtttgctgctaccattactatcgcgtgcaacattctgcaaaacactgcagtgacacaagaacagagaggtgttgcaaatggcatctctgttactctgatgtcaatgttcaaagctgtcgctccagcagcagcagggattctgttttcatgggctcagaaacacataagcgggctgttcttaccaggtgatcagatcctgttcctgatgctaaacatggtgtccgtaattggtctagttctgacattcaagccatttttgtccctgccaaatgcgatgagcatgtgagtcgttcgtaaccctgtgtatatgaagtttgttagttgtgagttacattgggtgcactgttagattacagtcgtcggttttgaactgcaagagttcatgtattgtaatggttcatatttttcgccttatgtttagttaagtaatcagatgcgaagggctgtgaatttttgcatagaaattgaaggaccgaatgcttcattgatatcataaaatggaaatgagatactgcttgtc

SEQ ID NO: 29814 - protein, 139 aa, Panicum virgatum
  misc_feature: Ceres CLONE 1893466-R
  misc_feature: Functional homolog of the protein sequence given in SEQ ID NO 51012
  misc_feature: Useful for making plants with modulated flowering time
FGPIKPFRPAAVLSILLLATYPFMTNLHGPELKILVNIASLLKNMFAATITIACNILQNTAVTQEQRGVANGISVTLMSMFKAVAPAAAGILFSWAQKHISGLFLPGDQILFLMLNMVSVIGLVLTFKPFLSLPNAMSM

SEQ ID NO: 29815 - DNA, 1269 bp, Panicum virgatum
  misc_feature: Ceres CLONE 1893466
accactgcgttagctagtttcttccgatcctatcgagtggcacgcagctgcgagggacggtcgagaaatggccggcggcgaggagggctcgccagctgcggcggtggcgctgctgctgccgccggcgcgggaggagaggagcagcaggaggaggcgccggtgccacgagtggtgccccgggtgccggcaggaggaggcgagcaaggcgagggccggcgtcccctacctcgacttcttctacatctgggtcgtctgcctcgccgccggtcagtccggcccgcccgctcacacttctctcccggttgtcgggtttcctggcgttacggtttcttcttcttcttcttctcttggttgttcggtaggcacgcacgccagcgccagacggagcgccacccggccgctgcgtcgaaagcttccacgcgcacgcgcacgcgcaccaccccacccgtctctgccaatccagtcattgttcccgtatctgtacttcatgatcagggacttgaaaatcgcaaaagaagagcaagacattgggttctatgctggttttgttggggcaacttatttccttggaagaaccatcagtgctgtgccatggggcatgtttgctgataagtatggaaggaagccatgcattgtgattagcatcctcgcagtggttgtgtttaacacgctttttggccttagcacaacttactggatggcaattgtaactagggggttacttggattgctctgtggcatactggggccaatcaaggcctatgcttcagaagtctgcaggaaagagcaccaagctctaggaatatctcttgttacatcgtcacgagcgatcgctcttgttattggacctgctatcggaggctttcttgcacagccagcaaaaaagtaccccaatcttttctctgaagagtccatatttgggaggtttccatacttccttccttgctttgtcatatcagtactagcagctggatcttgtattgcatgcatttggcttccggaaacactgcactttcataatgatgacaaggtagaagctattgatgaactagaggcacaatctggtgactccgacttagatgctcgaaaggctaaagaatctagaggtgaatcaacaaagaatctgctaaagaattggcaattgatgtcagcaataatcctgtactgtatcttttctctgcatgacacagcttatcttgagatattttcactttgggcagttagcagcagaaaatttcagggcctgagtttgacatcccaggatgttgg

SEQ ID NO: 29816 - DNA, 725 bp, Panicum virgatum
  misc_feature: Ceres CLONE 1893491
  misc_feature: Encodes the peptide sequence at SEQ ID NO. 29817
ctgccattgcaattcttgcagaaacatatcctcttctcttactaccttccaagcatttccttgctgagtgttcggtgttcttggatctttatgcagacttcagcccatcaaagtaaagtcttccactgatcaattaatctgcaggtagctaccgacatctcttttgtatgtctaaagatctcaattccaaatacgagaggctgtaaagaatagcaatgggttgcttctctgtgttccggagcaagaagaattccagaagccagattgtgcagcatgaccaagacatcctgatcactggcaacgtgaaaatctactcgttcaaggagctaaggaaagccacaagaaacttctgcccaggaaacaagcttggacagggttccttcggccgtgtctatctgggaaagctgaataacggcgagaaagttgccatcaaggtgctctcctcagagtcaaggcaaagaacgaaggagtttctgaatgagctgagtgtcatatccaacataacccatcacaaccttgtcaaactgcatggctgctgcgtcgatggaggccagaagatgctggtctacaattatgtggagaataacagccttgcacagacccttttcggtaattcgcgaagtggcatcatctttgactggaggacaagggtgaaaatctgcatcggtgtagccgatgggctcacataccttcacgaggaaattcgggccgccgatcgtccaccg

SEQ ID NO: 29817 - protein, 169 aa, Panicum virgatum
  misc_feature: Ceres CLONE 1893491
  misc_feature (45)..(169): Pfam Name: Pkinase_Tyr Pfam Description: Protein tyrosine kinase
  misc_feature: SWISSPROT Homolog: EC 2.7.11.1 Non-specific serine/threonine protein kinase
MGCFSVFRSKKNSRSQIVQHDQDILITGNVKIYSFKELRKATRNFCPGNKLGQGSFGRVYLGKLNNGEKVAIKVLSSESRQRTKEFLNELSVISNITHHNLVKLHGCCVDGGQKMLVYNYVENNSLAQTLFGNSRSGIIFDWRTRVKICIGVADGLTYLHEEIRAADRP

SEQ ID NO: 29818 - DNA, 2405 bp, Panicum virgatum
  misc_feature: Ceres CLONE 1893495
  misc_feature: Encodes the peptide sequence at SEQ ID NO. 29819
agcggcggcgtaaacacccaaggcacctccgccccgctcagctccaaaattcccccatcccacgccacgcccgaggcggccagcggtgatgtcgtcagcggcgcccgcgcccccgccgccccagccggagtcgccgtccgccggcgccggcggtgctggcggcggcgacaaggtcctggccgcggcgcagcacatcgtcaagtccctcgcaacctccaagaacgccgccgacgacatgatccgcatcctctccggcttcgacaaccgcctctcctccatcaccaacgaccacctcttcccctccccggacccctccggctccggctccagttccgtgtccgcctcgggctcctccgcctccgagatctccgccgccgccgccttcgacgccgcggaccagctcatccagctctgggacgccaccccggaggcgctcgtcttcgaggcccccgaggacgacgtcgcgcagtacctcgcagcggtcgacgtcgccgtcgagcacctcgcgcgcgggggccccggcggcgcgcgcgcgggcgtcgccgtgcagctcgccatggcgcggcttgaggaggagctgcgccacctcatggtccgccacgccgtgccgatcgaccccacggggctcttcttctcgctgcgccgcctctcgctcgagtccatggacgacctcgacgcctcctccgagttcgacgccgccacgccgcacagcttggacggcacccccgccgggtcggagaccgcgcgcggcgccgcgctgggatccaaccccttcgaggaccaggtgttcgatcccgtgcgccctgaggccgtcgaggagctgcgcgccatcgccgaccggatggcgcgcgcgggctactcccgcgagcttgccgatgcttactgcggcgtccggcgcgacctgctcgacgagtacctctccgtgctcggtgtcgagcgcctcagcatcgacgaggtgcagcgcatcgagtggaagctgctcaatgacaagatgaagaagtgggtgcacggtgtcaagacggtcgtgcgtgtgctgcttgctggtgagcgccgcctctgtgaccaggtgcttgccgcgtccgatgaccttatggaggagtgcttccttgagtccaccaaaggatgcattatgcagattctcagctttggggatgctgtgactgtgtgcccccgctcgccggagaaggtgccccggatcctcgacatgtatgaggtgcttgcagaggtgattcctgaaatgagggacttgtgcataggaagttctggggatggtgtgatcagtgacgtgcaggccattcttgataggcttggtgatgccgtgaggggtaacctgtttgagtttgggaagatgttgcagcaggagacatcacggagggcgatgacgactggtgagatccacccgatgacacgctatgtcatgaactatttaaggttgctggttgtttacagtgaaacacttgatgtcctcctggctgatgacaatagtgatcacgatgctttcagaaattctgatgatcaggatcaggaacacttggagagcatgacccctcttggaaggcgtctcctgaagctgatatcttatttggaggccaatttggaggaaaaatctaagctctatgaagatgctgcccttgagtgcatatttgccatgaacaatttgctctatattgttcagaaggtaaaggattctgagctaggaaagattttaggtgatcactggataaaaaggcgaagtggtaagattcggcagtattcaaagagctatctaagaatttcttggaccaaacctttgtcatatttcaaggaagatggatatgggagcggaagcggaagcggaagtgggagtgggagtggcagtggcagtgggcattcaagttctaggatgtccatcaaggaaaagttcaagaacttcaatgtggcctttgaggaaatttacaggaaccaaacactctggaaagttccagatcctcaactccgggaagaactgaaaatatcaatatctgaaaatgtaattccagcatatcgtgcttttctgggcagatatggtaatcaagtagatgggggaagaaatccaggaaaatatataaaatatgcaccagaggatttggagagacatttatctgatttatttgaagggtcttcagtttctgtcaacaactctaggagaagaacatagttcatggttgacaggataatgtttcaggccttccacatgttactctgtaagtaagctataagcatgccaaaaacttgtacattctaaaacaaatccatcatccacatttgaagggtggcagggggcttaatgctgtatactttatatatatatgttattgatggatacttctgccttctgtagtacaagttggatgatgctgtatactttatatatatgttattgatgg

SEQ ID NO: 29819 - protein, 695 aa, Panicum virgatum
  misc_feature: Ceres CLONE 1893495
  misc_feature (87)..(682): Pfam Name: Exo70 Pfam Description: Exo70 exocyst complex subunit
MSSAAPAPPPPQPESPSAGAGGAGGGDKVLAAAQHIVKSLATSKNAADDMIRILSGFDNRLSSITNDHLFPSPDPSGSGSSSVSASGSSASEISAAAAFDAADQLIQLWDATPEALVFEAPEDDVAQYLAAVDVAVEHLARGGPGGARAGVAVQLAMARLEEELRHLMVRHAVPIDPTGLFFSLRRLSLESMDDLDASSEFDAATPHSLDGTPAGSETARGAALGSNPFEDQVFDPVRPEAVEELRAIADRMARAGYSRELADAYCGVRRDLLDEYLSVLGVERLSIDEVQRIEWKLLNDKMKKWVHGVKTVVRVLLAGERRLCDQVLAASDDLMEECFLESTKGCIMQILSFGDAVTVCPRSPEKVPRILDMYEVLAEVIPEMRDLCIGSSGDGVISDVQAILDRLGDAVRGNLFEFGKMLQQETSRRAMTTGEIHPMTRYVMNYLRLLVVYSETLDVLLADDNSDHDAFRNSDDQDQEHLESMTPLGRRLLKLISYLEANLEEKSKLYEDAALECIFAMNNLLYIVQKVKDSELGKILGDHWIKRRSGKIRQYSKSYLRISWTKPLSYFKEDGYGSGSGSGSGSGSGSGSGHSSSRMSIKEKFKNFNVAFEEIYRNQTLWKVPDPQLREELKISISENVIPAYRAFLGRYGNQVDGGRNPGKYIKYAPEDLERHLSDLFEGSSVSVNNSRRRT

SEQ ID NO: 29820 - DNA, 446 bp, Panicum virgatum
  misc_feature: Ceres CLONE 1893516
  misc_feature: Encodes the peptide sequence at SEQ ID NO. 29821
  misc_feature (287)..(287): n is a, c, t, g, unknown, or other
  misc_feature (296)..(296): n is a, c, t, g, unknown, or other
aaagggcgaggtgatagagagacaaggggagaggggatcacgaggcgtgctacctcctccgcccaatccggccccaaccaaatccccgccagcgccgccgcctttacctccgccccggagctaaaagggtgggccaggctcggttcctggatcgcggggtcacgggacgcgcgccgcggccgggtgctgggctgctggtgctggtgggaggactgatcgggcgacctctggcctctgggtctgggcggcgctggcgggatagggagaggctagaacggagggcgcgncggggaggnagggaggccagccgaggatggaccgggcggcggtgaccgtggggcccgggatggacatgcccataatgcacgatggcgaccgctacgagctcgtccgcgacatcggctccggcaacttcggcatcgcgcgcctcatgcgcaaccgcgccg

SEQ ID NO: 29821 - protein, 44 aa, Panicum virgatum
  misc_feature: Ceres CLONE 1893516
  misc_feature: SWISSPROT Homolog: EC 2.7.11.1 Non-specific serine/threonine protein kinase
MDRAAVTVGPGMDMPIMHDGDRYELVRDIGSGNFGIARLMRNRA

SEQ ID NO: 29822 - DNA, 940 bp, Panicum virgatum
  misc_feature: Ceres CLONE 1893533
  misc_feature: Encodes the peptide sequence at SEQ ID NO. 29823
cccgtccctggtagaacattccagagcccctgctctcccctctcccaataaaatcccctcaaaccccacgatcctctcccatctcatccctccctccctcgcgctcccgctcctcacaaaacctactcgcttcctcccttgagccgccgccgcctcttctctcctcgcgttcgggaagggcctcgcaatggcctcggagacggagacgttcgccttccaggcggagatcaaccagctgctctccctcatcatcaacaccttctactccaacaaggagatcttcctcagggagctcatctccaactcctccgatgcattggacaagatcaggttcgagagcttgacggacaagagcaagctggatgcccagccagagctgttcatccacattgttcctgacaaggcctccaacactctgacaatcattgacagtggtattggtatgaccaagtctgatcttgtgaacaaccttggtaccattgcgcggtcaggcacaaaggagttcatggaggctctggctgctggtgctgatgtttctatgattggccagtttggtgttggtttctactctgcctaccttgttgctgagagagttgttgtgaccactaagcacaacgatgatgagcagtacgtgtgggagtctcaggctggtggctccttcactgtcacgcgtgatacctctggggagccccttggcaggggtaccaagatgaccctctacctcaaggatgatcagttggagtaccttgaggagcgtcgcctcaaggatctgatcaagaagcattctgagttcatcagctacccaatctctctctggacagagaagaccactgagaaggagatttccgatgatgaggatgaggaagataagaaggatgaggagggcaaggttgaggatgttgacgaggagaaggaagggaaggagaagaaagagagggac

SEQ ID NO: 29823 - protein, 250 aa, Panicum virgatum
  misc_feature: Ceres CLONE 1893533
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHIVPDKASNTLTIIDSGIGMTKSDLVNNLGTIARSGTKEFMEALAAGADVSMIGQFGVGFYSAYLVAERVVVTTKHNDDEQYVWESQAGGSFTVTRDTSGEPLGRGTKMTLYLKDDQLEYLEERRLKDLIKKHSEFISYPISLWTEKTTEKEISDDEDEEDKKDEEGKVEDVDEEKEGKEKKER

SEQ ID NO: 29824 - DNA, 645 bp, Panicum virgatum
  misc_feature: Ceres CLONE 1893533-R
  misc_feature: Encodes the peptide sequence at SEQ ID NO. 29825
ttcgagggcctctgcaaggtgatcaaggaggtgctgggtgacaaggttgagaaggttgttgtctctgaccgtgtggtggactccccctgctgtctagtcactggtgagtatggctggactgccaacatggagaggatcatgaaggcccaggcgctgagggactccagcatgtccggatacatgtcctccaagaagaccatggagatcaaccctgagaatgccatcatggaggagctccgcaagcgtgctgaggctgacaagaatgacaagtctgtcaaggaccttgtcatgctgctgttcgagactgcgctcctcacctccggcttcagcctcgacgaccccaacaccttcggcagccgcatccaccgtatgctcaagctgggcctgagcatcgacgaggacgaggctccggaggctgactcagacatgcccccgctggaggacgacgctggcgagagcaagatggaggaggtcgactaagcgctgtgcggtggttttttacgttcgacttgttagcttagctattcgggttgccagtctatgaacctcgagttgtcggtttattttgtgtggtgtgcctttgattatcgaactacttatgttaattgtcggtggtataatagtattattatcctgctgtcttcc

SEQ ID NO: 29825 - protein, 159 aa, Panicum virgatum
  misc_feature: Ceres CLONE 1893533-R
  misc_feature (1)..(159): Pfam Name: HSP90 Pfam Description: Hsp90 protein
FEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADSDMPPLEDDAGESKMEEVD

SEQ ID NO: 29826 - DNA, 1319 bp, Panicum virgatum
  misc_feature: Ceres CLONE 1893539
  misc_feature: Encodes the peptide sequence at SEQ ID NO. 29827
actgtcgccgcgctccagctctgctctcccccgtccaccaacgctttaccctttcccctccagcgccgggggaatcgcgccgggcgccccccaaccccaatccccgaaagagaagctcccggctccaaatcaaacttccctccgccttcctgcctcctaccctcgccggcgcggcttttagttttatttccacccaagattagcctccagctcaagccaactcattcagctcggtctcgatggaagccgatgacgccgctgccaagcttcggaacatcaacgacgcgatggatgaggtgcgcctcagaagcctcggctgtaggagatgcaccatcgaggaggcgataggggacatgtccagcaagaacttggagcggaatcgcaggttctaccgcacgctgcaggctaccgccgacctcgccgaggttgacccatgggatctgccgcggcgattcatcatgccgaagaagccggggagctcaagcctgcggacacattctgggtactggaaagagaaagaagatgagttcaccgcgatgcgctccaatggaggaggagaaggctcgtcctcgccctccagctcgccgtcctaccatggggttacgaggaccctggagttttacgagcacaacggcaccaagacggactgggtcatccacgagtacaacctgctcgataatgacatgtttgtctagttgtaggaggatgtggtctttcgtaaggtattcaacaaaaagcacacagatcgggtcccatattattcaaagggtgttgacgtagacctggaagtttaccttgatgcagcactcgccaaccccgaacacaacaaggacatgatggcggatctgcaaagtgctatgcttcatttttactatttctgcgtgcccgagttgatgagttggagaggtcttgataaagaaagatacgagcgtaggaagtttctaactgcgtctgctgctccagatagagaatcatcagacgatgtttggcagcacttcaccaggataaacaccaaagatcccgatgtggtgtacgcagcgtgccaccactgtgacagggtgctcagggctcattccaagaatggcacttctcacctcagaaggcaccgtaagagcaagacatgtacatgcaacaacaatccattgtccaccactgaagaccaggagatcctgcgtgagcttcgcgcaaaccttgatctctacaagcaggggaatatggagggaagggtcgactctccggagctcaacgctagtgtggatccatgggatctttccaccccacgctactgcacgaacttgctaagcctgaagacgcatcag

SEQ ID NO: 29827 - protein, 160 aa, Panicum virgatum
  misc_feature: Ceres CLONE 1893539
  misc_feature (48)..(97): Pfam Name: zf-BED Pfam Description: BED zinc finger
MADLQSAMLHFYYFCVPELMSWRGLDKERYERRKFLTASAAPDRESSDDVWQHFTRINTKDPDVVYAACHHCDRVLRAHSKNGTSHLRRHRKSKTCTCNNNPLSTTEDQEILRELRANLDLYKQGNMEGRVDSPELNASVDPWDLSTPRYCTNLLSLKTH

SEQ ID NO: 29828 - DNA, 653 bp, Panicum virgatum
  misc_feature: Ceres CLONE 1893539-R
gtgaggttggtcaatgtgatcaatcacggcttggaaagcgcaagagaactggtggtccggatgggttggtcaatgtgatcaatcacggcttggaaagcgcaagagaactggtggtccggatggtggatcagaagtttggttgtatttcactaagatttacaccacagatcctggcagggtgtatgcagtgtgccactgttgtgacaggggctacaagtttcatgcgaagaacggcacctctcagttcataaggcacaacaaatcatgctcaagcaagcgccagaaagtgtagaggaagaatcagtttggcaatttgtacagtcttcaggaaatatgaacctcagaacaggaggagtgaatgcgctgaagctaggaacgaaaaggatgaccttaagctgtcttttccttcttctcaatgtttccttttctcagtttgttttaggcttgatctatcctaaaagtactgtctttattccgaaaataatgtagtgtcagtatggctaagtcgttgagttctatctgaggtcgttttacttttaggtacaatgatacttgtgccacttaatctatgatttggatattggaggagtaatatcttctgtatataaaatgtggaggttgatttaatagtaagatgtatttgatttgggatc

SEQ ID NO: 29829 - DNA, 506 bp, Panicum virgatum
  misc_feature: Ceres CLONE 1893548
  misc_feature: Encodes the peptide sequence at SEQ ID NO. 29830
aagaagagcctccgcctccgcctcctcctcctccggtacccgagctcttctccactccacgtctcctccagccgcccatccatcggaactaccaagctccgagacacagccacgaaccttttcagttcagctgtgccgttgagacacatggagtgcgagaacggacacgtcgccgccgccaccggcaatggcgtgtgcctgcgggtgccgccgcgggccgaccccctgaactggggcaaggcggcggagaacctggccgggagccacctggaggccggcaagcggatggtggaggagtaccgcagggcgctggtgaggatcgagggcgccagcctcacggtcgcccaggtcgccgccgtggccgcggccggcgaggcccaggtggagctcgacgagtccgcccgcggccgcgtcaaggccagcagcaactgggtcatgagcagcatgatgaacggcaccgacagctacggcgtcaccaccggcttcggcgccacctcccaccgccg

SEQ ID NO: 29830 - protein, 119 aa, Panicum virgatum
  misc_feature: Ceres CLONE 1893548
  misc_feature: SWISSPROT Homolog: EC 4.3.1.5 Phenylalanine ammonia-lyase
  misc_feature: Functional homolog of the protein sequence given in SEQ ID NO 51172
  misc_feature: Useful for making plants with altered cell wall content and/or composition
  misc_feature: Functional homolog of the protein sequence given in SEQ ID NO 50787
  misc_feature: Useful for making plants with altered lignin content
MECENGHVAAATGNGVCLRVPPRADPLNWGKAAENLAGSHLEAGKRMVEEYRRALVRIEGASLTVAQVAAVAAAGEAQVELDESARGRVKASSNWVMSSMMNGTDSYGVTTGFGATSHR

SEQ ID NO: 29831 - DNA, 557 bp, Panicum virgatum
  misc_feature: Ceres CLONE 1893551
  misc_feature: Encodes the peptide sequence at SEQ ID NO. 29832
gcgcgatcctcttttcagggccgggcgcggcgttccttgcgagttgcgaccgagcacgcgcgcacaggcgggagacagcagccgccgcctgagggccggacggactccgtcgtggccatccgagggttttaatttgagggcggcgcgcgcgagcggggcgatagatggcgatggcggccgcggcggcgcccgcgttgtcgccggggacggtgccgctgggcgtgctgctgcggcgggaggtgaccaaggagcggatggagcgccccgacgtgctgtgcggggaggccagccgcagccgcaagggcgaggacttcacgctgctccgcgccggcgccggacagcgcgtcgccggggacccctccaccgccttctccgtcttcgcgctgtttgatgggcacaacggatctggagctgccatatacgctaaggagaatctgctgcacaatgtcttgcgtgccattcctacgtgcttgagcagggatgagtggcttgctgtgctcccacgtgcgcttgttgcagcatttgtcaagacagacaaggatttccagagagtagct

SEQ ID NO: 29832 - protein, 130 aa, Panicum virgatum
  misc_feature: Ceres CLONE 1893551
  misc_feature: SWISSPROT Homolog: EC 3.1.3.16 Phosphoprotein phosphatase
MAMAAAAAPALSPGTVPLGVLLRREVTKERMERPDVLCGEASRSRKGEDFTLLRAGAGQRVAGDPSTAFSVFALFDGHNGSGAAIYAKENLLHNVLRAIPTCLSRDEWLAVLPRALVAAFVKTDKDFQRV

SEQ ID NO: 29833 - DNA, 1149 bp, Panicum virgatum
  misc_feature: Ceres CLONE 1893553
  misc_feature: Encodes the peptide sequence at SEQ ID NO. 29834
aagacgaccatggtggcgagagagacatgggattttttttttttactcgccgcggtaaccggttcttgtgcacactagagctccatgtggccaccgggcgcggttcggcgatggtagtttcgtcaccccgcctgcgctgcaccgcacgccaatggtgctagtgctagcatggtgggaggtttagttttgtcccaggcgcagtcgcaccaggtcgctgcgccgagaaccgccgcgccggcgccgttgccggcgcaggcgctggagaagaggctgagggagcaggcggcggcgccatgtggtacggcggcgacggccgtctcggtgcggagcgtggacgatgtcaggaaggcgcacgcgaggcacatcaagctgggcctcgaccgctccccgcggcacgcgcggccgctgctcgcggcgtgcgcgctctcgggctggccaggcggcacggagctcgcggcctccatcttcgactcgctcgacgagccggaggccttcgactacaacaccctgatgcgcggccacgtcagcggcggccgcgacccggcgscagcgctgcgactgtacgctgacatgctgggggccggcgtggagcccgacaactacacgttcccgttcgtcctcaaggcgtgcgcgcagctcgcggccttgcaagaagggaggcagctgcaggcgcacatcgtgaagcttgggttccagcacgacgagcatgttcagaacagcctcatcagcttctacggcaagtgcggcgagccgacgatggctcgccgggcgttcgaccggacggaggccggggagcggacggcggcctcctggagcgcgctcctcgcggcgtacacgagggccgggctgtggggcgagtgcctcgagtcgttcggcgcgatggtgcgggaggggtggaggcccgacgagagctccatggtcagcgccctctcggcgtgcgcgcacctgggcgcctacgacgtcgggcggagcatccactgcgcgctgctgaggaacgccgcgaggctcaacaccatcatggagacgtccctggtggacatgtacgccaagtgcggctgcatcgagaaggccgcggcggtgttcgacgcaatggggcggcaagaacgcgggggcgtacagcgccatggtgtcccggcctggcgctgcacg

SEQ ID NO: 29834 - protein, 326 aa, Panicum virgatum
  misc_feature: Ceres CLONE 1893553
  misc_feature (213)..(247): Pfam Name: PPR Pfam Description: PPR repeat
  misc_feature (127)..(127): Xaa is any aa, unknown, or other
MVGGLVLSQAQSHQVAAPRTAAPAPLPAQALEKRLREQAAAPCGTAATAVSVRSVDDVRKAHARHIKLGLDRSPRHARPLLAACALSGWPGGTELAASIFDSLDEPEAFDYNTLMRGHVSGGRDPAXALRLYADMLGAGVEPDNYTFPFVLKACAQLAALQEGRQLQAHIVKLGFQHDEHVQNSLISFYGKCGEPTMARRAFDRTEAGERTAASWSALLAAYTRAGLWGECLESFGAMVREGWRPDESSMVSALSACAHLGAYDVGRSIHCALLRNAARLNTIMETSLVDMYAKCGCIEKAAAVFDAMGRQERGGVQRHGVPAWRC

SEQ ID NO: 29835 - DNA, 183 bp, Panicum virgatum
  misc_feature: Ceres CLONE 1893553-R
tagtgggattggttgttgatgttatagaggtaggtgtaggggttttgtaggataataggagaggggattgggtgatagtttgtgatatgagaatgggtagtggggttttgtaagttggtggtaaggtaggagatttgttagttggtgtttgtggttggggtggtatgatttgagggtggtgga

SEQ ID NO: 29836 - DNA, 507 bp, Panicum virgatum
  misc_feature: Ceres CLONE 1893564
  misc_feature: Encodes the peptide sequence at SEQ ID NO. 29837
gtctgcaagtgcctcttctacatcaacagcgtggatttcggtgacgatgacgacacgggagacacctcagaaccggctgaggagacaccgttcttctccctacacgtggtcgcgggcgtgcccatttgcaacacggtgcaactcaagttggatctgggcgcagcttcctttattgctctcgtcaacacgggatcaacccacagcttcatcggtgaggctgcagcacagcgcacggggtggaccatacaaccccgccctagactcacggcgacagtggccaacggcgagaaggttgcatgccctggtgtccttcgccaggcgccggtcaccatcaacggcaaggagttctgcgtcgacctctttgtcatgcctcttgctggatatgatgtggtccttggcacggagtggatggccatgttggcacccatagtctgggacttcgccactcggaccattacgttccagcacgaggggcgcgacgtctgttggcgcggtgtgccgccgcca

SEQ ID NO: 29837 - protein, 168 aa, Panicum virgatum
  misc_feature: Ceres CLONE 1893564
  misc_feature (44)..(160): Pfam Name: RVP_2 Pfam Description: Retroviral aspartyl protease
VCKCLFYINSVDFGDDDDTGDTSEPAEETPFFSLHVVAGVPICNTVQLKLDLGAASFIALVNTGSTHSFIGEAAAQRTGWTIQPRPRLTATVANGEKVACPGVLRQAPVTINGKEFCVDLFVMPLAGYDVVLGTEWMAMLAPIVWDFATRTITFQHEGRDVCWRGVPP

SEQ ID NO: 29838 - DNA, 503 bp, Panicum virgatum
  misc_feature: Ceres CLONE 1893572
  misc_feature: Encodes the peptide sequence at SEQ ID NO. 29839
gccaatcaatcaaggggagcaaatgcaaatgtacatggccagcagcagctccggccaccgctctccacggcgctccgccgcaacggcggcgctggtgctcgcgactgccggcctcctcctcctgctgccaccactggcacgcgggtcgacgtccaccgagcagcagcagctgctgcagcagcaggaggaggaccgcatcctgggactgccggggcagcccaacggcgtggcgttcgacatgtacggcggctacgtcaccgtcgacgagcaggccggccgcgcgctctactactggttccaggagacggccgacccaggcacggcgccgctcctcctgtggctaaacggcgggcccgggtgctcctccatcggcggcggcgcgctggaggagctcggcgcgttccgcgtccacaccgacgcggcgaacgtgctcttcttagagtcgccggccggcgtggggttctctgacaccaacaccagctccgacctcctcgtcggcgacg

SEQ ID NO: 29839 - protein, 160 aa, Panicum virgatum
  misc_feature: Ceres CLONE 1893572
  misc_feature: SWISSPROT Homolog: EC 3.4.16.6 Carboxypeptidase D
MQMYMASSSSGHRSPRRSAATAALVLATAGLLLLLPPLARGSTSTEQQQLLQQQEEDRILGLPGQPNGVAFDMYGGYVTVDEQAGRALYYWFQETADPGTAPLLLWLNGGPGCSSIGGGALEELGAFRVHTDAANVLFLESPAGVGFSDTNTSSDLLVGD

SEQ ID NO: 29840 - DNA, 392 bp, Panicum virgatum
  misc_feature: Ceres CLONE 1893574
  misc_feature: Encodes the peptide sequence at SEQ ID NO. 29841
aacaacagctagctggccccatttcagcttcagcagccagatgggctcccccgtgaaaagcctaacggcgccacccggaacggttctcccccgggccgtggccggcggcgggtaacccgattcgaacggccccgccgcccccatggggcgcggcgccgccgccgcgctggcggcgtggcacgcttttccggaagaaggttgggaagatggcttttccttcctccccgcggaatcggaacggggggcccgcgcggccggctggcgctcctgggttcccggcgagcgccgcttgcgccgccgcctcgccgttgccaagtggtacgctgcattcccggaagaagccgtccaacggtttccgttcgtacgggccggcgaaggccagggcaaagctc

SEQ ID NO: 29841 - protein, 83 aa, Panicum virgatum
  misc_feature: Ceres CLONE 1893574
  misc_feature: Functional homolog of the protein sequence given in SEQ ID NO 50502
  misc_feature: Useful for making plants with altered carbohydrate content
MGRGAAAALAAWHAFPEEGWEDGFSFLPAESERGARAAGWRSWVPGERRLRRRLAVAKWYAAFPEEAVQRFPFVRAGEGQGKA

SEQ ID NO: 29842 - DNA, 2012 bp, Panicum virgatum
  misc_feature: Ceres CLONE 1893591
  misc_feature: Encodes the peptide sequence at SEQ ID NO. 29843
aagccgagcgccagttcaaagcctcagcgagcgaggggagtgaggaagagagtggaacacgagagaagcgcgctagctaaagccatggcgacccccgatgactgtggcacctggctgctgtacctatcccttgccgccaaatgcggcggcgaccagccttaccgcctcgccggcttcctggcggtctgcgccgccgcctgcgtcgtcacgtgcctcctccactggtgcttccctggaggcccggcgtgggggcggtggtggtgggcacggcgggtcggcggcgcggcggccgtgccggggccgaggggcctgccggtgatcgggagcatgtggctcatgacggggctcgcgcaccgcaagctcgcggcggcggcggagcgcctgcgcgccaggcggctgatggcgttctccctcggcgagacccgggtggtggtggccgcgcacccgggcgtggcccgggagatcctcaacagcccggcgttcgcggaccggcccatcaaggagtccgcgtacgggctcctgttccaccgcgccatcgggttcgcgccccacggcgcctactggcgcgcgctccggcgcgtggcgtccacgcacctcttctccccgtggcaggtcgctgcctcgggcgcgcagcgcgcggtgatcgcgcggcagatggccgccgccgtcagggacatgtcggccgccgggcgcgacgtcgaggtccgccgcgtcctccggcgcgcgtccctgcacaacgtgatgtggtcggtgttcggccggcggtacaacctggagctggaccccgccagggagagccccgagacgcgggagctgaggagcctcgtggacgaaggctacgacctgctgggcgtgctcaactggtccgaccacctcccctggctcgcgcggttcgacctgcagggcacccgggccaggtgcgagcgcctcgtcccgcgcgtgaaccgcttcgtcggcggcatcgtcgacgagcaccgcgcccggaacgccgccccacccgccgtcgtggacttcaccgacgtcctcctctccctgcagggcgacgacaggctggccgagcctgacatggtcgccgtcctctgggaaatggtgttccgtggaactgacaccgtcgccgtgctgatggaatgggtgctggcccggctggtgctgcaccctgacgcgcaggcccgcgtgcacggcgagctggaccgcgtggtcggccgcgaccgcgccgtgaccgagtccgactcggcgtcgctggtgtacctgcacgccgtgatcaaggaggtgctcaggctgcacccgccgggcccgctactgtcgtgggcgcggctcgccacgtcggacgtgcacgtggacgggcacctcgtccccgccggcaccaccgccatggtgaacatgtgggccatcacgcacgaccccgacgtgtgggccgagccggcggagttccggccggagaggttcgctgccggagcagcggaggcctcgctctcggtgatggggtcggatctccggctcgcgccgttcggggccgggcggcgcagctgccccgggaagagcctcgccatggccacggtggcgttctggctcgccgcgctgctgcacgagttcgagctgctgccgtcgcccgacccggcccgcggcgtcgacctgtcggaggtgctcaggctgtcgtgcgagatggccgccccgctggcggtgacggcgaggccccggcgagcggtgtgatgacgcgcgtgcgacggcggacgtaccggccatatctcgtcatcagtcggagtcactcagtgggggtctcgctctaggctacgcgtgcttggtgcaggcgctactagaggtaagtggtaacaagtaaagcgccgtgccgctgcttttggggaggcgttgctacctaccggtgatgatcagctggcaagttgctgctaccactcgatcgacatgggtatatgctttccatgttaccatctcggatggatgcatggaccaggtgctgaatgtgatattttggcttgtaccattagctactctct

SEQ ID NO: 29843 - protein, 541 aa, Panicum virgatum
  misc_feature: Ceres CLONE 1893591
  misc_feature (70)..(531): Pfam Name: p450 Pfam Description: Cytochrome P450
  misc_feature: SWISSPROT Homolog: EC 1.14.13.21 Flavonoid 3'-monooxygenase
  misc_feature: Functional homolog of the protein sequence given in SEQ ID NO 51217
  misc_feature: Useful for biocontainment applications
  misc_feature: Useful for making plants with modulated flowering time
  misc_feature: Useful for making plants with modulated nitrogen use efficiency
MATPDDCGTWLLYLSLAAKCGGDQPYRLAGFLAVCAAACVVTCLLHWCFPGGPAWGRWWWARRVGGAAAVPGPRGLPVIGSMWLMTGLAHRKLAAAAERLRARRLMAFSLGETRVVVAAHPGVAREILNSPAFADRPIKESAYGLLFHRAIGFAPHGAYWRALRRVASTHLFSPWQVAASGAQRAVIARQMAAAVRDMSAAGRDVEVRRVLRRASLHNVMWSVFGRRYNLELDPARESPETRELRSLVDEGYDLLGVLNWSDHLPWLARFDLQGTRARCERLVPRVNRFVGGIVDEHRARNAAPPAVVDFTDVLLSLQGDDRLAEPDMVAVLWEMVFRGTDTVAVLMEWVLARLVLHPDAQARVHGELDRVVGRDRAVTESDSASLVYLHAVIKEVLRLHPPGPLLSWARLATSDVHVDGHLVPAGTTAMVNMWAITHDPDVWAEPAEFRPERFAAGAAEASLSVMGSDLRLAPFGAGRRSCPGKSLAMATVAFWLAALLHEFELLPSPDPARGVDLSEVLRLSCEMAAPLAVTARPRRAV

SEQ ID NO: 29844 - DNA, 582 bp, Panicum virgatum
  misc_feature: Ceres CLONE 1893600
  misc_feature: Encodes the peptide sequence at SEQ ID NO. 29845
cttcatggaatgtttcaatgttggtacctctatgaactagatacatcagatttggtgttcttcccaaaagaagctatgctagagcgcttcgctgtagctcgcagctctgctggaggccttcgcgccgccggtgaaggggcgacgccagattccgctcttccctaaagggctaaggcagctgaggctcatggtcctgcagctgcggcgaatgactactgcttcatgtgaatcttaaacatatggtctctcgtcctaactcctaagcgaaaacgtttttttctgtcccagggacaagagccaagataagccttgtgtgggggagcatggatattaaactccacgaccttgaaactatcacaaacaatttctcggaggagcataaagttggcagtggtggatatggcgatgtttacaggggttggtataaggggcaagagattgctatgaagaagcttcatcagctgcaaggacttgacgataaggcgtttcactctgaattccgtaaccttatcaaggtccaccatcaaaatgtcgttcggttaattggctactgctacgaatcacgacataaatacctcgacc

SEQ ID NO: 29845 - protein, 86 aa, Panicum virgatum
  misc_feature: Ceres CLONE 1893600
  misc_feature: SWISSPROT Homolog: EC 2.7.11.1 Non-specific serine/threonine protein kinase
MDIKLHDLETITNNFSEEHKVGSGGYGDVYRGWYKGQEIAMKKLHQLQGLDDKAFHSEFRNLIKVHHQNVVRLIGYCYESRHKYLD

SEQ ID NO: 29846 - DNA, 1241 bp, Panicum virgatum
  misc_feature: Ceres CLONE 1893617
  misc_feature: Encodes the peptide sequence at SEQ ID NO. 29847
gtgtcaccagggccaccaagctctcccccaccccgcttgcagcagcggcctcctcagaagcctagcagctcttcctcgccccaacagccgtttcccagatctttttcagcaccggcactccagcagggcacagcaagggcatctactcgggcatttttcgcctgatccagtccaaccggagagactgcaagacagtgaaaccattggactccgcttagaaacttcctgatatttctaagggccgataaggccacgctcacgtggagcccacacgtcagtggcccgagtcccgctgacttaagtcagcggagactcatcccgataaggcagggaatgagtacaaccaaggtgaagagacgtgtggggaagtatgagctcggtcggaccataggtgaaggcacattcgcaaaggtcaggttcgcaaaaaacactgagacaggcgaaccagtagccatcaaggtcgtagataaggagaaggtcctcaagcacaagatggtggaacagattaagcgggaaatttcaacaatgaagttgatcaagcatcccaatgttgttcgcatatatgaggtgatgggaagtaaaacaaagatctacattgtgttagaatatgctacaggtggcgagctctttgacataattgctaaccatggtcgaatgagggaagatgaggccaggaggtacttccaacaattaatcaatgcagttgattattgtcacagcaggggtgtgtaccaccgggatctaaaacctgaaaatgtactgctcgattcatatggaaacctgaaggtctctgactttgggctgagcgccctatctcagcagatcaaggatgatggattgctgcacacaacttgtggaactccgaactatgttgcaccagaggtccttgaagatcaaggctatgatggtgcaatggctgatttgtggtcatgtggagttatcctgtttgttctgctagcagggtatttgccttttgaggactctaatcttatgacgttgtataagaaaatatcaaatgcagaatttacatttccaccgtggacgtcttttcctgcgaagaggctgttaacaagaatccttgatccaaatccaatgacgagaataacaatccatgaaatattagaggatgagtggttcaaaaagggctacaagcgcccggaatttgacgaaaaatatgacaccacattggatgatgtggatgctgtcttcaatgattcagaagagcaccacgtgacagaaaa

SEQ ID NO: 29847 - protein, 302 aa, Panicum virgatum
  misc_feature: Ceres CLONE 1893617
  misc_feature (13)..(268): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MSTTKVKRRVGKYELGRTIGEGTFAKVRFAKNTETGEPVAIKVVDKEKVLKHKMVEQIKREISTMKLIKHPNVVRIYEVMGSKTKIYIVLEYATGGELFDIIANHGRMREDEARRYFQQLINAVDYCHSRGVYHRDLKPENVLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIHEILEDEWFKKGYKRPEFDEKYDTTLDDVDAVFNDSEEHHVTE

SEQ ID NO: 29848 - DNA, 659 bp, Panicum virgatum
  misc_feature: Ceres CLONE 1893617-R
  misc_feature: Encodes the peptide sequence at SEQ ID NO. 29849
agagcaggattcaaaagagaaacaaggttcacctcaaaatgtccacccaaggaaattgtccgcaagattgaggaagctgcaaaacctctaggattcgatgttcagaagaaaaattacaagttgaggctcgaaaaggtgaaagcagggaggaaaggaaacctcaatgttgctactgagatactacaagttgcaccctctcttcatatggtagaagtccgaaaagcaaaaggcgacactctggaattccataaattctacaagtacctttccaagaccttaaaggacgttgtctggaaatccgaggatctgcaaatgcaacctgctgcttagcactcggcagaacctaaggagaggaaggatggaaaactatttgtgtctcattcttccaagcagattccattttggtagcctggatcagcaaatatgttctccgaattatatatgtactggtgtggcccagcaaattgtgctggtcctccactactgttgtaaatgctgcattttgagaggtcgcgttgcttgctgtagactgtagttggagtgaagctcgttcagtagattttgtcagtatgtgagctttgtaaattcatgtatgccaatgaatcatgttgaaacaccatgcacaaaatccgcgaaatgaagccaagtatggtttttgc

SEQ ID NO: 29849 - protein, 109 aa, Panicum virgatum
  misc_feature: Ceres CLONE 1893617-R
  misc_feature (3)..(36): Pfam Name: NAF Pfam Description: NAF domain
  misc_feature: SWISSPROT Homolog: EC 2.7.11.1 Non-specific serine/threonine protein kinase
RAGFKRETRFTSKCPPKEIVRKIEEAAKPLGFDVQKKNYKLRLEKVKAGRKGNLNVATEILQVAPSLHMVEVRKAKGDTLEFHKFYKYLSKTLKDVVWKSEDLQMQPAA

SEQ ID NO: 29850 - DNA, 713 bp, Panicum virgatum
  misc_feature: Ceres CLONE 1893636
  misc_feature: Encodes the peptide sequence at SEQ ID NO. 29851
gaagagcctccgcctccgcctcctcctcctccggtacccgagctcttctccactccacgtctcctccagccgcccatccatcgcaactaccaagctcccagacacagccacgaaccttttcagttcagctgtgccgttgagacacatggagtgcgagaacggacacgtcgccgccgccaccggcaatggcgtgtgcctgccggtgccgccgcgggccgaccccctgaactggggcaaggcggcggagaacctggccgggagccacctggaggccgtcaagcggatggtggaggagtaccgcaggccgctggtgaggatcgagggcgccagcctcacggtcgcccaggtcgccgccgtggccgcggccggcgaggcccaggtggagctcgacgagtccgcccgcggcagcgtcaaggccagcagcaactgggtcatgagcagcatgatgaacggcaccgacagctacggcgtcaccaccggcttcggcgccacctcccaccgccgcaccaaggagggcggcgcgctccagagggagcttatccgattccttaacgccggggcgttcggcaccggcgacgacggtcacgtgctggcggcgtcggccacgcgcgccgccatgctcgtccgcatcaacaccctgctccagggctactccggcatccgcttcgagatcctcgaggggatcgccgcgctgctcaacgccaaagtcaccc

SEQ ID NO: 29851 - protein, 189 aa, Panicum virgatum
  misc_feature: Ceres CLONE 1893636
  misc_feature: SWISSPROT Homolog: EC 4.3.1.5 Phenylalanine ammonia-lyase
  misc_feature: Functional homolog of the protein sequence given in SEQ ID NO 51172
  misc_feature: Useful for making plants with altered cell wall content and/or composition
  misc_feature: Functional homolog of the protein sequence given in SEQ ID NO 50787
  misc_feature: Useful for making plants with altered lignin content
MECENGHVAAATGNGVCLPVPPRADPLNWGKAAENLAGSHLEAVKRMVEEYRRPLVRIEGASLTVAQVAAVAAAGEAQVELDESARGSVKASSNWVMSSMMNGTDSYGVTTGFGATSHRRTKEGGALQRELIRFLNAGAFGTGDDGHVLAASATRAAMLVRINTLLQGYSGIRFEILEGIAALLNAKVT

SEQ ID NO: 29852 - DNA, 470 bp, Panicum virgatum
  misc_feature: Ceres CLONE 1893641
  misc_feature: Encodes the peptide sequence at SEQ ID NO. 29853
aaacccacggacgcattcccactcgtcgccatccagcacagctcatcagatataagcttagcgcgccacccctttccgccctcccgtccactgccattgcccctccaagaaccgagagaacgaacggaagccaccgacccgggccgtcgtctcgtcctaggccggcccggcgccacccccgcccccgcgccatgcccagcggcgccgcgctcctcctcgccctgctggagctggcggcggccgccgccatcggcccggccccggccaatgccgcggagtcgtacgaccaccgcgccgtggtcagcaaggggcagcgccgcttcctcatatcgggctccatccactacccgcgcagcgcgccggagatgtggccggacctgctccagaaggccaaggacggcggcctcgacgtgctccagacgtacgtgttctggaacgggcacgagcccgtgcaggggcagtactacttc

SEQ ID NO: 29853 - protein, 92 aa, Panicum virgatum
  misc_feature: Ceres CLONE 1893641
  misc_feature: SWISSPROT Homolog: EC 3.2.1.23 Beta-galactosidase
  misc_feature: Functional homolog of the protein sequence given in SEQ ID NO 51152
  misc_feature: Useful for making plants with altered carbohydrate content
  misc_feature: Functional homolog of the protein sequence given in SEQ ID NO 51324
  misc_feature: Useful for making plants with altered cell wall content and/or composition
MPSGAALLLALLELAAAAAIGPAPANAAESYDHRAVVSKGQRRFLISGSIHYPRSAPEMWPDLLQKAKDGGLDVLQTYVFWNGHEPVQGQYY

SEQ ID NO: 29854 - DNA, 1735 bp, Panicum virgatum
  misc_feature: Ceres CLONE 1893642
  misc_feature: Encodes the peptide sequence at SEQ ID NO. 29855
aacggcgccccattttatctcttcccatctccagctcccccaccgcccattcccacgcgccatcgccgccacggccacggccatggccgccgccgcctcgtgctcccacccgcccttcagccccgccgcgtctctacaccaccgaccccacggggcccgccgctgcggcttctccccgctgccgtggccgccgccgccgccgcgcgcgctcctctggcggcggccgcggcggctggcgcccaccacgttctgctccgcgccgtcgctgcctcgcctgggacgcgtcggctggccgcgcagggaggggaacgcctggctgctctcgttccgcggcgacaccgccgcggcgccggaccccgcgctgggggacccctcgaaggcgctctccgcgctgctcccgcttgtcgtcgccgccaccgccgtcgcggcgctcgggaaccccgccaccttctcctgggtctcaaaggattactacgcgccggcgctcgggggcatcatgctgtccattggcatcaagctctccgtcgacgacttcgctctcgccttcaagaggcctgtgccactctccattggttatgccacacagtacgtgctcaagccactactgggcgtgatggttgcaaaggtattcaggatgccatcagcattcttcgcaggcttcatgcttacttgctgcgtctcaggcgctcagctctcaagctatgctagcttcctcagcaaaggggatgtggccttgagcattttattaacaagttactcaacaatatcttcggtggtcgtgacacctgttctcaccggattgttaatcggttcagtggtcccggttgatggaattgcgatggcaaaatctattcttcaggtggtgcttgttcctgtgacgctaggccttctcctgaatacctatgcgaagggagtggtgaatgtaatacaaccagcaatgccatttgttgctatggtgtgcacatctctctgtattggcagccctcttgctatcaataggagcaagatcctctctccagaaggattcttcttacttctccccatagttgctttccacattgtttcattcgttgcgggttactgggtctccaagttgccacaatggaggcaagaagagcctgtttgcaggacaatttccgtttgtactgggatgcaaagttccacccttgctggacttctcgcaacacaatttcttggaaccagtcaggcagttcctgcagcatgttctgttgtcatcatggccatttttggtttgactcttgcatcatactggggtagtggcttgcgaataagagatgtcgctgggggctttttaccacaagccacagcagctctgagcccgtgacaggcagcaggatgccgcatggtgatttttccatggatccccttgagagttgagagaccaattccagaaattcatttgccaaatgagactggagctacgagaaagtcgtccttcagcacaattttgcatgaggtacgccatggctgcaaaagagaactacaaattgtgggctttatgatgataaggatcaaggcgaccaaacttatgacaagaaccacttgtacaagatgctgagtttgcagtaatactcacatataatacggtatattgtaggttgggttagttgtctcttaccagctccttgtagatatagtcatatagataccactagacacgatccaggatgcttatatattggaggtgcagtgttatacatatttctgcgatatc

SEQ ID NO: 29855 - protein, 420 aa, Panicum virgatum
  misc_feature: Ceres CLONE 1893642
  misc_feature (132)..(312): Pfam Name: SBF Pfam Description: Sodium Bile acid symporter family
MAAAASCSHPPFSPAASLHHRPHGARRCGFSPLPWPPPPPRALLWRRPRRLAPTTFCSAPSLPRLGRVGWPRREGNAWLLSFRGDTAAAPDPALGDPSKALSALLPLVVAATAVAALGNPATFSWVSKDYYAPALGGIMLSIGIKLSVDDFALAFKRPVPLSIGYATQYVLKPLLGVMVAKVFRMPSAFFAGFMLTCCVSGAQLSSYASFLSKGDVALSILLTSYSTISSVVVTPVLTGLLIGSVVPVDGIAMAKSILQVVLVPVTLGLLLNTYAKGVVNVIQPAMPFVAMVCTSLCIGSPLAINRSKILSPEGFFLLLPIVAFHIVSFVAGYWVSKLPQWRQEEPVCRTISVCTGMQSSTLAGLLATQFLGTSQAVPAACSVVIMAIFGLTLASYWGSGLRIRDVAGGFLPQATAALSP

SEQ ID NO: 29856 - DNA, 626 bp, Panicum virgatum
  misc_feature: Ceres CLONE 1893644
  misc_feature: Encodes the peptide sequence at SEQ ID NO. 29857
gcgcaccccgctccaatggctgccacggctgtgaccgtgccctcctcgggcgtccccttccccgtctccaacaccgccgcacggcgctgcctgctactcccctccccgcttccccgccgagctctccgcgtcgtcgcctccgcggccaccgaagcgccgcccaagccgacgccgccgccgatctcgccctccggcatcgtgctcgttgaccccgcagaggcccagagggtgcaccggctcaaggccgtctacgaccagaaggtcgtcccgctcatcaccgaggagttcggctacacgaatgtccaccaggtggagaagattgtggtgaactgcggcctgggcgccgaggcgggcaactccaaggggctggaggccgccatgaaggacctcgccaatatcacaggccagtggcccgtcaagaccaaggccaagaagtcagtggccagcttcaagatccgtgagggaaacaccatcggtatcgcagtcaccctccgcggcaggataatgtacaacttcctggataggctcatcaaccttgggcttcctaggaccatggactttcttggcgtcaaccccaacagcttcgacgggcacggcaactacagtcttggcctccgtgatcaggg

SEQ ID NO: 29857 - protein, 203 aa, Panicum virgatum
  misc_feature: Ceres CLONE 1893644
  misc_feature (95)..(148): Pfam Name: Ribosomal_L5 Pfam Description: Ribosomal protein L5
MAATAVTVPSSGVPFPVSNTAARRCLLLPSPLPRRALRVVASAATEAPPKPTPPPISPSGIVLVDPAEAQRVHRLKAVYDQKVVPLITEEFGYTNVHQVEKIVVNCGLGAEAGNSKGLEAAMKDLANITGQWPVKTKAKKSVASFKIREGNTIGIAVTLRGRIMYNFLDRLINLGLPRTMDFLGVNPNSFDGHGNYSLGLRDQ

SEQ ID NO: 29858 - DNA, 625 bp, Panicum virgatum
  misc_feature: Ceres CLONE 1893667
  misc_feature: Encodes the peptide sequence at SEQ ID NO. 29859
  misc_feature (514)..(514): n is a, c, t, g, unknown, or other
ggccttcttcgacggcctgatccttgctggtttccaacgcttccaagcacggcgccatggcttcctctgcctccgggagggcaggacgaggagggctcccctcgcctgcggcggcggcggcggccgtggtgctgctaatactagctggagcggccccggcggcgggttgctacccgcgcgtgttcagcttcggggactcgctggccgacacggggaactacgccttcgtctacggcaacgactccagcgagcccgcgctccggctgccctacggcgagaccttcttccaccgcgccaccgggcgcttctccaatggccgcatcgtcctcgacttcatcgcggagacgctgggtctcccgttcgtgccgccgtacctgagcgggcggagcgcggaggacttcgcctgcggggccaacttcgccgtcggcggcgccacggcgctcagcccggacttcttccgggacaggggtatcgacgacatgggcgaccaagtgcacctcgacatggagatgangtggttccgcgagctgctcgacctcctctgccccggcaacctcgccggtatgtgtcttccatttttttacctccttcgattccctcttcctttgacctgacctccttttga

SEQ ID NO: 29859 - protein, 185 aa, Panicum virgatum
  misc_feature: Ceres CLONE 1893667
  misc_feature: SWISSPROT Homolog: EC 3.2.1.51 Alpha-L-fucosidase
  misc_feature (153)..(153): Xaa is any aa, unknown, or other
MASSASGRAGRGGLPSPAAAAAAVVLLILAGAAPAAGCYPRVFSFGDSLADTGNYAFVYGNDSSEPALRLPYGETFFHRATGRFSNGRIVLDFIAETLGLPFVPPYLSGRSAEDFACGANFAVGGATALSPDFFRDRGIDDMGDQVHLDMEMXWFRELLDLLCPGNLAGMCLPFFYLLRFPLPLT

SEQ ID NO: 29860 - DNA, 1823 bp, Panicum virgatum
  misc_feature: Ceres CLONE 1893681
  misc_feature: Encodes the peptide sequence at SEQ ID NO. 29861
actagtcgctcccaatcgcctcgcccgcccgccaccggtccggggcgatcaccgtccgaatccctcccgtcctgctcccgtcgccactgtgcgcgacgtcggtggtggtggtggcggcggcggcggcggcggccatggcagatgagttggaggcgacgcgtcacaagaagaggaggaagaagcacagggagcgtgcggaggtcacggcggcttcctcggagtctcctcgacccccggcgactcccttttccatgctggagtctccggcgccaatcgctcccgaaaccctaacctcgacggcggtggcagcgggcaaggggcgcaagaggaagcaggagttggcggcggcatctccattggtggaggaggccgagcggaaggaggagagaaagaagcacaagagaagcaggtatcaggaggcggcggctaccccatcgccgtccgcccctgccaccaccgcccaaatcttggagatggccgcggcgacaaaggagcagaggcggggtaatatggagcaggggcaatcctgccaggcgccattacccgtgggtgtccatccccaaggcggaggggcagcagcagctgatggtggtgctagtgttagtcggagtgtaaagaggttcagaggcggcaagatcccagtgctgagcgaccgcgagatcctcaggatgagaattgaggagttgaggaagcaacagccaatgccggcaggcttcgtccctgccatggcttatcccaatcccattgatcaggactccaattattcctctccttttggtgcgttctttgaccagttctgctacaagcctgaccgccaggaaggtcgcaatgctccatcacttccaaaaacccctgatcatccagccaggctgcttcctcaagatcacccaccatctctgtcttctcagctcactgcaaatgggacctttatggctgccatgacaacgacatcgaacacaaaacaaccacgctcagcatcagtctcacgtccacaagaagaggtaatggtaaaggaaaagaaaaggtctgagaagaaatttagcgagacgaagaagccaagaaaaaaatcaccatcgcttagtgctgctgagaaacggtcagacaagtatcgccgcctgccactgaaacagctggtacccccgccgcgttccaaacataacctcctgcaggagaagtatgcacctgacccctggaaggtcatggtaatatgtatgcttctcaacgtaacgacaggagctcaggtcaagaagaaagtgaagggcttctttaaacgctatcctgatgctcagactgcatatacagctgatcctgaaaagatggcaaagtatctagcacctctgggatgccagcgtgtgaaagcaaagaggatccagagattctctagggcttatgctgaagaggaatggacctacattacagagctttgtggcattggcaagtatgcagctgatgcttatgcaatcttttgcgctggaagggcaacagaggtggttccagaagatcacaagttagttctttactggaagttcgcctgcaagttaagcttaactcaggcatcgcaaaacgcgcaggaggctgcagaagcaactatgcaggggaactttgctccctagttgcagcaaatcgctttcagctgttgaaaaggaaaggggcggtggcagcgcaaatgctttaatgttttgatttgcagcataatgtaatgtggtgatgtgtcagctagctcttaacatttagctgattattaaatatgctactgcctgtaactaagtttaagctgctagtttaacttggtagaaatggaaagcttatggtaaccatggccg

SEQ ID NO: 29861 - protein, 492 aa, Panicum virgatum
  misc_feature: Ceres CLONE 1893681
  misc_feature (357)..(484): Pfam Name: HhH-GPD Pfam Description: HhH-GPD superfamily base excision DNA repair protein
MADELEATRHKKRRKKHRERAEVTAASSESPRPPATPFSMLESPAPIAPETLTSTAVAAGKGRKRKQELAAASPLVEEAERKEERKKHKRSRYQEAAATPSPSAPATTAQILEMAAATKEQRRGNMEQGQSCQAPLPVGVHPQGGGAAAADGGASVSRSVKRFRGGKIPVLSDREILRMRIEELRKQQPMPAGFVPAMAYPNPIDQDSNYSSPFGAFFDQFCYKPDRQEGRNAPSLPKTPDHPARLLPQDHPPSLSSQLTANGTFMAAMTTTSNTKQPRSASVSRPQEEVMVKEKKRSEKKFSETKKPRKKSPSLSAAEKRSDKYRRLPLKQLVPPPRSKHNLLQEKYAPDPWKVMVICMLLNVTTGAQVKKKVKGFFKRYPDAQTAYTADPEKMAKYLAPLGCQRVKAKRIQRFSRAYAEEEWTYITELCGIGKYAADAYAIFCAGRATEVVPEDHKLVLYWKFACKLSLTQASQNAQEAAEATMQGNFAP

SEQ ID NO: 29862 - DNA, 708 bp, Panicum virgatum
  misc_feature: Ceres CLONE 1893687-R
  misc_feature: Encodes the peptide sequence at SEQ ID NO. 29863
tatgtgttcaatttgtctgtgcagagtcagatcattaccggtgatcgtgttcctgccgcctctggtttctgtgcgagagctcttccgatgaggggtttctccacggtgggaaatgctgaggttgcttcagacgatgaggattccagctctccagcggttgcgcaccccccacggattaagttcaagaggctcgacaagactgccaggcacatcatgaatatcttgaacaaagaggcagttgaaaaggtccgctctgagagggagattcctgatgtacaacctggatgtatcattcaaatgagattgcaagttcctgagaacaaacggcgagaatctacattgaaagggattgtgataggaaggcgtaatgctgggatcaatacaactttcagacttcgtagattagtagctggtattggagttgagtctgtctttccactctactcaccaaacatcaaagaaatcaagatattggacaggaagaaagtcaggagagctaagctgtattacctgagggacaggatgaacgcacttaaaaaatgagacagatttcaacttgtttttaggattttgtcctgtggatttgcatggtttctgaagatgcagaaaattgcagtttgagaatcacatatttttagtccaattttggatgtcacaatttgtagttcccaagcagcaagtgctagtagagatatgactttatgattc

SEQ ID NO: 29863 - protein, 180 aa, Panicum virgatum
  misc_feature: Ceres CLONE 1893687-R
  misc_feature (72)..(178): Pfam Name: Ribosomal_L19 Pfam Description: Ribosomal protein L19
YVFNLSVQSQIITGDRVPAASGFCARALPMRGFSTVGNAEVASDDEDSSSPAVAHPPRIKFKRLDKTARHIMNILNKEAVEKVRSEREIPDVQPGCIIQMRLQVPENKRRESTLKGIVIGRRNAGINTTFRLRRLVAGIGVESVFPLYSPNIKEIKILDRKKVRRAKLYYLRDRMNALKK

SEQ ID NO: 29864 - DNA, 1256 bp, Panicum virgatum
  misc_feature: Ceres CLONE 1893687
cggatcggatcctgagccctcgtgagcgacggctgggggcgaggcggcggcgcgacgcggcgtgaggggagttgacggcgcagcacaaggcgacggcgaccgctccgccgccttctcgccgggtaatttgggagatggccttcctgcagaaggttggcaatcttgtcaagcggtccacgggtgccagctcgtcactctaccaggcggttcgatgcatgtcctcgtccaaactcttcataggaggtcccgggttctccactccacactgacactgctaatccatttctctttgtttgttttcctgaatggctggatacttttagatttgattgccacagaatggttcagataattgtacaaaaccattgttctgctgtgttgtgcttactaatttggcatccttgcaggaatctcgtatggcacagatgagcacagcctcagggatgcgcggtttgcattggtagtacctcaatgccaaatggaacatatgggtttgcattggtgctgctgggtcacatatgtacttgtgatcttgaagttccattcgatgttgtagacagcaatgctacgtgtggtgcatttggttttctgatttcatcttacaactattagttgatattacagtttttaacttgcatgagatgcaagaaatatagaataatttcatataatcaaccttactcttatgattggttggtgccttaatattgctcttctggtttgttatctatagtaaattccatggataggcccttaaacttggacaagcgtctcatctaggtatctgaacttgagaaataaacatttatgtcgttgaacttgtataaagtgggtcagcagacttccaagtctcttttaattttgaatgaaataggagaaaaaatcttggcttattctgaattgttgttttaacacaccatcatcgatcgaactgatgaaaagttgatgtttgtacttttaagataaatattcagtgcatttttataagtattatcatctctcgtctaatatttctgattttctgatcaattattttctcaaatataacttaagaaaagtgaatgtgccatgtcaccaaaacctgtgaattaagctggaatagtccctgctttgacacagcgtaccagtgaaagaaccagatttgcaacatatttgagcctaatggtcatgggctgaagtgagattgtcatgcaagtttagggatttatggtgcatttttaaggttttatacttaagatatgacaatggtgtattgt

SEQ ID NO: 29865 - DNA, 2392 bp, Panicum virgatum
  misc_feature: Ceres CLONE 1893693
  misc_feature: Encodes the peptide sequence at SEQ ID NO. 29866
gcacctcaccggagatgggatcatgggaggttgctactgtttcctccgcttcttgatcgccttcgtactgctccacttccacggcgccgccagtcagtccctgaaccagacttgccaccccgccgacctgcaggcgctccttgacttctccaatggcttggacagcaaggccgccgggctcgtcgggtggggtcccggcgacgccgcctgctgttcctggaccggcgtcgcctgcgattttgggagggtggtcggcctggatctctccaacaagagcctccgcggcgacctctcctcctcggtcgcctccctcgacggcctcgtcacgctcaacctctcctggaactcgctccgcggcgcggcgccggcggtgctcggccggctggcgaggctgcgcgtgctcgacctcagcatgaacgggctctccggcccatttccggcgagcgacagcggcttctcggcgatcgaggtggtcaacatctcctccaacagcttcgacgggccgcacccagcgttcccgggcgcggcgaacctgacggttcttgatatctccggcaacagcttctccggcggcatcaactcgtccacgctctgccttgcgccggttgaggtcctgcggttcacgatgaatggcttctccggcaaggtccctagcggcctgagccgatgcaaggcgctcgcggagctctctctaggcggcaatgacttatttgggaacatccctagcgacctgtatacgttgcccaagttgaggaggctgaacttacaggaaaaccagctcaccggcaacctccacaatgaccttggtaacctatctcagcttgtgcagcttgacttgtcctataacatgttcacaggcttcattcctgatgtgttcggaagtatgaggtggcttgaatccgtaaacttggcctccaataggttcgatggtgaattacctgcttccctgtcaagttgtcgaatgctgagggtaatcagcttaaggaacaactatctgtctggtgaaattgctatcaatttcaaattgctgcataaactgaacacttttgatactggaaccaacaatctgagcggtcctataccttctggcatcgccgtgtgcaccgagttgaggacgttgaaccttggaaggaacaagcttatgggggagataccggagagcttcaaggatttgagatctctgtcgtacctctccctgacaggaaatgacttcatgaacctgtcatcggcattgcaagtgttgcaacacctgcccaacctgaccaatttagttgtcaccaggaatttccgtggtggtgagacaatgccagtggatggaatcaatgggttcaagagcatgcaggtgcttgtcctggcaaactgtttactcactggcataattccgccatggctgcagggcttagaaagtctcaatgtcctggacatttcatggaacaagttaaacgggaacatcccgccatggctagggaagctgaacaatctcttctacgtcgacctgtcaaacaattcgttcactggggagcttcctatgagcttcacacagatgaggagtttgatttcaagtaatggctcgagtgggcagtcaccaacagaggacctgccattattcatcaagaagaattcaactggcagaggtttgcagtacaaccaagtcagcagctttccaccttctcttatactctcaaacaacttgcttgttggtccaatctggtcaagctttggtcatcttgtgaagcttcatgtgctggacttgagctggaacatcttctcaggaccaattcctgatgaattgtcaagtatgtcgagcttggaaatgctgaatttgggccacaacaatctcaatgggacaataccctcatctctaacgaagctgaattttctctccaagtttgatgtgtcatacaacaatttgactggacatatccctactggtgggcaattctccacattcacaaatgaggattttgaaggcaactctgcactctgccttcttcggagttcttcatgctccgaaaaggcttatttttcggaggaaattcatgacacggacattgcaatgcatattacatacaccattgttggagcaggatttgtttttgggcttctggtggtctcgactactctgttgtttgcaaaggcttggagggctgcgtattttctgatgattgataggttctttagtacgctgtatgttttgacaatggtgaacgtgaacagactcagaaggacatgggagaatgaagttcatccttaaagaacttccggtgctggttttcacaggttctagcttggtgctactgtatagatgtttaactgtaccatatagtattacagttgtctattggaatgtttgatcgtagtagcgtcatgaatggatttatcattttatggc

SEQ ID NO: 29866 - protein, 743 aa, Panicum virgatum
  misc_feature: Ceres CLONE 1893693
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MGGCYCFLRFLIAFVLLHFHGAASQSLNQTCHPADLQALLDFSNGLDSKAAGLVGWGPGDAACCSWTGVACDFGRVVGLDLSNKSLRGDLSSSVASLDGLVTLNLSWNSLRGAAPAVLGRLARLRVLDLSMNGLSGPFPASDSGFSAIEVVNISSNSFDGPHPAFPGAANLTVLDISGNSFSGGINSSTLCLAPVEVLRFTMNGFSGKVPSGLSRCKALAELSLGGNDLFGNIPSDLYTLPKLRRLNLQENQLTGNLHNDLGNLSQLVQLDLSYNMFTGFIPDVFGSMRWLESVNLASNRFDGELPASLSSCRMLRVISLRNNYLSGEIAINFKLLHKLNTFDTGTNNLSGPIPSGIAVCTELRTLNLGRNKLMGEIPESFKDLRSLSYLSLTGNDFMNLSSALQVLQHLPNLTNLVVTRNFRGGETMPVDGINGFKSMQVLVLANCLLTGIIPPWLQGLESLNVLDISWNKLNGNIPPWLGKLNNLFYVDLSNNSFTGELPMSFTQMRSLISSNGSSGQSPTEDLPLFIKKNSTGRGLQYNQVSSFPPSLILSNNLLVGPIWSSFGHLVKLHVLDLSWNIFSGPIPDELSSMSSLEMLNLGHNNLNGTIPSSLTKLNFLSKFDVSYNNLTGHIPTGGQFSTFTNEDFEGNSALCLLRSSSCSEKAYFSEEIHDTDIAMHITYTIVGAGFVFGLLVVSTTLLFAKAWRAAYFLMIDRFFSTLYVLTMVNVNRLRRTWENEVHP

SEQ ID NO: 29867 - DNA, 2462 bp, Panicum virgatum
  misc_feature: Ceres CLONE 1893703
  misc_feature: Encodes the peptide sequence at SEQ ID NO. 29868
acgcatgcagcacaaccacaggggcgcgagagggagatcgagcacccacctgctctcggtcggtgttgagacaatccaatccacagtgttgtgcttcttccccgaccggccgccatcgaccggcttaatttagccctcagactgagagaggagatagtggccacacaaggacggacactccctccccggttcgatttcctcgtcgatccgctcctcccgttcccgtccccgtccccggccccgtctccgatccgcgggtaggatagtgcgactgattgatccggtcgaccaccggagttcatggggacagctgccggcgatgggggccaccccctcggcgcggcggcggcggagcacaaggtgaacctgacggcgcagcggccgttcgcggaggtgctgcggacgggcctcgcggagacgttcttccccgacgacccgttccgggggttcgggtcgctcccgcccgccgagcgcgcgtggggcgggctcaagtacttcgtcccggccctcgagtgggcgccgcgctacaccctcggcaagttcaagtacgacctcctcgccggcgtcaccatcgccagcctcgccatcccgcagggcatcagctacgccaagctcgccaacctcccgcccatcatcggcctctattcgagcttcgtgccgccgctgctgtacgcggtgttcgggagctccaacaacctggcggtggggacggtggcggcggcgtcgctgctgctggcgtccatcgtcgaggcggaggtcccgcgggacgacaacccggagctgtacctgcagatcttctacaccgccgccttcttcaccggcgtcatccagaccgcactgggcgtcttcaggttaggtctgatagtggatttcctgtcgcggtcgaccatcaccgggttcatgggcggcacggcggcgatcatcatcctgcagcagctcaaggggatgctggggatgaagcacttcacgtccaagaccgacgtcgtctccgtcgtgcgctccatcttcctttacagggacgagtggaggtggcagagtgcagttctcggcgtaggcttcctcctgttcttgctgttaagcaagcaactgagaaagaaaaggccaaacttgttctgggtgtcggccattgcgccattcatggttgtcatcatcggtggcatcttcgctttcttggtcaaaggaaacgagcacgggatcccaattgtaggtgacctgaagaaagggatcaatccactgtccatttcgcagctaacgttcaagggcaagcacgtcaacacagctgtgaaagcaggattcttgtctgggatcctcgcactggcagaagggatcgccgtcggccggagcctggcgctgatcaagaacgagcagatcgacgggaacaaggagatgatcgcgttcggcatcatgaacatcgcggggtcctgcacctcctgctacctcacgacgggccccttctccaagtctgcggtgaacttccacgccgggtgccggacgcccatgtcgaacgtggtgatgtcggtgtgcatcatgctggtgctgctgttccttgctccgctcttcaagtacaccccgctggtggcgctgtcctccatcatcgtggtcgccatgatcgggctcatcaaggtcaaggagttcctacacctctaccgggtggacaagttcgacttctgcatctgcatggtcgccttcgtcggcgtcgtcttcttcaccatggtcatcggcctcggcgcatcaataggcttgtcagtgatcagagcactgctgcacgtagcgaggccgaccacctgcaagctcggaagcatggcgggaggcgagatcttctgcgacgtcaggcactacccgcacgcgaggaacatccccaacgttctcgtgctgcagctgggatctcccatctatttcgtcaacgcgggttacttgcgagaaaggattttgagatgggtagaagatgaggagagcgttagcaaggcagacgggcaagatctacagtacgtgatccttgatcttggtggtgtcagttcgatcgacaacacggggatcgggatgctaggagaagttcacaagagccttgaccggaaaggggtcacggtagctctgacgaaccccaggctggaggtaacagagaagctggtgctgtccgggttcatcagggacaaggtagggaaggagtgggtgttcctcacagtgaaggacgccatcacggcgtgccggtacgggctccagagatccagaggcaagcaggaggacagtgaagtatagctagtgaccagtgtccatggattgtgtgtgttttaggaaggcagatgtaggtgtagatattgttgggtggctcagcatggatattgcgtgtggaactgggtggggataggtctttggtagcagtttgcataacgcagaagaataggataatagctcttgtttgctagaagtgatgggaaaccacgaactggaagagtttcttttag

SEQ ID NO: 29868 - protein, 651 aa, Panicum virgatum
  misc_feature: Ceres CLONE 1893703
  misc_feature (180)..(490): Pfam Name: Sulfate_transp Pfam Description: Sulfate transporter family
  misc_feature (513)..(631): Pfam Name: STAS Pfam Description: STAS domain
MGTAAGDGGHPLGAAAAEHKVNLTAQRPFAEVLRTGLAETFFPDDPFRGFGSLPPAERAWGGLKYFVPALEWAPRYTLGKFKYDLLAGVTIASLAIPQGISYAKLANLPPIIGLYSSFVPPLLYAVFGSSNNLAVGTVAAASLLLASIVEAEVPRDDNPELYLQIFYTAAFFTGVIQTALGVFRLGLIVDFLSRSTITGFMGGTAAIIILQQLKGMLGMKHFTSKTDVVSVVRSIFLYRDEWRWQSAVLGVGFLLFLLLSKQLRKKRPNLFWVSAIAPFMVVIIGGIFAFLVKGNEHGIPIVGDLKKGINPLSISQLTFKGKHVNTAVKAGFLSGILALAEGIAVGRSLALIKNEQIDGNKEMIAFGIMNIAGSCTSCYLTTGPFSKSAVNFHAGCRTPMSNVVMSVCIMLVLLFLAPLFKYTPLVALSSIIVVAMIGLIKVKEFLHLYRVDKFDFCICMVAFVGVVFFTMVIGLGASIGLSVIRALLHVARPTTCKLGSMAGGEIFCDVRHYPHARNIPNVLVLQLGSPIYFVNAGYLRERILRWVEDEESVSKADGQDLQYVILDLGGVSSIDNTGIGMLGEVHKSLDRKGVTVALTNPRLEVTEKLVLSGFIRDKVGKEWVFLTVKDAITACRYGLQRSRGKQEDSEV

SEQ ID NO: 29869 - DNA, 1303 bp, Panicum virgatum
  misc_feature: Ceres CLONE 1893706
  misc_feature: Encodes the peptide sequence at SEQ ID NO. 29870
gcctgacctcgcccccgccgccagtgcctcctccggctccggcggcctccgccgccctccgtcaccgccggacactaacccatttgagccatttgcccccgccgcctccaccgcccaccgggggtcctccaccgcccggttccggcggcgcaggcgaggcgccgcctccgctccgccgccgtctctcccgcctccaccgccggccggcgagccaccccgtagctccctttacaaccgggcaccgagtgagtcgattcccttcgatccggaatccgccaccgacgcacgcacgattatattctttccgacgctctcgctttctctccccacatcggcggcggcggtgcgagcggagaagccaaggggtttagtgcctgcactgcattagatatgagtaagggattcttactgtctgcaatgacttcaacaaagaagaaggggttcttggttaggttctctgcctgatccaaattaattctgcagaaagattcgagatttgggtactggaattttgttgattggcaagaggccggaggtgttaagcagatgggtgtggtgacgagggtcaagaagcggaggctggatgaggaatccatcaacccagaactggcacctcgaggaggagaagacctgataagccgcctcccggacgatatcctcatcggcatcatcaccatcctccctggcaaggatgccgcctgcacacagatgctctcgcggcggtggcgccctctctggcgctctgcacctctcaatctcgaggccagggtcaatggcggtacagtgggaatggatgtggccaccatcttcagcactctgcgaagccacaagggccctgtccgtcgattctccatcagttggagctacgacagttctggtcactttcccgtcgttgattccatacttggatcccccaggctcgacaacctccaggagtttgaactgttctataataataatcgctctcaaaatcatccagttccacggtctgtactctgtctatctcatactctccgagttctcagcattcggtcattgtgtgacatacttcagtttcccatggagactgcttgcatgctcagtttcccatacctcaaggagctcgccctatccactgtcaacatcacggataacactatccattgtcttctttcacaaagccctgtcttggagagcttggtgctggatgagaacaggggctgtcgtcgtctccggatctgctccttgagccttcggagccttggtgtgtcagatacttatttctctgtagagggaaagctggaggaagtaattattgaaaatg

SEQ ID NO: 29870 - protein, 252 aa, Panicum virgatum
  misc_feature: Ceres CLONE 1893706
  misc_feature (28)..(75): Pfam Name: F-box Pfam Description: F-box domain
MGVVTRVKKRRLDEESINPELAPRGGEDLISRLPDDILIGIITILPGKDAACTQMLSRRWRPLWRSAPLNLEARVNGGTVGMDVATIFSTLRSHKGPVRRFSISWSYDSSGHFPVVDSILGSPRLDNLQEFELFYNNNRSQNHPVPRSVLCLSHTLRVLSIRSLCDILQFPMETACMLSFPYLKELALSTVNITDNTIHCLLSQSPVLESLVLDENRGCRRLRICSLSLRSLGVSDTYFSVEGKLEEVIIEN

SEQ ID NO: 29871 - DNA, 678 bp, Panicum virgatum
  misc_feature: Ceres CLONE 1893706-R
taaaggaaacttcaagaatgtacggcgatacgtttcacttgagtgccttgatctacatctcaggatggtggaatttattaactatcagggagacttgacagatttgaacttcatcaagttcttattaaatgctcgagtgctagaatgtataaagtttgtagcccgtcgtgacaagtgtgatgcaaaatggatacaaaaacaatatcagaggctacaactttattctagagcttcacggggcgttacacttgattttcaagctgattatagggtggatagtttggtacacatgaagcacatctgtgatttgactaaagatgatccctttgatagatcattttgtagatgccgtgatgaggaaatatgagttccttttttagctgtttatcagtctaatgcattggtgtatggacatattgatgttgctaggcggaaaggactactatgctgctatgttgacaaccaagtgcaattttgaattctgatagacccaatatgtatcgtcttttggatagttcactgcagatttaagttatgtcattaatgtactctatttataaattgtgtttgtgttttgtctcaaatcctgtggccatgataggactcattttttaatattacgggggataactacataatggtccgtagtgggaaaaatataagttgcttgtttgcacc
